US009493785B2

(12) United States Patent
Granevitze et al.

(10) Patent No.: US 9,493,785 B2
(45) Date of Patent: Nov. 15, 2016

(54) ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY

(75) Inventors: Zur Granevitze, Petach-Tikva (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 499 days.

(21) Appl. No.: 13/519,634

(22) PCT Filed: Dec. 22, 2010

(86) PCT No.: PCT/IB2010/056023
§ 371 (c)(1),
(2), (4) Date: Jun. 28, 2012

(87) PCT Pub. No.: WO2011/080674
PCT Pub. Date: Jul. 7, 2011

(65) Prior Publication Data
US 2012/0297504 A1 Nov. 22, 2012

Related U.S. Application Data

(60) Provisional application No. 61/282,183, filed on Dec. 28, 2009, provisional application No. 61/345,205, filed on May 17, 2010.

(51) Int. Cl.
*A01H 1/00* (2006.01)
*C12N 15/82* (2006.01)
*C07K 14/415* (2006.01)
*A01H 5/00* (2006.01)
*C12N 15/00* (2006.01)

(52) U.S. Cl.
CPC ......... *C12N 15/8261* (2013.01); *C07K 14/415* (2013.01); *C12N 15/8271* (2013.01)

(58) Field of Classification Search
None
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Alexandrov et al., A Geneseq Database, Acc. No. AAG49032, EP1033405A2, Sep. 6, 2000, see Result 7.*
Mayer et al., Acc. No. Q8H1G2, UniProt database, Nature 402:769-777, 1999.*
Yamada et al., GenEmbl Database, Direct submission, Accession No. AY045999.*
Restriction Official Action Dated Nov. 13, 2012 From the US Patent and Trademark Office Re. U.S. Appl. No. 12/992,902.
Backhaus et al. "Nucleotide Sequence of A cDNA for A P2 60S Acidic Ribosomal Protein From Parthenium Argentatum", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Advisory Action Before the Filing of an Appeal Brief Dated Aug. 29, 2012 From the US Patent and Trademark Office Re. U.S. Appl. No. 12/457,199.

(Continued)

Primary Examiner — Phuong Bui

(57) ABSTRACT

Provided are isolated polynucleotides encoding a polypeptide at least 80% homologous to the amino acid sequence selected from the group consisting of SEQ ID NOs: 799, 488-798, 800-813, 4852-5453, 5460, 5461, 5484, 5486-5550, 5553, and 5558-8091; and isolated polynucleotide comprising nucleic acid sequences at least 80% identical to SEQ ID NO: 460, 1-459, 461-487, 814-1598, 1600-1603, 1605-1626, 1632-1642, 1645-4850 or 4851. Also provided are nucleic acid constructs comprising same, isolated polypeptides encoded thereby, transgenic cells and transgenic plants comprising same and methods of using same for increasing yield, biomass, growth rate, vigor, oil content, fiber yield, fiber quality, abiotic stress tolerance, and/or nitrogen use efficiency of a plant. Also provided are isolated polynucleotides comprising the nucleic acid sequence set forth by SEQ ID NO:8096, wherein the isolated polynucleotide is capable of regulating expression of at least one polynucleotide sequence operably linked thereto.

17 Claims, 13 Drawing Sheets

(56) References Cited

U.S. PATENT DOCUMENTS

| | | |
|---|---|---|
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,981,834 A | 11/1999 | John et al. |
| 6,080,914 A | 6/2000 | Conner |
| 6,084,153 A | 7/2000 | Good et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,472,588 B1 | 10/2002 | Haigler et al. |
| 6,670,528 B1 | 12/2003 | Shinozaki et al. |
| 6,720,477 B2 | 4/2004 | da Costa e Silva et al. |
| 7,214,786 B2 | 5/2007 | Kovalic et al. |
| 7,554,007 B2 | 6/2009 | Ronen et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1 | 2/2004 | Liu et al. |
| 2004/0123343 A1 | 6/2004 | La Rosa et al. |
| 2004/0172684 A1 | 9/2004 | Kovalic et al. |
| 2004/0181830 A1 | 9/2004 | Kovalic et al. |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 | 7/2006 | Alexandrov et al. |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalic et al. |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0196120 A1 | 8/2008 | Wu et al. |
| 2008/0301839 A1 | 12/2008 | Ravanello |
| 2009/0089898 A1 | 4/2009 | Karchi et al. |
| 2009/0093620 A1 | 4/2009 | Kovalic et al. |
| 2009/0094717 A1 | 4/2009 | Troukhan et al. |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2013/0125258 A1 | 5/2013 | Emmanuel et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| CN | 1823168 | 8/2006 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| JP | 2005-052114 | 3/2005 |
| JP | 2005-185101 | 7/2005 |
| RU | 2350653 | 3/2009 |
| WO | WO 2007/020638 | 0/2007 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/26639 | 12/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058961 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |

(56) References Cited

FOREIGN PATENT DOCUMENTS

| WO | WO 2008/122980 | 10/2008 |
|---|---|---|
| WO | WO 2009/009142 | 1/2009 |
| WO | WO 2009/013750 | 1/2009 |
| WO | WO 2009/083958 | 7/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |
| WO | WO 2015/181823 | 12/2015 |

OTHER PUBLICATIONS

Examination Report Dated Aug. 16, 2012 From the Instituto Mexicano de la Propiedad Industrial Re. Application No. MX/a/2010/014097 and Its Translation Into English.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the International Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Bautista et al. "Arabidopsis Thaliana At5g06690 mRNA, Complete Cds", Unpublished, The Salk Institute for Biological Studies, La Jolla, CA, USA, GenBank: BT029447, Nov. 15, 2006.
Castelli et al. "Arabidopsis Thaliana Full-Length cDNA Complete Sequence From Clone GSLTFB52ZA10 of Flowers and Buds of Strain Col-0 of Arabidopsis Thaliana (*Thale Cress*)", GeneBank Direct Submission BX829993, Accession No. BX829993, Feb. 6, 2004.
Cheuk et al. "Arabidopsis Thaliana At2g40550 Gene, Complete CDS", Database EMBL [Online], XP002673499, Retrieved From EBI Accession No. EM PL: BT022032.1, Database Accession No. BT022032, May 4, 2005.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Matsumoto et al. "*Hordeum vulgare* Subsp. Vulgare, Full-Length cDNA", UniProtKB/TrEMBL, ID: F2DLE8-HORVD, UniProt Accession No. F2DLE8, May 31, 2011.
Rounsley et al. "Arabidopsis Thaliana Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig. S6, p. 1844-1845.
Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
Invitation to Pay Additional Fees Dated Oct. 17, 2012 From the International Searching Authority Re. Application No. PCT/IL2012/050154.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus Solanum Lycopersicum cDNA Clone cLEC80A19 5-end, mRNA Sequence", GenBank: BI923254.1, GenBank Accession No. BI923254, Oct. 17, 2001.
Communication Under Rule 71(3) EPC Dated Nov. 19, 2012 From the European Patent Office Re. Application No. 08738191.9.
Notice of Allowance Dated Nov. 19, 2012 From the US Patent and Trademark Office Re. U.S. Appl. No. 13/450,547.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Patent Examination Report Dated Dec. 12, 2012 From the Australian Government, IP Australia Re. Application No. 2008236316.
Communication Pursuant to Article 94(3) EPC Dated Dec. 19, 2012 From the European Patent Office Re.: Application No. 04734072.4.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Communication Pursuant to Article 94(3) Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.

(56) References Cited

OTHER PUBLICATIONS

Invitation to Pay Additional Fees Dated Dec. 31, 2012 From the International Searching Authority Re. Application No. PCT/IL2012/050327.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Translation of Notice to Amendment Dated Aug. 31, 2012 From the Thai Patent Office, Department of Intellectual Property Office Re. Application No. 0901000235.
Translation of Office Action Dated Feb. 25, 2013 From the State Intellectual Property Office of the People's Republic of China Re. Application No. 200910217137.1.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.
Restriction Official Action Dated Mar. 1, 2013 From the US Patent and Trademark Office Re. U.S. Appl. No. 13/254,183.
Notice of Allowance Dated Apr. 8, 2013 From the US Patent and Trademark Office Re. U.S. Appl. No. 12/594,853.
Requisition by the Examiner Dated Mar. 25, 2013 From the Canadian Intellectual Property Office Re. Application No. 2,619,114.
International Search Report and the Written Opinion Dated Apr. 10, 2013 From the International Searching Authority Re. Application No. PCT/IL2012/050327.
Invitation to Pay Additional Fees Dated Apr. 8, 2013 From the International Searching Authority Re. Application No. PCT/IL2013/050172.
Requisition by the Examiner Dated Apr. 11, 2013 From the Canadian Intellectual Property Office Re. Application No. 2,626,592.
Translation of Office Action Dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Examination Report Dated Mar. 23, 2013 From the Government of India, Patent Office, Intellectual Property Building Re. Application No. 2570/CBENP/2008.
Communication Pursuant to Article 94(3) EPC Dated May 8, 2013 From the European Patent Office Re. Application No. 08776651.5.
Translation of Office Action Dated Sep. 13, 2012 From the State Intellectual Property Office of the People's Republic of China Re. Application No. 200910217137.1.
Restriction Official Action Dated Apr. 4, 2013 From the US Patent and Trademark Office Re. U.S. Appl. No. 13/125,047.
Requisition—Sequence Listing Dated May 8, 2013 From the Canadian Intellectual Property Office Re. Application No. 2,753,616.
Notice of Allowance Dated Nov. 15, 2013 From the US Patent and Trademark Office Re. U.S. Appl. No. 12/669,975.
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.
Invitation to Pay Additional Fees Dated Dec. 18, 2008 From the International Searching Authority Re.: Application No. PCT/IL08/01024.
Advisory Action Before the Filing of an Appeal Brief Dated Aug. 5, 2011 From the US Patent and Trademark Office Re. U.S. Appl. No. 12/083,978.
Communication Pursuant to Article 93(3) EPC Dated Jun. 15, 2012 From the European Patent Office Re. Application No. 11154193.4.
Communication Pursuant to Article 94(3) EPC Dated Apr. 3, 2012 From the European Patent Office Re.: Application No. 06766224.7.
Communication Pursuant to Article 94(3) EPC Dated Mar. 8, 2011 From the European Patent. Office Re.: Application No. 06809784.9.
Communication Pursuant to Article 94(3) Dated Nov. 8, 2010 From the European Patent Office Re.: Application No. 04734072.4.
Communication Pursuant to Article 94(3) Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) Dated Feb. 14, 2012 From the European Patent Office Re.: Application No. 04734072.4.
Communication Pursuant to Article 94(3) EPC Dated Mar. 14, 2011 From the European Patent Office Re. Application No. 07849616.3.
Communication Pursuant to Article 94(3) EPC Dated Nov. 19, 2010 From the European Patent Office Re.: Application No. 06809784.9.
Communication Pursuant to Article 94(3) EPC Dated Jun. 21, 2012 From the European Patent Office Re. Application No. 11154213.0.
Communication Pursuant to Article 94(3) EPC Dated Nov. 17, 2009 From the European Patent Office Re.: Application No. 06809784.9.
Communication Pursuant to Article 94(3) EPC Dated Jun. 29, 2011 From the European Patent Office Re. Application No. 08738191.9.
Communication Pursuant to Rule 55 EPC Dated Mar. 16, 2012 From the European Patent Office Re. Application No. 11190921.4.
Communication Pursuant to Rule 58 EPC or Rule 159 EPC, invitation to Remedy Deficiencies in the Application Documents Dated Jan. 19, 2012 From the European Patent Office Re. Application No. 11190922.2.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) and of the Examination Fee (Art. 94(1)—and Invitation Pursuant to Rule 70a(1) EPC Dated Jul. 25, 2011 From the European Patent Office Re. Application No. 11154213.0.
Communication Pursuant to Rule 70(2) EPC and Reference to Rule 39(1) EPC Dated Sep. 13, 2010 From the European Patent Office Re.: Application No. 09163033.5.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Communication Pursuant to Rules 70(2) and 70a(2) EPC Dated Jan. 19, 2012 From the European Patent Office Re. Application No. 09807983.3.
Communication Pursuant to Rules 70(2) and 70a(2) EPC Dated May 24, 2011 From the European Patent Office Re. Application No. 09750276.9.
Communication Relating to the Results of the Partial International Search Dated Jul. 8, 2009 From the International Searching Authority Re.: Application No. PCT/IL2008/001657.
Communication Under Rule 71(3) EPC Dated Jun. 5, 2012 From the European Patent Office Re.: Application No. 06809784.9.
Communiciation Pursuant to Rules 70(2) and 70a(2) EPC Dated Aug. 30, 2010 From the European Patent Office Re. Application No. 08738191.9.
Decision on Granting a Patent for Invention Dated Dec. 7, 2010 From the Rospatent, Federal State Institution, Federal Institute for Industrial Property of the Federal Service for Intellectual Property, Patents and Trademarks of the Russian Federation Re. Application No. 2008120395 and Its Translation Into English.
European Search Report and the European Search Opinion Dated Nov. 2, 2011 From the European Patent Office Re. Application No. 10194223.3.

(56) References Cited

OTHER PUBLICATIONS

European Search Report and the European Search Opinion Dated Oct. 6, 2011 From the European Patent Office Re. Application No. 11172514.9.
European Search Report and the European Search Opinion Dated Aug. 9, 2010 From the European Patent Office Re.: Application No. 09163033.5.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Nov. 3, 2010 From the Government of India, Patent Office Re.: Application No. 158/CHENP/2007.
Examination Report Dated Nov. 13, 2007 From the Government of India, Patent Office Re.: Application No. 3482/CHENP/2005.
Examination Report Dated Feb. 17, 2010 From the Instituto Mexican de la Propriedad Industrial Re. Application No. PA/a/2005/012565 and Its Summary in English.
Examination Report Dated Apr. 19, 2011 From the Instituto Mexican de la Propriedad Industrial Re. Application No. MX/a/2008/002262 and Its Summary Into English.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examination Report Dated Sep. 22, 2010 From the Instituto Mexican de la Propriedad Industrial Re. Application No. MX/a/2008/005280 and Its Summary Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.3
Examiner's Report Dated Jan. 10, 2012 From the Australian Government, IP Australia Re. Application No. 2005234725.
Examiner's Report Dated Jan. 13, 2011 From the Australian Government, IP Australia Re. Application No. 2005252469.
Examiner's Report Dated Jan. 13, 2012 From the Australian Government, IP Australia Re. Application No. 2011239323.
Examiner's Report Dated Mar. 15, 2012 From the Australian Government, IP Australia Re. Application No. 2011239323.
Examiner's Report Dated Dec. 17, 2009 From the Australian Government, IP Australia Re. Application No. 2005252469.
Examiner's Report Dated Oct. 19, 2011 From the Australian Government, IP Australia Re. Application No. 2006281018.
Examiner's Report Dated Dec. 20, 2011 From the Australian Government, IP Australia Re. Application No. 2005234725.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Oct. 28, 2011 From the Australian Government, IP Australia Re. Application No. 2006307457.
Examiner's Report Dated Jun. 30, 2011 From the Australian Government, IP Australia Re. Application No. 2006307457.
Examiner's Report Dated Jan. 31, 2012 From the Australian Government, IP Australia Re. Application No. 2006281018.
Examiner's Report Dated Mar. 31, 2011 From the Australian Government, IP Australia Re. Application No. 2005252469.
International Preliminary Report on Patentability Dated Dec. 1, 2011 From the International Bureau of WIPO Re. Application No. PCT/IL2008/000489.
International Preliminary Report on Patentability Dated Dec. 2, 2010 From the International Bureau of WIPO Re. Application No. PCT/IL2009/000508.
International Preliminary Report on Patentability Dated Mar. 3, 2011 From the International Bureau of WIPO Re.: Application No. PCT/IB2009/053633.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Jan. 14, 2010 From the International Bureau of WIPO Re.: Application No. PCT/IL2008/000489.
International Preliminary Report on Patentability Dated Sep. 15, 2011 From the International Bureau of WIPO Re. Application No. PCT/IB2010/050871.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 2, 2010 From the International Searching Authority Re. Application No. PCT/IB09/53633.
International Search Report and the Written Opinion Dated Dec. 6, 2011 From the International Searching Authority Re. Application No. PCT/IB2011/051843.
International Search Report and the Written Opinion Dated Sep. 7, 2010 From the International Searching Authority Re. Application No. PCT/IB10/50871.
International Search Report and the Written Opinion Dated Feb. 17, 2010 From the International Searching Authority Re.: Application No. PCT/IL09/00508.
International Search Report and the Written Opinion Dated Aug. 22. 2011 From the International Searching Authority Re: Application No. PCT/IB2010/56023.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report and the Written Opinion Dated Oct. 31, 2011 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated May 8, 2012 From the International Searching Authority Re. Application No. PCT/IB11/53697.

(56) References Cited

OTHER PUBLICATIONS

Invitation to Pay Additional Fees Dated Sep. 8, 2006 From the International Searching Authority Re.: Application No. PCT/IL05/00627.
Invitation to Pay Additional Fees Dated Jun. 9, 2011 From the International Searching Authority Re. Application No. PCT/IB10/56023.
Invitation to Pay Additional Fees Dated Aug. 18, 2011 From the International Searching Authority Re.: Application No. PCT/IL08/00489.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Notice of Allowance Dated Dec. 5, 2011 From the US Patent and Trademark Office Re. U.S. Appl. No. 12/448,359.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.: U.S. Appl. No. 11/990,386.
Notice of Grant Dated Jan. 14, 2011 From the Instituto Mexican de la Propriedad Industrial Re. Application No. MX/a/2008/005280.
Office Action Dated Jan. 2, 2012 From the Israel Patent Office Re. Application No. 206118 and Its Translation Into English.
Office Action Dated Feb. 3, 2011 From the Israel Patent Office Re.: Application No. 172135 and Its Translation Into English.
Office Action Dated Aug. 4, 2010 From the Israel Patent Office Re.: Application No. 172135 and Its Translation Into English.
Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and Its Translation Into English.
Office Action Dated May 13, 2010 From the Israel Patent Office Re. Application No. 180022 and Its Translation Into English. Examiner.
Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jun. 19, 2011 From the Israel Patent Office Re. Application No. 199391 and Its Translation Into English.
Office Action Dated Jun. 20, 2011 From the Israel Patent Office Re. Application No. 190918 and Its Translation Into English.
Office Action Dated Jan. 22, 2010 From the State Intellectual Property Office of the People's Republic of China Re.: Application No. 200580027481.4 and Its Translation Into English.
Office Action Dated Sep. 22, 2011 From the Israeli Patent Office Re. Application No. 201242 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jul. 8, 2011 From the US Patent and Trademark Office Re. U.S. Appl. No. 12/083,978.
Official Action Dated Jun. 8, 2010 From the US Patent and Trademark Office Re.: U.S. Appl. No. 11/629,411.
Official Action Dated Apr. 10, 2012 From the US Patent and Trademark Office Re. U.S. Appl. No. 12/669,975.
Official Action Dated May 10, 2011 From the US Patent and Trademark Office Re. U.S. Appl. No. 12/457,199.
Official Action Dated Jun. 13, 2012 From the US Patent and Trademark Office Re. U.S. Appl. No. 12/594,853.
Official Action Dated May 14, 2012 From the US Patent and Trademark Office Re. U.S. Appl. No. 12/457,199.
Official Action Dated Feb. 15, 2011 From the US Patent and Trademark Office Re. U.S. Appl. No. 12/448,359.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Jun. 19, 2012 From the US Patent and Trademark Office Re. U.S. Appl. No. 13/450,547.
Official Action Dated Sep. 19, 2011 From the US Patent and Trademark Office Re. U.S. Appl. No. 12/810,855.
Official Action Dated Dec. 21, 2011 From the US Patent and Trademark Office Re. U.S. Appl. No. 12/810,855.
Official Action Dated Aug. 22, 2011 From the US Patent and Trademark Office Re. U.S. Appl. No. 12/457,199.
Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re.: U.S. Appl. No. 11/284,236.
Official Action Dated Apr. 29, 2011 From the US Patent and Trademark Office Re. U.S. Appl. No. 12/448,359.
Partial European Search Report Dated Jul. 12, 2011 From the European Patent Office Re. Application No. 10194223.3.
Partial European Search Report Dated Apr. 19, 2010 From the European Patent Office Re.: Application No. 09163033.5.
Requisition by the Examiner Dated Feb. 2, 2012 From the Canadian Intellectual Property Office Re. Application No. 2,570,195.
Requisition by the Examiner Dated Jun. 15, 2011 From the Canadian Intellectual Property Office Re. Application No. 2,526,440.
Response Dated Jun. 2, 2011 to Office Action of Feb. 3, 2011 From the Israel Patent Office Re.: Application No. 172135.
Response Dated Jul. 3, 2011 to Examination Report of Apr. 19, 2011 From the Instituto Mexican de la Propriedad Industrial Re. Application No. MX/a/2008/002262 and Its Summary Into English.
Response Dated Oct. 3, 2011 to Examiner's Report of Jun. 24, 2011 From the Australian Government, IP Australia Re. Application No. 2006281018.
Response Dated Jan. 4, 2010 to Official Action of Sep. 2, 2009 From the US Patent and Trademark Office Re.: U.S. Appl. No. 11/629,411.
Response Dated Oct. 4, 2011 to Official Action of Jul. 8, 2011 From the US Patent and Trademark Office Re. U.S. Appl. No. 12/083,978.
Response Dated Dec. 5, 2010 to Office Action of Aug. 4, 2010 From the Israel Patent Office Re.: Application No. 172135.
Response Dated Jul. 6, 2011 to Examiner's Report of Dec. 20, 2010 From the Australian Government, Ip Australia Re. Application No. 2005234725.
Response Dated Jun. 6, 2011 to Official Action of May 10, 2011 From the US Patent and Trademark Office Re. U.S. Appl. No. 12/457,199.
Response Dated Jan. 7, 2010 to Communication Pursuant to Article 94(3) EPC of Sep. 9, 2009 From the European Patent Office Re.: Application No. 04734072.4.
Response Dated Mar. 8, 2011 to Examiner's Report of Jan. 13, 2011 From the Australian Government, IP Australia Re.: Application No. 2005252469.
Response Dated Feb. 9, 2011 to Communication Pursuant to Article 94(3) EPC of Nov. 19, 2010 From the European Patent Office Re.: Application No. 06809784.9.
Response Dated Jun. 9, 2011 to Examiner's Report of Dec. 20, 2011 From the Australian Government, IP Australia Re. Application No. 2005234725.
Response Dated Mar. 9, 2011 to Office Action of Nov. 11, 2010 From the Israel Patent Office Re. Application No. 206118.

(56) References Cited

OTHER PUBLICATIONS

Response Dated Jan. 10, 2012 to European Search Report and the European Search Opinion of Jun. 14, 2011 From the European Patent Office Re. Application No. 11154193.4.
Response Dated Aug. 11, 2011 to Examination Report of Aug. 1, 2011 From the Government of India, Patent Office Re.: Application No. 158/CHENP/2007.
Response Dated Dec. 12, 2010 to Examiner's Report of Dec. 17, 2009 From the Australian Government, IP Australia Re.: Application No. 2005252469.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Dec. 14, 2010 to Examination Report of Sep. 22, 2010 From the Instituto Mexicano de la Propriedad Industrial Re. Application No. MX/a/2008/005280.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Response Dated Oct. 14, 2010 to Office Action of Jun. 17, 2010 From the Israel Patent Office Re. Application No. 190918.
Response Dated Sep. 14, 2010 to Official Action of Aug. 18, 2010 From the US Patent and Trademark Office Re. U.S. Appl. No. 12/083,978.
Response Dated Dec. 15, 2011 to Examiner's Report of Aug. 1, 2011 From the Australian Government, IP Australia Re. Application No. 2005234725.
Response Dated Jun. 15, 2011 to Examiner's Report of Mar. 31, 2011 From the Australian Government, IP Australia Re.: Application No. 2005252469.
Response Dated Jun. 17, 2011 to Examiner's Report of Mar. 31, 2011 From the Australian Government, IP Australia Re.: Application No. 2005252469.
Response Dated May 17, 2010 to Office Action of Jan. 22, 2010 From the State Intellectual Property Office of the People's Republic of China Re.: Application No. 200580027481.4.
Response Dated Oct. 17, 2011 to Requisition by the Examiner of Jun. 15, 2011 From the Canadian Intellectual Property Office Re. Application No. 2,526,440.
Response Dated Oct. 18, 2011 to Official Action of Sep. 19, 2011 From the US Patent and Trademark Office Re. U.S. Appl. No. 12/810,855.
Response Dated Dec. 191, 2011 to Examiner's Report of Oct. 19, 2011 From the Australian Government, IP Australia Re. Application No. 2006281018.
Response Dated Jan. 19, 2011 to Supplementary European Search Report and the European Search Opinion of Jul. 1, 2010 From the European Patent Office Re. Application No. 07849616.3.
Response Dated Oct. 19, 2011 to Official Action of Apr. 29, 2011 From the US Patent and Trademark Office Re. U.S. Appl. No. 12/448,359.
Response Dated Jul. 20, 2011 to Examination Report of May 25, 2011 From the Government of India, Patent Office Re.: Application No. 158/CHENP/2007.
Response Dated Apr. 21, 2011 to Communication Pursuant to Article 94(3) EPC of Nov. 8, 2010 From the European Patent Office Re.: Application No. 04734072.4.
Response Dated Sep. 21, 2010 to Notice of Allowance of Apr. 16, 2010 From the US Patent and Trademark Office Re.: U.S. Appl. No. 11/629,411.
Response Dated Dec. 22, 2011 to Official Action of Aug. 22, 2011 From the US Patent and Trademark Office Re. U.S. Appl. No. 12/457,199.

Response Dated Feb. 22, 2010 to Official Action of Oct. 22, 2009 From the US Patent and Trademark Office Re.: U.S. Appl. No. 11/990,386.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Mar. 23, 2011 to Official Action of Nov. 23, 2010 From the US Patent and Trademark Office Re. U.S. Appl. No. 12/083,978.
Response Dated Feb. 24, 2011 to Communciation Pursuant to Rules 70(2) and 70a(2) EPC of Aug. 30, 2010 From the European Patent Office Re. Application No. 08738191.9.
Response Dated Mar. 24, 2011 to Examination Report of Nov. 3, 2010 From the Government of India, Patent Office Re.: Application No. 158/CHENP/2007.
Response Dated Oct. 24, 2010 to Office Action of Sep. 2, 2010 From the Rospatent, Federal State Institution, Federal Institute for Industrial Property of the Federal Service for Intellectual Property, Patents and Trademarks of the Russian Federation Re. Application No. 2008120395.
Response Dated Jul. 25, 2011 to Examiner's Report of Jul. 21, 2011 From the Australian Government, IP Australia Re. Application No. 2005234725.
Response Dated Sep. 25, 2011 to Examiner's Report of Jun. 30, 2011 From the Australian Government, IP Australia Re. Application No. 2006307457.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Jun. 29, 2010 to Examination Report of Feb. 17, 2010 From the Instituto Mexicano de la Propriedad Industrial Re. Application No. PA/a/2005/012565.
Response Dated Jun. 29, 2011 to Communication Pursuant to Article 94(3) EPC of Mar. 8, 2011 From the European Patent Office Re.: Application No. 06809784.9.
Response Dated May 31, 2010 to Office Action of Jan. 31, 2010 From the Israel Patent Office Re.: Application No. 172135.
Response Dated Oct. 31, 2011 to Notification of the First Office Action of Jun. 30, 2011 From the State Intellectual Property Office of the People's Republic of China Re. Application No. 200680047610.0.
Restriction Official Action Dated Feb. 1, 2012 From the US Patent and Trademark Office Re. U.S. Appl. No. 12/669,975.
Restriction Official Action Dated Apr. 11, 2012 From the US Patent and Trademark Office Re. U.S. Appl. No. 12/834,106.
Restriction Official Action Dated Feb. 13, 2012 From the US Patent and Trademark Office Re. U.S. Appl. No. 12/594,853.
Summary of Office Action Dated Sep. 2, 2010 From the Rospatent, Federal State Institution, Federal Institute for Industrial Property of the Federal Service for intellectual Property, Patents and Trademarks of the Russian Federation Re. Application No. 2008120395.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated Jan. 2, 2012 From the European Patent Office Re. Application No. 09807983.3.
Supplementary European Search Report and the European Search Opinion Dated May 6, 2011 From the European Patent Office Re. Application No. 09750276.9.
Supplementary European Search Report and the European Search Opinion Dated Aug. 11, 2010 From the European Patent Office Re. Application No. 08738191.9.

(56) References Cited

OTHER PUBLICATIONS

Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of Decision of Rejection Dated Dec. 9, 2011 From the State Intellectual Property Office of the People's Republic of China Re.: Application No. 200580027481.4.
Translation of Notice of Payment of the Restoration Fee for Unity of Invention Dated Mar. 20, 2009 From the State Intellectual Property Office of the People's Republic of China Re.: Application No. 200580027481.4.
Translation of Notification of the Office Action Dated Dec. 1, 2011 From the State Intellectual Property Office of the People's Republic of China Re. Application No. 200680047610.0.
Translation of Notification of the Office Action Dated Jun. 30, 2011 From the State Intellectual Property Office of the People's Republic of China Re. Application No. 200680047610.0.
Translation of Office Action Dated Jul. 1, 2011 From the State Intellectual Property Office of the People's Republic of China Re. Application No. 200880017707.6.
Translation of Office Action Dated Jan. 4, 2012 From the State Intellectual Property Office of the People's Republic of China Re. Application No. 200880109464.9.
Translation of Office Action Dated Apr. 9, 2012 From the State Intellectual Property Office of the People's Republic of China Re. Application No. 200880017707.6.
Translation of Office Action Dated Jan. 17, 2012 From the State Intellectual Property Office of the People's Republic of China Re. Application No. 201110104274.1.
Translation of Office Action Dated Oct. 19, 2010 From the State Intellectual Property Office of the People's Republic of China Re. Application No. 200680038391.X.
Translation of Office Action Dated Jun. 22, 2011 From the State Intellectual Property Office of the People's Republic of China Re. Application No. 200880127685.9.
Translation of Office Action Dated Dec. 31, 2011 From the State Intellectual Property Office of the People's Republic of China Re. Application No. 200910217137.1.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/IL04/00431.
Written Opinion Dated Aug. 27, 2008 From the International Searching Authority Re.: Application No. PCT/IL06/00947.
Adachi et al. "Oryza Sativa Japonica Group cDNA Clone:J023021L06, Full Insert Sequence", Database EMBASE [Online], XP002665608, Retrieved From EBI, Database Accession No. AK099270, Jul. 19, 2003.
Aharon et al. "Overexpression of A Plasma Membrane Aquaporin in Transgenic Tobacco Improves Plant Vigor Under Favorable Growth Conditions But Not Under Drought or Salt Stress", The Plant Cell, 15: 439-447, Feb. 2003.

Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, XP003018468, 13(2): 146-150, Apr. 1, 2002.
Blewitt et al. "BNLGHi10083 Six-Day Cotton Fiber Gossypium Hirsutum cDNA 5' Similar to (AC004521) Unknown Protein [Arabidopsis Thaliana], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber Gossypium Hirsutum cDNA 5' Similar to (AC004521) Unknown Protein [Arabidopsis Thaliana], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber Gossypium Hirsutum cDNA 5' Similar to (AC004521) Unknown Protein [Arabidopsis Thaliana], mRNA Sequence", XP002576190, Retrieved From EBI Accession no. EMBL:AI27553, Database Accession No. AI27553, Jun. 12, 1999. Sequence.
Blewitt et al. "Gossypium Hirsutum Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Cheuk et al. "Arabidopsis Thaliana At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Davletova et al. "The Zinc-Finger Protein Zat12 Plays a Central Role in Reactive Oxygen and Abiotic Stress Signaling in Arabidopsis", Plant Physiology, 139: 847-856, Oct. 2005.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Friedberg "Automated Protein Function Prediction—The Genomic Challenge", Briefings in Bioinformatics, 7(3): 225-242, 2006.
Gardiner et al. "Zea mays PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result. From Overexpression of the AVP1 H+-Pump", Proc. Natl. Acad. Sci. USA, PNAS, 98(20): 11444-11449, Sep. 25, 2001.
Good et al. "Can Less Yield More? Is Reducing Nutrient Input Into the Environment Compatible With Maintaining Crop Production?", Trends in Plant Science, 9(12): 597-605, Dec. 2004.
Grover et al. "Understanding Molecular Alphabets of the Plant. Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2—p. 1153, col. 1, § 1, Table 1.

(56) References Cited

OTHER PUBLICATIONS

Hill et al. "Functional Analysis of Conserved Histidines in ADP-Glucose Pyrophosphorylase From *Escherichia coli*", Biochemical and Biophysical Research Communications, 244(2): 573-577, 1998.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ji et al. "Gossypium Hirsutum Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Johansson et al. "The Role of Aquaporins in Cellular and Whole Plant Water Balance," Biochimica et Biophysica Acta 1465: 324-342, 2000.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Katavic et al. "Utility of the Arabidopsis FAE1 and Yeast SLC1-1 Genes for Improvement in Erucic Acid and Oil Content in Rapeseed", Biochemical Society Transactions, 28(6): 935-937, Dec. 2000.
Keskin et al. "A New, Structurally Nonredundant, Diverse Data Set of Protein-Protein Interfaces and Its Implications", Protein Science, 13: 1043-1055, 2004.
Kim et al. "Arabidopsis Thaliana At2g46960/F14M4.21 mRNA, Complete CDS", Database EMBL [Online], XP002593 834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculenium Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
Li et al. "Gossypium Hirsutum Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "Arabidopsis Thaliana Chromosome F7O18 Genomic Sequence, Complete Sequence", GenBank Accession No. AC011437, Oct. 30, 2002.
Liu et al. "Root-Specific Expression of a Western White Pine PR10 Gene Is Mediated by Different. Promoter Regions in Transgenic Tobacco", Plant. Molecular Biology, 52: 103-120, 2003.
Maurel "Plant Aquaporins: Novel Functions and Regulation Properties", FEBS Letters, XP022078418, 581(12): 2227-2236, May 25, 2007. p. 2230, col. 2, Last § -p. 2231, col. 1, § 2, Fig.1.
McConnell et al. "Role of Phabulosa and Phavoluta in Determining Radial Patterning in Shoots", Nature, 411(6338): 709-713, Jun. 7, 2001.
Merriam-Webster "Exogenous Definition", Merrian-Webster On-Line Dictionary, 2010.

NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Rctreicved From EBI Accession No. EMBL, Database Accession No. AY453393, 2004.
Payne et al. "Heterologous MYB Genes Distinct From GL1 Enhance Trichome Production When Overexpressed in Nicotiana Tabacum", Development, 126: 671-682, 1999.
Purnelle et al. "Arabidopsis Thaliana DNA Chromosome 3, BAC Clone F3C22", Database EMBL [Online], XP002640829, Retrieved From EBI Accession No. EMBL:AL353912, Database Accession No. AL353912, Apr. 17, 2000. Compound.
Saez-Vasquez et al. "Accumulation and Nuclear Targeting of BnC24, A Brassica Napus Ribosomal Protein Corresponding to a mRNA Accumulating in Response to Cold Treatment", Plant Science, 156(1): 35-46, 2000.
Smart et al. "MIP Genes Are Down-Regulated Under Drought. Stress in Nicotiana Glauca", Plant and Cell Physiology, XP002455682, 42(7): 686-693, 2001. p. 686, Reference to Database Entry AF290618, p. 692, 1-h col., § 2.
Smart et al. "Nicotiana Glauca Putative Delta Tip (MIP2) mRNA, Complete Cds", Database EMBL [Online], Retrieved From EBI Accession No. EMBL: AF290618, XP002455682, Database Accession No. AF290618, Jan. 2, 2001.
Sunkar et al. "Small RNAs as Big Players in Plant Abiotic Stress Responses and Nutrient Deprivation", Trends in Plant Science, XP022148764, 12(7): 301-309, Jul. 1, 2007.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root. During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218814, XP002455680, Database Accession No. AW218814, Dec. 14, 1999. Abstract.
Van der Hoeven et al. "EST301295 Tomato Root During/After Fruit Set, Cornell University Lycopersicon Esculentum cDNA Clone cLEXIK11 Similar to Vernicia Fordii Aquaporin, mRNA Sequence", Database EMBL [Online], Retrieved From EBI Accession No. EMBL: AW218815, XP002455681, Database Accession No. AW218815, Dec. 14, 1999. Abstract.
Van der Hoeven et al. "EST428934 Tomato Nutrient Deficient Roots Lycopersicon Esculent un cDNA Clone cLEW26B2 5' Sequence, mRNA Sequence", Database EMBL, Retrieved From EBI Accession No. EMBL, Database Accession No. BF098413, 2000.
Vigeolas et al. "Increasing Seed Oil Content in Oil-Seed Rape (*Brassica napus* L.) by Over-Expression of a Yeast Glyecrol-3-

(56) References Cited

OTHER PUBLICATIONS

Phosphate Dehydrogenase Under the Control of a Seed-Specific Promoter", Plant Biotechnology Journal, 5 Issue: 431-441, 2007. Abstract.
Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004.
Wang et al. "Control of Plant Trichome Development by A Cotton Fiber MYB Gene", The Plant Cell, 16: 2323-2334, Sep. 2004. GenEmbl Database, Accession No. AY641990.
Wells "Additivity of Mutational Effects in Proteins", Biochemistry, 29 (37): 85098517, 1990.
Whisstock et al. "Prediction of Protein Function from Protein Sequence and Structure," Quarterly Reviews of Biophysics 36 (3): 307-340, Aug. 2003.
Wing et al. "An Integrated Analysis of the Genetics, Devlopment, and Evolution of Cotton Fiber", NBCI GenBank Accession no. BE052336, 2000.
Wing et al. "GA_Eb0023F09f Gossypium Arboreum 7-10 DPA Fiber Library Gossypium Arboreum cDNA Clone GA_Eb0023F09f, mRNA Sequence", XP002576191, Retrieved From EBI Accession No. EMBL:BF275177, Database Accession No. BF275177, Nov. 20, 2000. Sequence.
Wing et al. "GA_Eb0026P18f Gossypium Arboreum 7-10 DPA Fiber Library Gossypium Arboreum cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Wu et al. "SubName: Full=Major Intrinsic Protein", Database UniProt [Online], P002529191, Retrieved From EBI Accession No. UNIPROT:AOFI89, Database Accession No. AOFI89, Nov. 28, 2006.
Yamada et al. "Arabidopsis Thaliana Clone RAFL14-87-A16 (R20399) Unknown Protein (At1g60770) mRNA, Complete Cds", GenBank Accession No. BT002876, Retrieved From the Internet, Jan. 21, 2010.
Yamada et al. "Arabidopsis Thaliana Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Communication Pursuant to Article 94(3) EPC Dated Jul. 4, 2012 From the European Patent Office Re. Application No. 10194223.3.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:IIV067703, Database Accession No. IIV067703, Jul. 15, 2011. Sequence.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No:246 (Protein) and Corresponding Polynucleotide Shows 100 % Identity to SEQ ID No:7 Over 458 Nucleotides. Abstract.
La Rosa et al. "Oryza Sativa Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No:246, Corresponding Polynucleotide Has 99,6% Identity to Present SEQ ID No:7 Over 488 Nucleotides. Abstract, Sequence.
La Rosa et al. "Oryza Sativa Nucleotide Sequence seq id no. 31205", Database Geneseq [Online], X0002678024, Retrieved From EBI Accession No. GSN:ANL17203, Database Accession No. ANL17203, Dec. 28, 2007. Sequence.
Communication Pursuant to Article 94(3) EPC DAted Jul. 13, 2012 From the European Patent Office Re. Application No. 11172514.9.
Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
Applicant-Initiated Interview Summary Dated Aug. 6, 2012 From the US Patent and Trademark Office Re. U.S. Appl. No. 12/669,975.
Communication Pursuant to Rules 70(2) and 70a(2) EPC Dated Jul. 24, 2012 From the European Patent Office Re. Application No. 10748403.2.
Office Action Dated Jun. 25, 2012 From the State Intellectual Property Office of the People's Republic of China Re.: Application No. 200880109464.9 and Its Translation Into English.
International Search Report and the Written Opinion Dated Aug. 6, 2012 From the International Searching Authority Re. Application No. PCT/IB11/53697.
Daniell et al. "Solanum Bulbocastanum Chloroplast, Complete Genome", GenBank NCBI, Accession No. NC 007943, Mar. 26, 2010. p. 1, Source, p. 10-11, Nucleotides 46590-47195, Gene 'RPS4'.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Payne et al. "GL3 Encodes a bHLH Protein That Regulates Trichome Development in Arabidopsis Through Interaction With GL1 and TTG1", Genetics, 156: 1349-1362, Nov. 2000.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.
International Preliminary Report on Patentability Dated Feb. 21, 2013 From the International Bureau of WIPO Re. Application No. PCT/IB2011/051843.
Official Action Dated Feb. 8, 2013 From the US Patent and Trademark Office Re. U.S. Appl. No. 12/594,853.
Supplementary European Search Report and the European Search Opinion Dated Feb. 14, 2013 From the European Patent Office Re. Application No. 10785834.2.
Communication Pursuant to Article 94(3) EPC Dated Aug. 20, 2013 From the European Patent Office Re. Application No. 11172514.9.
Requisition by the Examiner Dated Aug. 27, 2013 From the Canadian Intellectual Property Office Re. Application No. 2,526,440.
Applicant-Initiated Interview Summary Dated Nov. 20, 2013 From the US Patent and Trademark Office Re. U.S. Appl. No. 13/125,047.
Requisition by the Examiner Dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Examination Report Dated Oct. 1, 2013 From the Instituto Mexicano de la Propiedad Industrial Re. Application No. MX/a/2010/000975 and Its Translation Into English.
International Preliminary Report on Patentability Dated Nov. 14, 2013 From the International Bureau of WIPO Re. Application No. PCT/IL2012/050154.
Communication Pursuant to Rule 58 EPC or Rule 159 EPC, Invitation to Remedy Deficiencies in the Application Documents Dated Dec. 6, 2013 From the European Patent Office Re. Application No. 11190921.4.
Patent Examination Report Dated Jan. 3, 2014 From the Australian Government, IP Australia Re. Application No. 2008278654.

(56) References Cited

OTHER PUBLICATIONS

Official Action Dated Jan. 9, 2014 From the US Patent and Trademark Office Re. U.S. Appl. No. 12/992,902.
Bork et al. "Go Hunting in Sequence Databases But Watch Out for the Traps", Trends in Genetics, TIG, 12(10): 425-427, Oct. 1996.
Doerks et al. "Protein Annotation: Detective Work for Function Prediction", Trends in Genetics, TTG, 14(6): 248-250, Jun. 1998.
Smith et al. "The Challenges of Genome Sequence Annotation or the Devil Is in the Details'", Nature Biotechnology, 15: 1222-1223, Nov. 1997.
Applicant-Initiated Interview Summary Dated Dec. 20, 2013 From the US Patent and Trademark Office Re. U.S. Appl. No. 13/125,047.
Office Action Dated Apr. 1, 2013 From the State Intellectual Property Office of the People's Republic of China Re. Application No. 200880127757.X and Its Translation Into English.
International Search Report and the Written Opinion Dated May 12, 2013 From the International Searching Authority Re. Application No. PCTIL2013/050172.
Official Action Dated May 8, 2013 From the US Patent and Trademark Office Re. U.S. Appl. No. 13/125,047.
Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [Medicago Truncatula]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in Arabidopsis", The Plant Cell, 24: 4555-4576, Nov. 2012.
Official Action Dated May 20, 2013 From the US Patent and Trademark Office Re. U.S. Appl. No. 13/059,231.
Patent Examination Report Dated May 31, 2013 From the Australian Government, IP Australia Re. Application No. 2008278654.
Hirner et al. "Arabidopsis LHT1 Is a High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of *Vica narbonensis* and Pea Increases Storage Proteins", Plant Physiology, 137: 1236-1249, Apr. 2005.
Su et al. "Molecular and Functional Characterization of a Family of Amino Acid Transporter From Arabidopsis", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Examination Report Dated Mar. 13, 2013 From the Instituto Mexican de la Propiedad Industrial Re. Application No. PA/a/2005/009380 and Its Summary in English.
Communication Pursuant to Article 94(3) EPC Dated May 29, 2013 From the European Patent Office Re. Application No. 09823171.5.
Official Action Dated Jun. 24, 2013 From the US Patent and Trademark Office Re. U.S. Appl. No. 12/992,902.
Patent Examination Report Dated Jun. 21, 2013 From the Australian Government, IP Australia Re. Application No. 2012241091.
Arabidopsis Genome Initiative "Analysis of the Genome Sequence of the Flowering Plant *Arabicopsis thaliana*" Nature, 408: 796-815, Dec. 14, 2000.
Ciddi et al. "Elicitation of *Taxus* Sp. Cell Cultures for Production of Taxol", Biotechnology Letters, 17(12): 1343-1346, Dec. 1995.
Kikuchi et al. "Olyza Safi-km Japonica Group cDNA Clone:J023131O04, Full Insert Sequence", GenRank Database Accession No. AK072531, Jul. 2, 2013.
Lunn et al. "Genome-Wide Analysis of Arabidopsis Pentatricopeptide Repeat Proteins Reveals Their Essential Role in Organelle Biogenesis", The plant Cell, 16: 2089-2103, Aug. 2004.
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
Patent Examination Report Dated Jun. 27, 2013 From the Australian Government, IP Australia Re. Application No. 2012216482.
Matz et al. "Gossypium Hirsutum GHDEL65 (ghde165) mRNA, Complete CDS", GenBank Nucleotide, GenBank Accession No. AF336280, Mar. 15, 2001.
Advisory Action Before the Filing of an Appeal Brief Dated Nov. 19, 2013 From the US Patent and Trademark Office Re. U.S. Appl. No. 12/834,106.
International Search Report and the Written Opinion Dated Nov. 19, 2013 From the International Searching Authority Re. Application No. PCT/IL2013/050725.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Examination Report Dated Dec. 16, 2013 From the Government of India, Patent Office, Intellectual Property Building Re. Application No. 2570/CBENP/2008.
Li et al. "Dehydration-Induced Protein RD22-Like Protein [Gossypium Hirsutum]", NCBI Database [Online], GenBank: AAL67991.1, GenBank Accession No. AAL67991, Dec. 4, 2002.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Examination Report Dated Jun. 11, 2012 From the Instituto Mexicano de la Propiedad Industrial Re. Application No. MX/a/2011/007294 and Summary in English.
International Preliminary Report on Patentability Dated Mar. 14, 2013 From the International Bureau of WIPO Re. Application No. PCT/IB2011/053697.
International Preliminary Report on Patentability Dated Jul. 4, 2013 From the International Bureau of WIPO Re. Application No. PCT/IB2011/055854.
Examination Report Dated May 23, 2013 From the Instituto Mexican de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
Official Action Dated Jul. 26, 2013 From the US Patent and Trademark Office Re. U.S. Appl. No. 13/254,183.
Matsumoto et al. "Os11gO162200 [Oryza Sativa Japonica Group]", Direct GenBank Sequence Submission, GenBank: BAF27672.1, GenBank Accession No. BAF27672, Aug. 11, 2012.
Communication Pursuant to Article 94(3) EPC Dated Aug. 2, 2013 From the European Patent Office Re. Application No. 10194223.3.
Examination Report Dated Jul. 9, 2013 From the Instituto Mexicano de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
Examination Report Dated Jun. 7, 2013 From the Instituto Mexicano de la Propiedad Industrial Re. Application No. MX/a/2011/003575 and Its Translation Into English.

(56) References Cited

OTHER PUBLICATIONS

Examination Report Dated Jun. 20, 2013 From the Instituto Mexicano de la Propiedad Industrial Re. Application No. MX/a/2011/007294 and Its Translation Into English.
International Search Report and the Written Opinion Dated Sep. 1, 2013 From the International Searching Authority Re. Application No. PCT/IB2013/054374.
Bennetzen et al. "Setaria Italica Strain Yugu1 SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
NCBI "Predicted: Nudix Hydrolase 16, Mitochondrial-Like [Setaria Italica]", Database NCBI [Online], NCBI Reference Sequence: XP_004955808, Jun. 26, 2013.
Official Action Dated Sep. 16, 2013 From the US Patent and Trademark Office Re. U.S. Appl. No. 13/125,047.
Translation of Office Action Dated Aug. 28, 2013 From the State Intellectual Property Office of the People's Republic of China Re. Application No. 200880109464.9.
Clontech "Genome Walker™ Universal Kit User Manual", Clontech Laboratories Inc., Cat. No. 638904, PT3042-1 (PR742239), p. 1-30, Apr. 25, 2007.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Examination Report Dated Jul. 29, 2013 From the Instituto Mexican de la Propiedad Industrial Re. Application No. MX/a/2010/012697 and Its Translation Into English.
Official Action Dated Sep. 20, 2013 From the US Patent and Trademark Office Re. U.S. Appl. No. 12/669,975.
Communication Pursuant to Article 94(3) EPC Dated Oct. 9, 2013 From the European Patent Office Re. Application No. 08869158.9.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No:653 and Is Used for the Same Purpose, Abstract, Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No:166, 653, Abstract, Sequence.
Office Action Dated Oct. 28, 2013 From the State Intellectual Property Office of the People's Republic of China Re. Application No. 201110104274.1 and Its Translation Into English.
Communication Pursuant to Article 94(3) EPC Dated Nov. 7, 2013 From the European Patent Office Re. Application No. 10748403.2.
Examination Report Dated Aug. 22, 2013 From the Instituto Mexicano de la Propiedad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 Arabidopsis Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
Communication Pursuant to Article 94(3) EPC Dated Jun. 6, 2014 From the European Patent Office Re. Application No. 10840687.7.
Communication Pursuant to Article 94(3) EPC Dated Oct. 20, 2014 From the European Patent Office Re. Application No. 10840687.7.
Communication Pursuant to Rules 70(2) and 70a(2) EPC Dated Nov. 4, 2013 From the European Patent Office Re. Application No. 10840687.7.
International Preliminary Report on Patentability Dated Jul. 12, 2012 From the International Bureau of WIPO Re. Application No. PCT/IB2010/056023.
International Search Report and the Written Opinion Dated Aug. 22, 2011 From the International Searching Authority Re. Application No. PCT/IB2010/056023.
Invitation to Pay Additional Fees Dated Jun. 9, 2011 From the International Searching Authority Re. Application No. PCT/IB2010/056023.
Supplementary European Search Report and the European Search Opinion Dated Oct. 15, 2013 From the European Patent Office Re. Application No. 10840687.7.
Apse et al. "Engineering Salt Tolerance in Plants", Current Opinion in Biotechnology, 13: 146-150, 2002.
Gaxiola et al. "Drought- and Salt-Tolerant Plants Result From Overexpression of the AVP1 H+ -Pump", Proc. Natl. Acad. Sci. USA, PNAS, 98(20): 11444-11449, Sep. 25, 2001.
Gowik et al. "Cis-Regulatory Elements for Mesophyll-Specific Gene Expression in the C4 Plant Flaveria trinervia, the Promoter of the C4 Phosphoenolpyruvate Carboxylase Gene", The Plant Cell, 16: 1077-1090, 2004.
Hattori et al. "An Acetohydroxy Acid Synthase Mutant Reveals a Single Site Involved in Multiple Herbicide Resistance", Molecular and General Genetics, 246: 419-425, 1995. Abstract.
Holmstroem et al. "Drought Tolerance in Tobacco", Nature, 379: 683-684, 1996. Abstract.
Katavic et al. "Utility of the Arabidopsis FAE1 and Yeast SLC1-1 Genes for Improvements in Erucic Acid and Oil Content in Rapeseed", Biochemical Society Transactions, 28: 935-7, 2000. Abstract.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and Is Used for the Same Purpose, Abstract, Sequence.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.
Pilon-Smits et al. "Improved Performance of Transgenic Fructan-Accumulating Tobacco under Drought Stress", Plant Physiology, 107: 125-130, 1995.
Quesada et al. "Genetic Architecture of NaC1 Tolerance in Arabidopsis", Plant Physiology, 130: 951-963, 2002. Abstract.
Saijo et al. "Over-Expression of a Single Ca 2+ -Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Tarczynski et al. "Stress Protection of Transgenic Tobacco by Production of the Osmolyte Mannitol", Science, 259: 508-510, 1993. Abstract.
Van Haaren et al. "A Functional Map of the Fruit-Specific Promoter of the Tomato 2A11 Gene", Plant Molecular Biology, 21: 625-640, 1993. Abstract.
Vigeolas et al. "Increasing Seed Oil Content in Oil-Seed Rape (Brassica napus L.) by Over-Expression of a Yeast Glycerol-3-Phosphate Dehydrogenase Under the Control of a Seed-Specific Promoter", Plant Biotechnology Journal, 5 Issue: 431-441, 2007. Abstract.

(56) References Cited

OTHER PUBLICATIONS

Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract.
Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.
Yanagisawa et al. "Diversity and Similarity Among Recognition Sequences of Dof Transcription Factors", The Plant Journal, 17(2): 209-214, 1999.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Zabrouskov et al. "Oxidative Metabolism and the Physiological Age of Seed Potatoes Are Affected by Increased Alpha-Linolenate Content", Physiologia Plantarum, 116: 172-185, 2002.
Communication under Rule 71(3) EPC Dated Jul. 30, 2015 From the European Patent Office Re. Application No. 10840687.7.
Patent Examination Report Dated Jun. 11, 2015 From the Australian Government, IP Australia Re. Application No. 2010337936.
Patent Examination Report Dated Apr. 18, 2016 From the Australian Government, IP Australia Re. Application No. 2010337936.
Patent Examination Report Dated Dec. 18, 2015 From the Australian Government, IP Australia Re. Application No. 2010337936.
Examination Report Dated Apr. 25, 2016 From the Instituto Mexicano de la Propiedad Industrial, IMPI Re. Application No. MX/a/2012/007675 and Its Translation Into English.

\* cited by examiner

Normal conditions

Osmotic stress (15 % PEG)

Nitrogen limiting conditions

FIGs. 11A-C 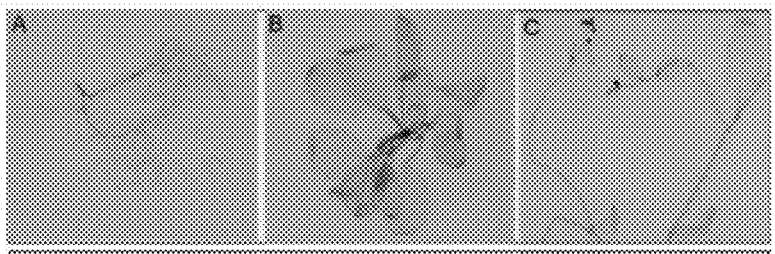
FIGs. 11D-F 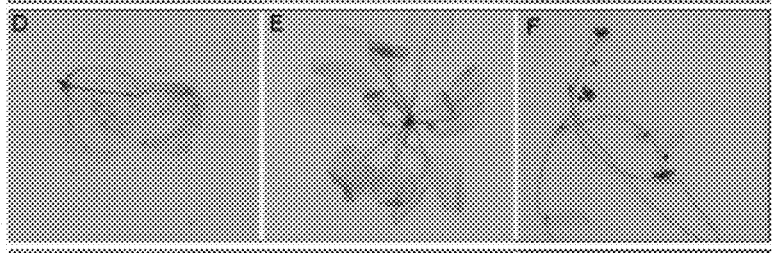
FIGs. 11G-I 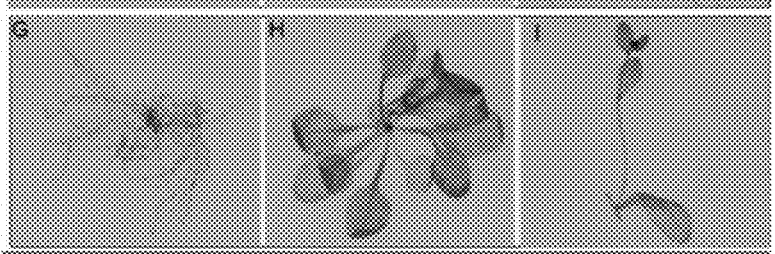
FIGs. 11J-L 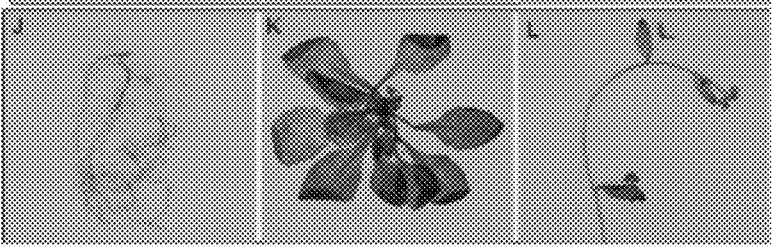

ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing yield (e.g., seed yield, oil yield), biomass, growth rate, vigor, oil content, fiber yield, fiber quality abiotic stress tolerance, and/or fertilizer use efficiency (e.g., nitrogen use efficiency) of a plant.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

The global shortage of water supply is one of the most severe agricultural problems affecting plant growth and crop yield and efforts are made to mitigate the harmful effects of desertification and salinization of the world's arable land. Water deficit is a common component of many plant stresses and occurs in plant cells when the whole plant transpiration rate exceeds the water uptake. In addition to drought, other stresses, such as salinity and low temperature, produce cellular dehydration.

Drought is a gradual phenomenon, which involves periods of abnormally dry weather that persists long enough to produce serious hydrologic imbalances such as crop damage and water supply shortage. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. This condition is only expected to worsen, further reducing the availability of arable land and crop production, since none of the top five food crops, i.e., wheat, corn, rice, potatoes, to and soybean, can tolerate excessive salt. Detrimental effects of salt on plants result from both water deficit which leads to osmotic stress (similar to drought stress) and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Germination of many crops is sensitive to temperature. A gene that would enhance germination in hot conditions would be useful for crops that are planted late in the season or in hot climates. In addition, seedlings and mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat.

Heat stress often accompanies conditions of low water availability. Heat itself is seen as an interacting stress and adds to the detrimental effects caused by water deficit conditions. Water evaporation increases along with the rise in daytime temperatures and can result in high transpiration rates and low plant water potentials. High-temperature damage to pollen almost always occurs in conjunction with drought stress, and rarely occurs under well-watered conditions. Combined stress can alter plant metabolism in various ways; therefore understanding the interaction between different stresses may be important for the development of strategies to enhance stress tolerance by genetic manipulation.

Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. For example, photoinhibition of photosynthesis (disruption of photosynthesis due to high light intensities) often occurs under clear atmospheric conditions subsequent to cold late summer/autumn nights. In addition, chilling may lead to yield losses and lower product quality through the delayed ripening of maize.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c)

increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Developing stress-tolerant plants is a strategy that has the potential to solve or mediate at least some of these problems. However, traditional plant breeding strategies used to develop new lines of plants that exhibit tolerance to ABS are relatively inefficient since they are tedious, time consuming and of unpredictable outcome. Furthermore, limited germplasm resources for stress tolerance and incompatibility in crosses between distantly related plant species represent significant problems encountered in conventional breeding. Additionally, the cellular processes leading to ABS tolerance are complex in nature and involve multiple mechanisms of cellular adaptation and numerous metabolic pathways.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Suboptimal nutrient (macro and micro nutrient) affect plant growth and development through the whole plant life cycle. One of the essential macronutrients for the plant is Nitrogen. Nitrogen is responsible for biosynthesis of amino acids and nucleic acids, prosthetic groups, plant hormones, plant chemical defenses, and the like. Nitrogen is often the rate-limiting element in plant growth and all field crops have a fundamental dependence on inorganic nitrogenous fertilizer. Since fertilizer is rapidly depleted from most soil types, it must be supplied to growing crops two or three times during the growing season. Additional important macronutrients are Phosphorous (P) and Potassium (K), which have a direct correlation to yield and general plant tolerance.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; *Arabidopsis* Information Resource (TAIR; Hypertext Transfer Protocol://World Wide Web (dot) *arabidopsis* (dot) org/), TAIR No. AT2G43710)], OleosinA (TAIR No. AT3G01570) or FAD3 (TAIR No. to AT2G29980), and various transcription factors and activators such as Led1 [TAIR No. AT1G21970, Lotan et al. 1998. *Cell.* 26; 93(7):1195-205], Lec2 [TAIR No. AT1G28300, Santos Mendoza et al. 2005, FEBS Lett. 579(21):4666-70], Fus3 (TAIR No. AT3G26790), ABI3 [TAIR No. AT3G24650, Lara et al. 2003. J Biol. Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using *Arabidopsis* FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range to of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. No. 5,981,834, U.S. Pat. No. 5,597,718, U.S. Pat. No. 5,620,882, U.S. Pat. No. 5,521,708 and U.S. Pat. No. 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

A promoter is a nucleic acid sequence approximately 200-1500 base pairs (bp) in length which is typically located upstream of coding sequences. A promoter functions in directing transcription of an adjacent coding sequence and thus acts as a switch for gene expression in an organism. Thus, all cellular processes are ultimately governed by the activity of promoters, making such regulatory elements important research and commercial tools.

Promoters are routinely utilized for heterologous gene expression in commercial expression systems, gene therapy and a variety of research applications.

The choice of the promoter sequence determines when, where and how strongly the heterologous gene of choice is expressed. Accordingly, when a constitutive expression throughout an organism is desired, a constitutive promoter is preferably utilized. On the other hand, when triggered gene expression is desired, an inductive promoter is preferred. Likewise, when an expression is to be confined to a particular tissue, or a particular physiological or developmental stage, a tissue specific or a stage specific promoter is respectively preferred.

Constitutive promoters are active throughout the cell cycle and have been utilized to express heterologous genes in transgenic plants so as to enable expression of traits encoded by the heterologous genes throughout the plant at all times. Examples of known constitutive promoters often used for plant transformation include the cauliflower heat shock protein 80 (hsp80) promoter, 35S cauliflower mosaic virus promoter, nopaline synthase (nos) promoter, octopine (ocs) *Agrobacterium* promoter and the mannopine synthase (mas) *Agrobacterium* promoter.

Inducible promoters can be switched on by an inducing agent and are typically active as long as they are exposed to the inducing agent. The inducing agent can be a chemical agent, such as a metabolite, growth regulator, herbicide, or phenolic compound, or a physiological stress directly imposed upon the plant such as cold, heat, salt, toxins, or through the action of a microbial pathogen or an insecticidal pest. Accordingly, inducible promoters can be utilized to regulate expression of desired traits, such as genes that control insect pests or microbial pathogens, whereby the protein is only produced shortly upon infection or first bites of the insect and transiently so as to decrease selective pressure for resistant insects. For example, plants can be transformed to express insecticidal or fungicidal traits such as the *Bacillus thuringiensis* (Bt) toxins, viruses coat proteins, glucanases, chitinases or phytoalexins. In another example, plants can be transformed to tolerate herbicides by overexpressing, upon exposure to a herbicide, the acetohydroxy acid synthease enzyme, which neutralizes multiple types of herbicides [Hattori, J. et al., Mol. General. Genet. 246: 419 (1995)].

Several fruit-specific promoters have been described, including an apple-isolated Thi promoter (U.S. Pat. No. 6,392,122); a strawberry-isolated promoter (U.S. Pat. No. 6,080,914); tomato-isolated E4 and E8 promoters (U.S. Pat. No. 5,859,330); a polygalacturonase promoter (U.S. Pat. No. 4,943,674); and the 2AII tomato gene promoter [Van Haaren et al., Plant Mol. Biol. 21: 625-640 (1993)]. Such fruit specific promoters can be utilized, for example, to modify fruit ripening by regulating expression of ACC deaminase which inhibits biosynthesis of ethylene. Other gene products which may be desired to express in fruit tissue include genes encoding flavor or color traits, such as thaumatin, cyclase or sucrose phosphate synthase.

Seed specific promoters have been described in U.S. Pat. Nos. 6,403,862, 5,608,152 and 5,504,200; and in U.S. patent application Ser. Nos. 09/998,059 and 10/137,964. Such seed specific promoters can be utilized, for example, to alter the levels of saturated or unsaturated fatty acids; to increase levels of lysine- or sulfur-containing amino acids, or to modify the amount of starch contained in seeds.

Several promoters which regulate gene expression specifically during germination stage have been described, including the α-glucoronidase and the cystatin-1 barely-isolated promoters (U.S. Pat. No. 6,359,196), and the hydrolase promoter [Skriver et al., Proc. Natl. Acad. Sci. USA, 88:7266-7270 (1991)].

WO2004/081173 discloses novel plant derived regulatory sequences and constructs and methods of using same for directing expression of exogenous polynucleotide sequences in plants.

SUMMARY OF THE INVENTION

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide at least 80% identical to SEQ ID NO: 488-813, 4852-5453, 5460, 5461, 5484, 5486-5550, 5553, 5558-8090 or 8091, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing oil content, fiber yield and/or fiber quality of a plant, comprising expressing within the plant an exogenous polynucleotide comprising a nucleic acid sequence encoding a polypeptide at least 80% identical to SEQ ID NO: 5470, 5476, or 5481, thereby increasing the oil content, fiber yield and/or fiber quality of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least 80% identical to SEQ ID NO: 1-487, 814-1598, 1600-1603, 1605-1626, 1632-1642, 1645-4850 or 4851, thereby increasing the yield, biomass, growth rate, vigor, oil content, fiber yield, fiber quality, abiotic stress tolerance, and/or nitrogen use efficiency of the plant.

According to an aspect of some embodiments of the present invention there is to provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising the nucleic acid sequence selected from the group consisting of SEQ ID NOs: 1-487, 814-1598, 1600-1603, 1605-1626, 1632-1642, 1645-4851, 1599, 1604, 1628, 1630, and 1644, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing oil content, fiber yield and/or fiber quality of a plant, comprising expressing within the plant an exogenous polynucleotide comprising a nucleic acid sequence at least 80% identical to SEQ ID NO: 1627, 1629, or 1631, thereby increasing the oil content, fiber yield and/or fiber quality of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 488-813, 4852-5453, 5460, 5461, 5484, 5486-5550, 5553, 5558-8090 or 8091, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to an aspect of some embodiments of the present invention there is provided an isolated polynucleotide comprising a nucleic acid sequence at least 80% identical to SEQ ID NO: 1-487, 814-1598, 1600-1603, 1605-1626, 1632-1642, 1645-4850 or 4851, wherein the nucleic acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is to provided an isolated polynucleotide comprising the nucleic acid sequence selected from the group consisting of SEQ ID NOs: 1-487, 814-1598, 1600-1603, 1605-1626, 1632-1642, 1645-4851, 1599, 1604, 1628, 1630, and 1644.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 488-813, 4852-5453, 5460, 5461, 5484, 5486-5550, 5553, 5558-8090 or 8091, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polypeptide comprising the amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant exogenously expressing the isolated polynucleotide of some embodiments of the invention.

According to an aspect of some embodiments of the present invention there is provided a transgenic plant comprising the nucleic acid construct of some embodiments of the invention.

According to an aspect of some embodiments of the present invention there is provided an isolated polynucleotide comprising the nucleic acid sequence set forth by SEQ ID NO: 8096.

According to an aspect of some embodiments of the present invention there is provided a nucleic acid construct comprising the isolated polynucleotide of some embodiments of the invention.

According to an aspect of some embodiments of the present invention there is provided a transgenic cell comprising the nucleic acid construct of some embodiments of the invention.

According to an aspect of some embodiments of the present invention there is provided a transgenic plant comprising the nucleic acid construct of some embodiments of the invention.

According to an aspect of some embodiments of the present invention there is provided a method of producing a transgenic plant, comprising transforming a plant with the isolated polynucleotide of some embodiments of the invention or with the nucleic acid construct of some embodiments of the invention.

According to an aspect of some embodiments of the present invention there is provided a method of expressing a polypeptide of interest in a cell comprising transforming the cell with a nucleic acid construct which comprises a polynucleotide sequence encoding the polypeptide of interest operably linked to the isolated polynucleotide of some embodiments of the invention, thereby expressing the polypeptide of interest in the cell.

According to some embodiments of the invention, the nucleic acid sequence encodes an amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to some embodiments of the invention, the nucleic acid sequence is selected from the group consisting of SEQ ID NOs:1-487, 814-1598, 1600-1603, 1605-1626, 1632-1642, 1645-4851, 1599, 1604, 1628, 1630, and 1644.

According to some embodiments of the invention, the polynucleotide consists of the nucleic acid sequence selected from the group consisting of SEQ ID NOs:1-487, 814-1598, 1600-1603, 1605-1626, 1632-1642, 1645-4851, 1599, 1604, 1628, 1630, and 1644.

According to some embodiments of the invention, the nucleic acid sequence encodes the amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to some embodiments of the invention, the plant cell forms part of a plant.

According to some embodiments of the invention, the promoter is heterologous to the isolated polynucleotide and/or to the host cell.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the promoter is set forth by SEQ ID NO: 8096.

According to some embodiments of the invention, the nucleic acid construct further comprising at least one heterologous polynucleotide operably linked to the isolated polynucleotide.

According to some embodiments of the invention, the at least one heterologous polynucleotide is a reporter gene.

According to some embodiments of the invention, the nucleic acid construct further comprising a heterologous polynucleotide operably linked to the isolated polynucleotide.

According to some embodiments of the invention, the heterologous to polynucleotide comprises the nucleic acid sequence selected from the group consisting of SEQ ID NOs: 1-487, 814-1598, 1600-1603, 1605-1626, 1632-1642, 1645-4851, 1599, 1604, 1628, 1630, and 1644.

According to some embodiments of the invention, the transgenic cell of some embodiments of the invention, being a plant cell.

According to some embodiments of the invention, the polypeptide of interest comprises the amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to some embodiments of the invention, the polynucleotide encoding the polypeptide of interest comprises the nucleic acid sequence selected from the group consisting of SEQ ID NOs: 1-487, 814-1598, 1600-1603, 1605-1626, 1632-1642, 1645-4851, 1599, 1604, 1628, 1630, and 1644.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

FIG. 5 depicts sequence alignment between the novel promoter sequence (SEQ ID NO:8096) identified herein from *Arabidopsis thaliana* and the previously disclosed *Arabidopsis* At6669 promoter (WO2004/081173; set forth by SEQ ID NO:8093 herein). Mismatched nucleotides are underlined in positions 270; 484; 867-868; 967; 2295 and 2316-2318 of SEQ ID NO: 8096. New Domains are marked with an empty box in positions 862-865; 2392-2395 and 2314-2317 of SEQ ID NO:8096. Note that the YACT regulatory element at position 862-865 and the AAAG regulatory element at positions 2392-2395 and 2314-2317 of the novel promoter sequence (SEQ ID NO:8096) are absent in the previously disclosed At6669 promoter (SEQ ID NO:8093).

FIGS. 11A-L are images depicting GUS staining in 41-day-old *A. thaliana* seedlings which were transformed with the GUS intron expression cassette under the novel At6669 promoter (SEQ ID NO:8096). Note that the novel promoter sequence p6669 induces GUS expression (blue staining) in 41 day old *A. thaliana*, especially in the stem, roots mainly root tip. Strong expression was detected in flower, leaves and cauline leaves. GUS expression is demonstrated for 4 indepented events: FIGS. 11A-C—event 12511; FIGS. 11D-F—event 12516; FIGS. 11G-I—event 12515; FIGS. 11J-L—event 12512.

DESCRIPTION OF SPECIFIC EMBODIMENTS OF THE INVENTION

Figure 1:
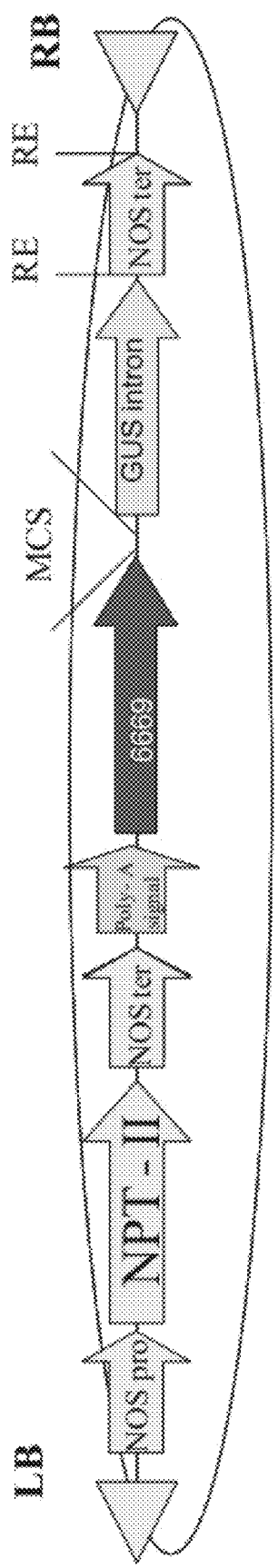
FIG. 1 is a schematic illustration of the modified pGI binary plasmid containing to the new At6669 promoter (SEQ ID NO:8096) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.

The present invention, in some embodiments thereof, relates to isolated polynucleotides and polypeptides, nucleic acid constructs encoding same, cells expressing same, transgenic plants expressing same and methods of using same for increasing yield, biomass, growth rate, vigor, oil content, fiber yield, fiber quality, abiotic stress tolerance, and/or nitrogen use efficiency of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase yield, biomass, growth rate, vigor, oil content, fiber yield, fiber quality abiotic stress tolerance, and/or fertilizer use efficiency (e.g., nitrogen use efficiency) of a plant, and a novel regulatory sequence which can be used to express heterologous genes in host cells such as in plants.

Thus, as shown in the Examples section which follows, the present inventors have utilized bioinformatics tools to identify polynucleotides which enhance yield (e.g., seed yield, oil yield, oil content), growth rate, biomass, vigor, fiber yield, fiber quality, abiotic stress tolerance and/or nitrogen use efficiency) of a plant. Genes which affect the trait-of-interest were identified (Table 27, Example 10) based on correlation analyses performed using *Arabidopsis* ecotypes (Examples 2 and 3), tomato varieties (Example 4), *b. Juncea* ecotypes (Examples 5 and 6), *Sorghum* varieties (Example 7), Maize hybrids (Example 8) and the expression profiles of the genes according to selected expression sets (e.g., tissues, developmental stages and stress conditions) (Tables 1-26, Examples 1-9). Homologous polypeptides and polynucleotides having the same function were also identified (Table 28, Example 11). The identified polynucleotides were cloned into binary vectors (Example 12, Table 29) and transgenic plants over-expressing the identified polynucleotides and polypeptides were generated (Example 13) and further tested for the effect of the exogenous gene on the trait of interest (e.g., increased fresh and dry weight, leaf area, root coverage and length, relative growth rate (RGR) of leaf area, RGR of root coverage, RGR of root length, seed yield, oil yield, dry matter, harvest index, growth rate, rosette area, rosette diameter, RGR leaf number, RGR plot coverage, RGR rosette diameter, leaf blade area, oil percentage in seed and weight of 1000 seeds, plot coverage, tolerance to abiotic stress conditions and to fertilizer limiting conditions; Examples 14-16; Tables 30-48). In addition, as is further shown in the Examples section which follows, the present inventors have uncovered a novel promoter sequence which can be used to express the gene-of-interest in a host cell (Example 17, FIGS. 5, 8-11). Altogether, these results suggest the use of the novel polynucleotides and polypeptides of the invention for increasing yield (including oil yield, seed yield and oil content), growth rate, biomass, vigor, fiber yield, fiber quality, abiotic stress tolerance and/or nitrogen use efficiency of a plant.

Thus, according to an aspect of some embodiments of the invention, there is provided method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least 80% identical to SEQ ID NO: 1-487, 814-1598, 1600-1603, 1605-1626, 1632-1642, 1645-4850 or 4851, thereby increasing the yield, to biomass, growth rate, vigor, oil content, fiber yield, fiber quality, abiotic stress tolerance, and/or nitrogen use efficiency of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given to plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in cm² per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

It should be noted that a plant yield can be determined under stress (e.g., abiotic stress, nitrogen-limiting conditions) and/or non-stress (normal) conditions.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, seed yield, biomass, growth rate, vigor, oil content, fiber yield, fiber quality, abiotic stress tolerance, and/or nitrogen use efficiency of a plant as compared to a native plant [i.e., a plant not modified with the biomolecules (polynucleotide or polypeptides) of the invention, e.g., a non-transformed plant of the same species which is grown under the same growth conditions).

The phrase "expressing within the plant an exogenous polynucleotide" as used herein refers to upregulating the expression level of an exogenous polynucleotide within the plant by introducing the exogenous polynucleotide into a plant cell or a plant and expressing by recombinant means, as further described herein below.

As used herein "expressing" refers to expression at the mRNA and optionally to polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof. According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-487, 814-1598, 1600-1603, 1605-1626, 1632-1642, 1645-4851.

According to some embodiments of the invention, the homology is a global homology, i.e., an homology over the entire amino acid or nucleic acid sequences of the invention and not over portions thereof.

According to some embodiments of the invention, the identity is a global identity, i.e., an identity over the entire amino acid or nucleic acid sequences of the invention and not over portions thereof.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least to about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-487, 814-1598, 1600-1603, 1605-1626, 1632-1642, 1645-4851.

According to some embodiments of the invention the exogenous polynucleotide is set forth by SEQ ID NO: 1-487, 814-1598, 1600-1603, 1605-1626, 1632-1642, 1645-4851, 1599, 1604, 1628, 1630, or 1644.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising the nucleic acid sequence selected from the group consisting of SEQ ID NOs: 1-487, 814-1598, 1600-1603, 1605-1626, 1632-1642, 1645-4851, 1599, 1604, 1628, 1630, and 1644, thereby increasing the yield, biomass, growth rate, vigor, oil content, fiber yield, fiber quality, abiotic stress tolerance, and/or nitrogen use efficiency of the plant.

According to some embodiments of the invention the exogenous polynucleotide is set forth by the nucleic acid sequence selected from the group consisting of SEQ NOs: 1-487, 814-1598, 1600-1603, 1605-1626, 1632-1642, 1645-4851, 1599, 1604, 1628, 1630, and 1644.

According to an aspect of some embodiments of the invention, there is provided a method of increasing oil content, fiber yield and/or fiber quality of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1627, 1629 and 1631, thereby increasing the oil content, fiber yield and/or fiber quality of the plant.

According to an aspect of some embodiments of the invention, there is provided a method of increasing oil content, fiber yield and/or fiber quality of a plant, comprising expressing within the plant an exogenous polynucleotide comprising the nucleic acid sequence selected from the group consisting of SEQ ID NOs: 1627, 1629, and 1631, thereby increasing the oil content, fiber yield and/or fiber quality of the plant.

According to some embodiments of the invention the exogenous polynucleotide is set forth by the nucleic acid sequence selected from the group consisting of SEQ ID NOs:1627, 1629, and 1631.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs:488-813, 4852-5453, 5460, 5461, 5484, 5486-5550, 5553, and 5558-8091.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:488-813, 4852-5453, 5460, 5461, 5484, 5486-5550, 5553, and 5558-8091.

According to some embodiments of the invention, the exogenous polynucleotide encodes a polypeptide consisting of the amino acid sequence set forth by SEQ ID NO: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, 5554-5556 or 5557.

According to an aspect of some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs:488-813, 4852-5453, 5460, 5461, 5484, 5486-5550, 5553, and 5558-8091, thereby increasing the yield, biomass, growth rate, vigor, oil content, fiber yield, fiber quality, abiotic stress tolerance, and/or nitrogen use efficiency of the plant.

According to an aspect of some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid to sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:488-813, 4852-5453, 5460, 5461, 5484, 5486-5550, 5553, and 5558-8091, thereby increasing the yield, biomass, growth rate, vigor, oil content, fiber yield, fiber quality, abiotic stress tolerance, and/or nitrogen use efficiency of the plant.

According to an aspect of some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs:488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557, thereby increasing the yield, biomass, growth rate, vigor, oil content, fiber yield, fiber quality, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, 5554-5556 or 5557.

According to an aspect of some embodiments of the invention, there is provided a method of increasing oil content, fiber yield and/or fiber quality of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 5470, 5476, and 5481, thereby increasing the oil content, fiber yield and/or fiber quality of the plant.

According to an aspect of some embodiments of the invention, the method of increasing oil content, fiber yield and/or fiber quality of a plant is effected by expressing within the plant an exogenous polynucleotide comprising a nucleic acid sequence encoding a polypeptide selected from the group consisting of SEQ ID NOs: 5470, 5476, and 5481, thereby increasing the oil content, fiber yield and/or fiber quality of a plant.

According to some embodiments of the invention, the exogenous polynucleotide encodes a polypeptide consisting of the amino acid sequence set forth by SEQ ID NO: 5470, 5476, or 5481.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance to of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 211-217, 278-284, 486 and 487.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-487, 814-1598, 1600-1603, 1605-1626, 1632-1642, 1645-4851.

According to some embodiments of the invention the nucleic acid sequence is capable of increasing yield, biomass, growth rate, vigor, oil content, fiber yield, fiber quality, abiotic stress tolerance, and/or nitrogen use efficiency of a plant.

According to some embodiments of the invention the isolated polynucleotide comprising the nucleic acid sequence selected from the group consisting of SEQ ID NOs: 1-487, 814-1598, 1600-1603, 1605-1626, 1632-1642, 1645-4851, 1599, 1604, 1628, 1630, and 1644.

According to some embodiments of the invention the isolated polynucleotide is set forth by SEQ ID NO: 1-487, 814-1598, 1600-1603, 1605-1626, 1632-1642, 1645-4851, 1599, 1604, 1628, 1630, or 1644.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 488-813, 4852-5453, 5460, 5461, 5484, 5486-5550, 5553, and 5558-8091.

According to some embodiments of the invention the amino acid sequence is capable of increasing yield, biomass, growth rate, vigor, oil content, fiber yield, fiber quality, abiotic stress tolerance, and/or nitrogen use efficiency of a plant.

The invention provides an isolated polynucleotide comprising a nucleic acid sequence encoding a polypeptide which comprises the amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least to about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 488-813, 4852-5453, 5460, 5461, 5484, 5486-5550, 5553, and 5558-8091.

According to some embodiments of the invention the amino acid sequence is capable of increasing yield, biomass, growth rate, vigor, oil content, fiber yield, fiber quality, abiotic stress tolerance, and/or nitrogen use efficiency of a plant.

According to some embodiments of the invention, the polypeptide comprising an amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to some embodiments of the invention, the polypeptide is set forth by SEQ ID NO: 488-813, 4852-

5453, 5460, 5461, 5484, 5486-5550, 5553, 5558-8091, 5454-5459, 5462-5469, 5471-5475, 5477-5480, 5482, 5483, 5485, 5551, 5552, 5554-5556 or 5557.

According to an aspect of some embodiments of the invention there is provided a nucleic acid construct comprising the isolated polynucleotide of the invention and a promoter for directing transcription of the nucleic acid sequence in a host cell.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemafhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp., *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter (SEQ ID NO:8094; Odell et al., Nature 313:810-812, 1985); *Arabidopsis* At6669 promoter (SEQ ID NO:8093; see PCT Publication No. WO04081173A2) or the novel At6669 promoter (SEQ ID NO:8096); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:8095), from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), apetala-3] and root promoters such as the ROOTP promoter [SEQ ID NO: 8097].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

As mentioned above, and further described in Example 15 of the Examples section which follows, the present inventors have uncovered a novel promoter to sequences (regulatory nucleic acid sequences) which can be used to express a polynucleotide-of-interest in a plant.

Thus, according to an aspect of some embodiments of the invention, there is provided an isolated polynucleotide comprising the nucleic acid sequence set forth by SEQ ID NO:8096.

According to some embodiments of the invention the isolated polynucleotide is capable of regulating expression of the heterologous polynucleotide in a host cell.

According to some embodiments of the invention the heterologous polynucleotide is operably linked to the regulatory nucleic acid sequence set forth by SEQ ID NO: 8096.

According to an aspect of some embodiments of the invention, there is provided a nucleic acid construct comprising the isolated polynucleotide set forth by SEQ ID NO:8096.

According to some embodiments of the invention the nucleic acid construct further comprising at least one heterologous polynucleotide operably linked to the isolated polynucleotide.

According to some embodiments of the invention, the regulatory nucleic acid sequence of the invention ranges in length from about 500 nucleotides to about 4000 nucleotides and includes one or more sequence regions which are capable of recognizing and binding RNA polymerase II and other proteins (trans-acting transcription factors) involved in transcription.

According to some embodiments of the invention, the regulatory sequence is positioned 1-500 bp upstream of the ATG codon of the coding nucleic acid sequence, although it will be appreciated that regulatory sequences can also exert their effect when positioned elsewhere with respect to the coding nucleic acid sequence (e.g., within an intron).

As is clearly illustrated in the Examples section which follows, the novel At6669 promoter sequence of some embodiments of the invention is capable of regulating expression of a coding nucleic acid sequence (e.g., a reporter gene such as GUS, luciferase) operably linked thereto (see Example 17 of the Examples section which follows).

According to some embodiments of the invention, the regulatory nucleic acid sequences of the invention are modified to create variations in the molecule sequences such as to enhance their promoting activities, using methods known in the art, such as PCR-based DNA modification, or standard DNA mutagenesis techniques, or by chemically synthesizing the modified polynucleotides.

Accordingly, the regulatory nucleic acid sequence of the invention (e.g., SEQ ID NO: 8096) may be truncated or deleted and still retain the capacity of directing the transcription of an operably linked heterologous DNA sequence. The minimal length of a promoter region can be determined by systematically removing sequences from the 5' and 3'-ends of the isolated polynucleotide by standard techniques known in the art, including but not limited to removal of restriction enzyme fragments or digestion with nucleases. Consequently, any sequence fragments, portions, or regions of the disclosed promoter polynucleotide sequences of the invention can be used as regulatory sequences. It will be appreciated that modified sequences (mutated, truncated and the like) can acquire different transcriptional properties such as the direction of different pattern of gene expression as compared to the unmodified element.

Optionally, the sequences set forth in SEQ ID NO:8096 may be modified, for example for expression in a range of plant systems. In another approach, novel hybrid promoters can be designed or engineered by a number of methods. Many promoters contain upstream sequences which activate, enhance or define the strength and/or specificity of the promoter, such as described, for example, by Atchison [Ann. Rev. Cell Biol. 4:127 (1988)]. T-DNA genes, for example contain "TATA" boxes defining the site of transcription initiation and other upstream elements located upstream of the transcription initiation site modulate transcription levels [Gelvin In: Transgenic Plants (Kung, S.-D. and Us, R., eds, San Diego: Academic Press, pp. 49-87, (1988)]. Another chimeric promoter combined a trimer of the octopine synthase (ocs) activator to the mannopine synthase (mas) activator plus promoter and reported an increase in expression of a reporter gene [Min Ni et al., The Plant Journal 7:661 (1995)]. The upstream regulatory sequences of the promoter polynucleotide sequences of the invention can be used for the construction of such chimeric or hybrid promoters. Methods for construction of variant promoters include, but are not limited to, combining control elements of different promoters or duplicating portions or regions of a promoter (see for example, U.S. Pat. Nos. 5,110,732 and 5,097,025). Those of skill in the art are familiar with the specific conditions and procedures for the construction, manipulation and isolation of macromolecules (e.g., DNA molecules, plasmids, etc.), generation of recombinant organisms and the screening and isolation of genes, [see for example Sambrook et al., Molecular Cloning: A Laboratory Manual, Cold Spring Harbor Press, (1989); Mailga et al., Methods in Plant Molecular Biology, Cold Spring Harbor Press, (1995); Birren et al., Genome Analysis: volume 1, Analyzing DNA, (1997); volume 2, Detecting Genes, (1998); volume 3, Cloning Systems, (1999); and volume 4, Mapping Genomes, (1999), Cold Spring Harbor, N.Y.].

According to some embodiments of the invention the heterologous polynucleotide, which is regulated by the regulatory nucleic acid sequence set forth by SEQ ID NO:8096, comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-487, 814-1598, 1600-1603, 1605-1626, 1632-1642, 1645-4851, 1599, 1604, 1628, 1630, and 1644.

According to some embodiments of the invention the heterologous polynucleotide, which is regulated by the regulatory nucleic acid sequence set forth by SEQ ID NO:8096, encodes an amino acid sequence at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to SEQ ID NO: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, 5554-5556 or 5557.

According to some embodiments of the invention the heterologous polynucleotide, which is regulated by the regulatory nucleic acid sequence set forth by SEQ ID NO:8096, comprises a nucleic acid sequence at least about 80%, at least about 81%, at least about 82%, at least about 83%, at least about 84%, at least about 85%, to at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1627, 1629 and 1631.

According to some embodiments of the invention the heterologous polynucleotide, which is regulated by the regulatory nucleic acid sequence set forth by SEQ ID NO:8096, encodes an amino acid sequence at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to SEQ ID NO: 5470, 5476 and 5481.

According to some embodiments of the invention, the method of increasing yield, biomass, growth rate, vigor, oil content, fiber yield, fiber quality, abiotic stress tolerance, and/or nitrogen use efficiency of a plant is effected by expressing within the plant a nucleic acid construct which comprises the nucleic acid sequence set forth by SEQ ID NO: 8096 and a heterologous polynucleotide sequence which comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-487, 814-1598, 1600-1603, 1605-1626, 1632-1642, 1645-4851, 1599, 1604, 1628, 1630, and 1644, wherein the nucleic acid sequence is capable of regulating expression of the heterologous polynucleotide in a host cell.

According to some embodiments of the invention, the method of increasing yield, biomass, growth rate, vigor, oil content, fiber yield, fiber quality, abiotic stress tolerance, and/or nitrogen use efficiency of a plant is effected by expressing within the plant a nucleic acid construct which comprises the nucleic acid sequence set forth by SEQ ID NO: 8096 and a heterologous polynucleotide sequence which encodes an amino acid sequence at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to SEQ ID NO: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, 5554-5556 or 5557, wherein the nucleic acid sequence is capable of regulating expression of the heterologous polynucleotide in a host cell.

According to some embodiments of the invention, the method of increasing yield, biomass, growth rate, vigor, oil content, fiber yield, fiber quality, abiotic stress tolerance, and/or nitrogen use efficiency of a plant is effected by expressing within the plant a nucleic acid construct which comprises the nucleic acid sequence set forth by SEQ ID NO: 8096 and a heterologous polynucleotide sequence which comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1627, 1629 or 1631, wherein the nucleic acid sequence is capable of regulating expression of the heterologous polynucleotide in a host cell.

According to some embodiments of the invention, the method of increasing yield, biomass, growth rate, vigor, oil content, fiber yield, fiber quality, abiotic stress tolerance, and/or nitrogen use efficiency of a plant is effected by expressing within the plant a nucleic acid construct which comprises the nucleic acid sequence set forth by SEQ ID NO: 8096 and a heterologous polynucleotide sequence which encodes an amino acid sequence at least at least about 80%, at least about 81%, at least about 82%, at least about 83%, at least about 84%, at least about 85%, at least about 86%, at to least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to SEQ ID NO: 5470, 5476 or 5481, wherein the nucleic acid sequence is capable of regulating expression of the heterologous polynucleotide in a host cell.

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most to common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase oil content, yield, growth rate, biomass, vigor, nitrogen use efficiency and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor, nitrogen use efficiency and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal to ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield, oil content and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

According to an aspect of some embodiments of the invention there is provided a method of expressing a polypeptide of interest in a cell, the method is effected by transforming the cell with a nucleic acid construct which comprises a polynucleotide sequence encoding the polypeptide of interest operably linked to the isolated polynucleotide set forth by SEQ ID NO: 8096, thereby expressing the polypeptide of interest in the cell.

According to some embodiments of the invention, the polypeptide of interest comprises the amino acid sequence at least about 80%, at least about 81%, at least about 82%, at least about 83%, at least about 84%, at least about 85%, at least about to 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to the polypeptide selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to some embodiments of the invention, the polypeptide of interest comprises the amino acid sequence selected from the group consisting of SEQ ID NOs: 488-813, 4852-5453, 5460, 5461, 5484, 5486-5550, 5553, 5558-8091, 5454-5459, 5462-5469, 5471-5475, 5477-5480, 5482, 5483, 5485, 5551, 5552, and 5554-5557.

According to some embodiments of the invention, the polypeptide of interest comprises the amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to the polypeptide selected from the group consisting of SEQ ID NOs:5470, 5476 and 5481.

According to some embodiments of the invention, the polypeptide of interest comprises the amino acid sequence selected from the group consisting of SEQ ID NOs: 5470, 5476 and 5481.

According to some embodiments of the invention, the polynucleotide encoding the polypeptide of interest comprises the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-487, 814-1598, 1600-1603, 1605-1626, 1632-1642, 1645-4851, 1599, 1604, 1628, 1630, and 1644.

According to some embodiments of the invention, the polynucleotide encoding the polypeptide of interest comprises the nucleic acid sequence selected from the group consisting of SEQ ID NOs: 1-487, 814-1598, 1600-1603, 1605-1626, 1632-1642, 1645-4851, 1599, 1604, 1628, 1630, and 1644.

According to some embodiments of the invention, the polynucleotide encoding the polypeptide of interest comprises the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1627, 1629 and 1631.

According to some embodiments of the invention, the polynucleotide encoding the polypeptide of interest comprises the nucleic acid sequence selected from the group consisting of SEQ ID NOs: 1627, 1629 and 1631.

Thus, the invention encompasses transgenic cells (e.g., transgenic plant cells), plants exogenously expressing the polynucleotide(s) (e.g., transgenic plants), the nucleic acid constructs and/or polypeptide(s) of the invention, and methods of generating or producing same. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those to polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM to mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic *Arabidopsis* plants are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), to amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM or 0.05 mM. Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 to Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course            Formula II Thus, the relative growth area rate is in units of 1/day and length growth rate is in units of 1/day.

Seed yield—Evaluation of the seed yield per plant can be done by measuring the to amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000            Formula III The Harvest Index can be calculated using Formula IV Harvest Index=Average seed yield per plant/Average dry weight            Formula IV Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol:// World Wide Web (dot) cottoninc (dot) com/Classification-ofCotton/?Pg=4#Length).

According to some embodiments of the invention, increased yield of corn may be manifested as one or more of the following: increase in the number of plants per growing area, increase in the number of ears per plant, increase in the number of rows to per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known to manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); to Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—was performed for selected genes according to some to embodiments of the invention, in which the characterized parameters (measured parameters according to the correlation IDs) were used as "x axis" for correlation with the tissue transcriptom which was used as the "Y axis". For each gene and measured parameter a correlation coefficient "R" was calculated [using Pearson correlation test Hypertext Transfer Protocol://World Wide Web (dot) davidmlane (dot) com/hyperstat/A34739 (dot) html] along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like). A positive correlation indicates that the expression of the gene in a certain tissue or developmental stage and the correlation vector (phenotype performance) are positively associated (both, expression and phenotypic performance increase or decrease simultaneously) while a negative correlation indicates a negative association (while the one is increasing the other is decreasing and vice versa). Genes which expression thereof in certain tissue significantly correlates with certain trait are presented in Table 26 along with their correlation coefficient (R, calculated using Pearson correlation) and the p-values under the category of the biodiesel ecotypes vector set.

Example 1

Identification of Genes and Predicted Role Using Bioinformatics Tools

The present inventors have identified polynucleotides which can increase plant yield, seed yield, oil yield, oil content, biomass, growth rate, fiber yield and/or quality, abiotic stress tolerance, nitrogen use efficiency and/or vigor of a plant, as follows.

The nucleotide sequence datasets used here were from publicly available databases or from sequences obtained using the Solexa technology (e.g. Barley and *Sorghum*). Sequence data from 100 different plant species was introduced into a single, to comprehensive database. Other information on gene expression, protein annotation, enzymes and pathways were also incorporated. Major databases used include:

Genomes

*Arabidopsis* genome [TAIR genome version 8 (Hypertext Transfer Protocol://World Wide Web (dot) *arabidopsis* (dot) org/)]; Rice genome [build 6.0 (Hypertext Transfer Protocol://http://rice (dot) plantbiology(dot)msu(dot)edu/index-.shtml];

Poplar [*Populus trichocarpa* release 1.1 from JGI (assembly release v1.0) (Hypertext Transfer Protocol://World Wide Web (dot) genome (dot) jgi-psf (dot) org/)];

Brachypodium [JGI 4× assembly, Hypertext Transfer Protocol://World Wide Web (dot) brachpodium (dot) org)];

Soybean [DOE-JGI SCP, version Glyma1 (Hypertext Transfer Protocol://World Wide Web (dot) phytozome (dot) net/)];

Grape [French-Italian Public Consortium for Grapevine Genome Characterization grapevine genome (Hypertext Transfer Protocol://World Wide Web (dot) genoscope (dot) cns (dot) fr/)];

Castobean [TIGR/J Craig Venter Institute 4× assembly [(Hypertext Transfer Protocol://msc (dot) jcvi (dot) org/r communis];

Sorghum [DOE-JGI SCP, version Sbi1 [Hypertext Transfer Protocol://World Wide Web (dot) phytozome (dot) net/)];

Partially assembled genome of Maize [Hypertext Transfer Protocol://maizesequence (dot) org/];

Expressed EST and mRNA Sequences were Extracted from the Following Databases:

EST and RNA sequences from NCBI (Hypertext Transfer Protocol://World Wide Web (dot) ncbi (dot) nlm (dot) nih (dot) gov/dbEST/);

RefSeq (Hypertext Transfer Protocol://World Wide Web (dot) ncbi (dot) nlm (dot) nih (dot) gov/RefSeq/);

TAIR (Hypertext Transfer Protocol://World Wide Web (dot) *arabidopsis* (dot) org/);

Protein and Pathway Databases

Uniprot [Hypertext Transfer Protocol://World Wide Web (dot) uniprot (dot) org/].

AraCyc [Hypertext Transfer Protocol://World Wide Web (dot) *arabidopsis* (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web.ncbi.nlm.nih.gov/geo/) TAIR (Hypertext Transfer Protocol://World Wide Web.arabidopsis.org/).

Proprietary microarray data (See WO2008/122980) and Examples 2-9 below.

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was to employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling which combined microarray data and digital expression profile (see below). According to gene expression profile, a correlation analysis was performed to identify genes which are co-regulated under different developmental stages and environmental conditions and which are associated with different phenotypes.

Publicly available microarray datasets were downloaded from TAIR and NCBI GEO sites, renormalized, and integrated into the database. Expression profiling is one of the most important resource data for identifying genes important for yield, biomass, growth rate, vigor, oil content, abiotic stress tolerance of plants and nitrogen use efficiency.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (e.g., the developmental stages at which a gene can be found/expressed) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?lPage=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test.

Experimental Procedures

RNA extraction—Five tissues at different developmental stages including root, leaf, flower at anthesis, seed at 5 days after flowering (DAF) and seed at 12 DAF, representing different plant characteristics, were sampled and RNA was extracted as described above. The Expression sets (e.g., roots, leaf etc.) are included in Table 26 below.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer [20:20:20; weight ratios; Nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in tissue culture assays—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in greenhouse assays—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S. National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 2 days starting at day 7 in the photography room and the roots development was documented (FIGS. 3A-F). The growth rate of roots was calculated according to Formula V.

Relative growth rate of root coverage=Regression coefficient of root coverage along time course.  Formula V Vegetative growth rate analysis—was calculated according to Formula VI. The analysis was ended with the appearance of overlapping plants.

Relative vegetative growth rate area=Regression coefficient of vegetative area along time course.  Formula VI For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques from each plot were opened in the photography room, the seeds were scatter on a glass tray and photographed using a high resolution digital camera. Using the images the number of seeds per silique was determined Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula VII.

Seed Oil yield=Seed yield per plant (gr)*Oil % in seed          Formula VII

Harvest Index—The harvest index was calculated using Formula IV as described above [Harvest Index=Average seed yield per plant/Average dry weight].

Experimental Results

Nine different *Arabidopsis* ecotypes were grown and characterized for 18 parameters (named as correlation vectors in Table 26). The measured parameters are provided in Tables 1 and 2 below. Correlations of gene's expression in various tissues with these phenotypic measurements are presented in Table 26, as "*Arabidopsis* 1" in vector set column.

TABLE 1

Measured parameters in *Arabidopsis* ecotypes

| Ecotype | Seed yield per plant (gr) | Oil yield per plant (mg) | Oil % per seed | 1000 Seed weight (gr) | Dry matter per plant (gr) | Harvest Index | Total leaf area per plant (cm$^2$) | Seeds per silique | Silique length (cm) |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 1. Provided are the values of each of the parameters measured in *Arabidopsis* ecotypes: Seed yield per plant (gram); oil yield per plant (mg); oil % per seed; 1000 seed weight (gr); dry matter per plant (gr); harvest index; total leaf area per plant (cm$^2$); seeds per silique; Silique length (cm). "gr." = grams; "mg" = miligrams; "cm" = centimeters".

TABLE 2

Additional measured parameters in *Arabidopsis* ecotypes

| Ecotype | Veg. GR | Relat. root growth | Root length day 7 | Root length day 13 | Fresh weight per plant | Lam. Leng. | Lam. width | Leaf width/ length | Blade circularity |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |

TABLE 2-continued

Additional measured parameters in *Arabidopsis* ecotypes

| Ecotype | Veg. GR | Relat. root growth | Root length day 7 | Root length day 13 | Fresh weight per plant | Lam. Leng. | Lam. width | Leaf width/ length | Blade circularity |
|---|---|---|---|---|---|---|---|---|---|
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 2. Provided are the values of each of the parameters measured in *Arabidopsis* ecotypes:
Veg. GR = vegetative growth rate (cm$^2$/day) until 8 true leaves; Relat. Root growth = relative root growth (cm/day); Root length day 7 (cm); Root length day 13 (cm); fresh weight per plant (gr) at bolting stage; Lam. Leng. = Lamima length (cm); Lam. Width = Lamina width (cm); Leaf width/length; Blade circularity.

Example 3

Production of *Arabidopsis* Transcriptom and High Throughput Correlation Analysis of Normal and Nitrogen Limiting Conditions Using 44K *Arabidopsis* Oligonucleotide Micro-Array In order to produce a high throughput correlation analysis, the present inventors utilized an *Arabidopsis* oligonucleotide micro-array, produced by Agilent Technologies [Hypertext Transfer Protocol://World Wide Web (dot) chem (dot) agilent (dot) com/Scripts/PDS (dot) asp?l-Page=50879]. The array oligonucleotide represents about to 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test.

Experimental Procedures

RNA extraction—Two tissues of plants [leaves and stems] growing at two different nitrogen fertilization levels (1.5 mM Nitrogen or 6 mM Nitrogen) were sampled and RNA was extracted as described above. The Expression sets (e.g., roots, leaf etc.) are included in Table 26 below.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of KNO$_3$, supplemented with 2 mM CaCl$_2$, 1.25 mM KH$_2$PO$_4$, 1.50 mM MgSO$_4$, 5 mM KCl, 0.01 mM H$_3$BO$_3$ and microelements, while normal irrigation conditions (Normal Nitrogen conditions) was achieved by applying a solution of 6 mM inorganic nitrogen also in the form of KNO$_3$, supplemented with 2 mM CaCl$_2$, 1.25 mM KH$_2$PO$_4$, 1.50 mM MgSO$_4$, 0.01 mM H$_3$BO$_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol:// rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb (dot) nih (dot) gov/]. Next, analyzed data was saved to text files and processed using the JMP statistical analysis software (SAS institute).

Data parameters collected are summarized in Table 26 below.

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process was repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, rosette diameter and rosette area.

Relative growth rate area: The growth rate and the relative growth rate of the rosette and the leaves were calculated according to the following Formulas VIII and IX:

$$\text{Growth rate} = \frac{\Delta \text{Area}}{\Delta t} \qquad \text{Formula VIII}$$

$$\text{Relative growth rate} = \frac{\Delta \text{Area}}{\Delta t} * \frac{1}{\Delta \text{Area}_{t0}} \qquad \text{Formula IX}$$

$\Delta t$ is the current analyzed image day subtracted from the initial day (Meaning that area growth rate is in units of cm$^2$/day and length growth rate is in units of cm/day). Though the examples shown here are for Area growth rate parameters, the Length growth rate parameters are calculated using similar formulas.

Seed yield and 1000 seeds weight—At the end of the experiment all seeds from all plots were collected and weighed in order to measure seed yield per plant in terms of total seed weight per plant (gr). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—The harvest index was calculated using formula IV (Harvest Index=Average seed yield per plant/Average dry weight).

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr]/SPAD unit], plant DW per nitrogen unit [DW/N level=plant biomass per plant [g]/SPAD unit], and nitrogen level per gram of biomass [N level/DW=SPAD unit/plant biomass per plant (gr)] were calculated.

Percent of seed yield reduction—measures the amount of seeds obtained in plants when grown under nitrogen-limiting conditions compared to seed yield produced at normal nitrogen levels expressed in %.

TABLE 3

Additional measured parameters in *Arabidopsis* ecotypes

| Arabidopsis 2 NUE | N 1.5 mM Rosette Area 8 day | N 1.5 mM Rosette Area 10 day | N 1.5 mM Leaf Number 10 day | N 1.5 mM Leaf Blade Area 10 day | N 1.5 mM RGR of Rosette Area 3 day | N 1.5 mM t50 Flowering |
|---|---|---|---|---|---|---|
| Bay-0 | 0.760 | 1.430 | 6.875 | 0.335 | 0.631 | 15.967 |
| Col-0 | 0.709 | 1.325 | 7.313 | 0.266 | 0.793 | 20.968 |
| Ct-1 | 1.061 | 1.766 | 7.313 | 0.374 | 0.502 | 14.836 |
| Gr-6 | 1.157 | 1.971 | 7.875 | 0.387 | 0.491 | 24.708 |
| kondara | 0.996 | 1.754 | 7.938 | 0.373 | 0.605 | 23.566 |
| Mc-0 | 1.000 | 1.832 | 7.750 | 0.370 | 0.720 | 23.698 |
| Mt-0 | 0.910 | 1.818 | 7.625 | 0.386 | 0.825 | 18.059 |
| No-0 | 0.942 | 1.636 | 7.188 | 0.350 | 0.646 | 19.488 |
| Oy-o | 1.118 | 1.996 | 8.625 | 0.379 | 0.668 | 23.568 |
| Shakadara | 0.638 | 1.150 | 5.929 | 0.307 | 0.636 | 21.888 |

Table 3. Provided are the values of each of the parameters measured in *Arabidopsis* ecotypes:
N 1.5 mM Rosette Area 8 day (measured in cm$^2$); N 1.5 mM Rosette Area 10 day (measured in cm$^2$); N 1.5 mM Leaf Number 10 day; N 1.5 mM Leaf Blade Area 10 day (measured in cm$^2$); N 1.5 mM RGR of Rosette Area 3 day; N 1.5 mM t50 Flowering (measured in days);
"cm" = centimeters".

TABLE 4

Additional measured parameters in *Arabidopsis* ecotypes

| Arabidopsis 2 NUE | N 1.5 mM Dry Weight | N 1.5 mM Seed Yield | N 1.5 mM Harvest Index | N 1.5 mM 1000 Seeds weight | N 1.5 mM seed yield per rosette area day 10 | N 1.5 mM seed yield per leaf blade |
|---|---|---|---|---|---|---|
| Bay-0 | 0.164 | 0.032 | 0.192 | 0.016 | 0.022 | 0.095 |
| Col-0 | 0.124 | 0.025 | 0.203 | 0.016 | 0.019 | 0.095 |
| Ct-1 | 0.082 | 0.023 | 0.295 | 0.018 | 0.014 | 0.063 |
| Gr-6 | 0.113 | 0.010 | 0.085 | 0.014 | 0.005 | 0.026 |
| kondara | 0.184 | 0.006 | 0.031 | 0.018 | 0.003 | 0.015 |
| Mc-0 | 0.124 | 0.009 | 0.071 | 0.022 | 0.005 | 0.024 |
| Mt-0 | 0.134 | 0.032 | 0.241 | 0.015 | 0.018 | 0.084 |
| No-0 | 0.106 | 0.019 | 0.179 | 0.014 | 0.013 | 0.059 |
| Oy-o | 0.148 | 0.012 | 0.081 | 0.022 | 0.007 | 0.034 |
| Shakadara | 0.171 | 0.014 | 0.079 | 0.019 | 0.012 | 0.044 |

Table 4. Provided are the values of each of the parameters measured in *Arabidopsis* ecotypes:
N 1.5 mM Dry Weight (measured in grams); N 1.5 mM Seed Yield (measured in gr/plant); N 1.5 mM Harvest Index; N 1.5 mM 1000 Seeds weight (measured in grams); N 1.5 mM seed yield per rosette area day 10 (measured in gr/plant*cm$^2$); N 1.5 mM seed yield per leaf blade (measured in gr/plant*cm$^2$);

TABLE 5

Additional measured parameters in *Arabidopsis* ecotypes

| Arabidopsis 2 NUE | N 6 mM Rosette Area 8 day | N 6 mM Rosette Area 10 day | N 6 mM Leaf Number 10 day | N 6 mM Leaf Blade Area 10 day |
|---|---|---|---|---|
| Bay-0 | 0.759 | 1.406 | 6.250 | 0.342 |
| Col-0 | 0.857 | 1.570 | 7.313 | 0.315 |
| Ct-1 | 1.477 | 2.673 | 8.063 | 0.523 |
| Gr-6 | 1.278 | 2.418 | 8.750 | 0.449 |
| kondara | 1.224 | 2.207 | 8.063 | 0.430 |
| Mc-0 | 1.095 | 2.142 | 8.750 | 0.430 |
| Mt-0 | 1.236 | 2.474 | 8.375 | 0.497 |
| No-0 | 1.094 | 1.965 | 7.125 | 0.428 |
| Oy-o | 1.410 | 2.721 | 9.438 | 0.509 |
| Shakadara | 0.891 | 1.642 | 6.313 | 0.405 |

Table 5. Provided are the values of each of the parameters measured in *Arabidopsis* ecotypes: N 6 mM Rosette Area 8 day; N 6 mM Rosette Area 10 day; N 6 mM Leaf Number 10 day; N 6 mM Leaf Blade Area 10 day.

TABLE 6

Additional measured parameters in *Arabidopsis* ecotypes

| Arabidopsis 2 NUE | N 6 mM RGR of Rosette Area 3 day | N 6 mM t50 Flowering | N 6 mM Dry Weight | N 6 mM Seed Yield | N 6 mM Harvest Index | N 6 mM 1000 Seeds weight |
|---|---|---|---|---|---|---|
| Bay-0 | 0.689137 | 16.3714 | 0.41875 | 0.11575 | 0.279999 | 0.014743 |
| Col-0 | 1.023853 | 20.5 | 0.53125 | 0.165163 | 0.308528 | 0.016869 |
| Ct-1 | 0.614345 | 14.63465 | 0.381875 | 0.108469 | 0.283603 | 0.01777 |
| Gr-6 | 0.600985 | 24 | 0.5175 | 0.08195 | 0.158357 | 0.012078 |
| kondara | 0.476947 | 23.378 | 0.49625 | 0.067544 | 0.136182 | 0.01601 |
| Mc-0 | 0.650762 | 23.59507 | 0.579375 | 0.119181 | 0.205875 | 0.015535 |
| Mt-0 | 0.675597 | 15.0327 | 0.50125 | 0.138769 | 0.276265 | 0.015434 |
| No-0 | 0.584219 | 19.74969 | 0.6275 | 0.106956 | 0.170622 | 0.014038 |
| Oy-o | 0.612997 | 22.88714 | 0.649375 | 0.138088 | 0.21248 | 0.016601 |
| Shakadara | 0.515469 | 18.80415 | 0.573125 | 0.094813 | 0.165557 | 0.016081 |

Table 6. Provided are the values of each of the parameters measured in *Arabidopsis* ecotypes: N 6 mM RGR of Rosette Area 3 day; N 6 mM t50 Flowering (measured in days); N 6 mM Dry Weight (measured in gr/plant); N 6 mM Seed Yield (measured in gr/plant); N 6 mM Harvest Index; N 6 mM 1000 Seeds weight (measured in gr); "gr." = grams; "mg" = miligrams; "cm" = centimeters".

TABLE 7

Additional measured parameters in *Arabidopsis* ecotypes

| Arabidopsis 2 NUE | N 6 mM seed yield/rosette area day 10 day | N 6 mM seed yield/leaf blade |
|---|---|---|
| Bay-0 | 0.082439 | 0.339198 |
| Col-0 | 0.105792 | 0.52646 |
| Ct-1 | 0.040511 | 0.207182 |
| Gr-6 | 0.033897 | 0.182671 |
| kondara | 0.030718 | 0.157924 |
| Mc-0 | 0.055634 | 0.277238 |
| Mt-0 | 0.057027 | 0.281182 |
| No-0 | 0.055374 | 0.252332 |
| Oy-o | 0.050715 | 0.271258 |
| Shakadara | 0.058181 | 0.235472 |

Table 7. Provided are the values of each of the parameters measured in *Arabidopsis* ecotypes: N 6 mM seed yield/rosette area day 10 day (measured in gr/plant * cm$^2$); N 6 mM seed yield/leaf blade (measured in gr/plant * cm$^2$);

TABLE 8

Additional measured parameters in *Arabidopsis* ecotypes

| Arabidopsis 2 | N 6 mM Spad/FW | N 6 mM DW/SPAD (biomas/Nunit) | N 6 mM spad/DW (gN/g plant) | N 6 mM Seed yield/N unit | N 1.5 mM Spad/FW | N 1.5 mM SPAD/DW | N 1.5 mM DW/SPAD | N 1.5 mM seed yield/spad |
|---|---|---|---|---|---|---|---|---|
| Bay-0 | 22.49 | 0.01862 | 53.7055 | 0.004209 | 45.59 | 167.3004 | 0.005977 | 0.001155 |
| Gr-6 | 28.27 | 0.018307 | 54.6248 | 0.002953 | 42.11 | 241.0608 | 0.004148 | 0.000361 |
| kondara | 17.64 | 0.028131 | 35.54803 | 0.002333 | 28.15 | 157.8231 | 0.006336 | 0.000191 |
| Mt-0 | 33.32 | 0.015042 | 66.47908 | 0.005299 | 53.11 | 194.9767 | 0.005129 | 0.001234 |
| Shakadara | 39 | 0.014694 | 68.05368 | 0.003255 | 67 | 169.3431 | 0.005905 | 0.000466 |

Table 8. Provided are the values of each of the parameters measured in *Arabidopsis* ecotypes: N 6 mM Spad/FW; N 6 mM DW/SPAD (biomas/Nunit); N 6 mM spad/DW (gN/g plant); N 6 mM Seed yield/N unit (measured in gr/N units); N 1.5 mM Spad/FW (measured in 1/gr); N 1.5 mM SPAD/DW (measured in 1/gr); N 1.5 mM DW/SPAD (measured in 1/gr); N 1.5 mM seed yield/spad (measured in gr);

Experimental Results 10 different *Arabidopsis* accessions (ecotypes) were grown and characterized for 33 parameters as described above (Tables 3-8). The average for each of the measured parameters was calculated using the JMP software. Subsequent correlation analysis was performed between the characterized parameters in the *Arabidopsis* ecotypes (which are used as x axis for correlation) and the tissue transcriptom, and genes exhibiting a significant correlation to selected traits (classified using the correlation vector) are presented in Table 26 below along with their correlation values (R, calculated using Pearson correlation) and the p-values under the category of the vector sets *Arabidopsis* 2 NUE vector and *Arabidopsis* 2.

Example 4

Production of Tomato Transcriptom and High Throughput Correlation Analysis Using 44K Tomato Oligonucleotide Micro-Array In order to produce a high throughput correlation analysis, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?lPage=50879]. The array oligonucleotide represents about 44,000 Toamto genes and transcripts. In order to define correlations between the levels of RNA expression with ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test.

I. Correlation of Tomato Varieties Across Ecotype Grown Under 50% Irrigation Conditions Experimental Procedures Growth procedure—Tomato variety was grown under normal conditions (4-6 Liters/m² per day) until flower stage. At this time, irrigation was reduced to 50% compared to normal conditions.

RNA extraction—Two tissues at different developmental stages [flower and leaf], representing different plant characteristics, were sampled and RNA was extracted as described above. The Expression sets (e.g., flower and leaf) are included in Table 26 below.

Tomato yield components and vigor related parameters under 50% water irrigation assessment—10 Tomato varieties in 3 repetitive blocks (named A, B, and C), each containing 6 plants per plot were grown at net house. Plants were phenotyped on a daily basis following the standard descriptor of tomato (Table 11, below). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute).

Data parameters collected are summarized in Table 9, hereinbelow.

TABLE 9

Tomato correlated parameters (vectors)

| Correlated parameter with | Correlation Id |
|---|---|
| 50% Irrigation; Vegetative fresh weight [gr.] | 1 |
| 50% Irrigation; Fruit per plant [gr.] | 2 |
| 50% Irrigation; Inflorescence weight [gr.] | 3 |
| 50% Irrigation; number of flowers | 4 |
| 50% Irrigation; relative Water use efficiency | 5 |
| 50% Irrigation; Ripe fruit average weight [gr.] | 7 |
| 50% Irrigation: SPAD | 8 |
| Normal Irrigation; vegetative fresh weight [gr.] | 9 |
| Normal Irrigation; Fruit per plant [gr.] | 10 |
| Normal Irrigation; Inflorescence weight [gr.] | 11 |
| Normal Irrigation; number of flowers | 12 |
| Normal Irrigation; relative Water use efficiency | 13 |
| Normal Irrigation; number of fruit per plant | 14 |
| Normal Irrigation; Ripe fruit average weight [gr.] | 15 |
| Normal Irrigation; SPAD | 16 |
| 50% Irrigation; Vegetative fresh weight [gr.]/Normal Irrigation; vegetative fresh weight [gr.] | 17 |
| 50% Irrigation; Fruit per plant [gr.]/Normal Irrigation; Fruit per plant [gr.] | 18 |
| 50% Irrigation; Inflorescence weight [gr.]/Normal Irrigation; Inflorescence weight [gr.] | 19 |
| 50% Irrigation; number of flowers/Normal Irrigation; number of flowers | 20 |
| 50% Irrigation; relative Water use efficiency/Normal Irrigation; Water use efficiency | 21 |
| 50% Irrigation; Ripe fruit average weight [gr.]/Normal Irrigation; Ripe fruit average weight [gr.] | 22 |
| 50% Irrigation: SPAD/Normal Irrigation; SPAD | 23 |

Table 9. Provided are the tomato correlated parameters. "gr." = grams; "SPAD" =chlorophyll levels;

Fruit Weight (grams)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Plant vegetative Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying to the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content Experimental Results 10 different Tomato varieties (accessions) were grown and characterized for 23 parameters as described above. The average for each of the measured parameter was calculated using the JMP software and values are summarized in Tables 10, 11 and 12 below. Subsequent correlation analysis between expression of selected genes in various transcriptom expression sets and the measured parameters in tomato accessions (Tables 10-12) was conducted, and results were integrated to the database and provided in Table 26 below under the category of the vector sets Tomato vectors field Normal, Tomato vectors field Drought.

TABLE 10

Measured parameters in Tomato accessions

| Variety | 2 | 10 | 1 | 9 | 7 | 15 | 18 | 17 |
|---|---|---|---|---|---|---|---|---|
| 612 | 0.47 | 0.83 | 2.62 | 1.53 | 0.01 | 0.05 | 0.57 | 1.72 |
| 613 | 0.48 | 0.34 | 1.09 | 3.17 | 0.19 | 0.01 | 1.41 | 0.34 |
| 617 | 2.04 | 0.49 | 2.63 | 2.24 | 0.10 | 0.01 | 4.20 | 1.18 |
| 618 | 0.25 | 0.45 | 2.71 | 1.98 | 0.00 | 0.05 | 0.55 | 1.36 |
| 622 | 0.29 | 0.21 | 1.95 | 3.21 | 0.01 | 0.01 | 1.39 | 0.61 |
| 623 | 1.02 | 0.31 | 1.76 | 2.75 | 0.00 | 0.01 | 3.28 | 0.64 |
| 626 | 0.27 | 0.85 | 2.21 | 1.89 | 0.00 | 0.03 | 0.32 | 1.17 |
| 629 | 0.53 | 0.33 | 1.76 | 1.65 | 0.14 | 0.00 | 1.62 | 1.06 |
| 630 | 0.55 | 0.31 | 0.63 | 3.01 | 0.04 | 0.00 | 1.76 | 0.21 |
| 631 | 0.41 | 0.29 | 1.11 | 2.29 | 0.09 | 0.01 | 1.42 | 0.48 |

Table 10: Provided are the measured yield components and vigor related parameters under normal or 50% water irrigation for the tomato accessions (Varieties) according to the Correlation ID numbers (described in Table 9 above) as follows: 2 [50% Irrigation; Fruit per plant (gr.)]; 10 [Normal Irrigation; Fruit per plant (gr.)]; 1 [50% Irrigation; Vegetative fresh weight (gr.)]; 9 [Normal Irrigation; vegetative fresh weight (gr.)]; 7 [50% Irrigation; ripe Fruit average weight (gr.)]; 15 [Normal Irrigation; Ripe fruit average weight (gr.)]; 18 [50% Irrigation; Fruit per plant (gr.)/Normal Irrigation; Fruit per plant (gr.)]; 17 [50% Irrigation; Vegetative fresh weight (gr.)/Normal Irrigation; vegetative fresh weight (gr.)].

TABLE 11

Additional measured parameters in Tomato accessions

| Variety | 22 | 8 | 16 | 5 | 13 | 23 |
|---|---|---|---|---|---|---|
| 612 | 0.19 | 49.30 | 49.70 | 72.12 | 72.83 | 0.99 |
| 613 | 24.37 | 67.10 | 37.20 | 74.51 | 76.47 | 1.80 |
| 617 | 20.26 | 56.00 | 48.20 | 66.13 | 54.79 | 1.16 |
| 618 | 0.04 | 38.90 | 43.40 | 68.33 | 77.61 | 0.90 |
| 622 | 0.86 | 50.20 | 58.50 | 73.21 | 64.71 | 0.86 |
| 623 | 0.74 | 60.50 | 51.10 | 62.50 | 75.25 | 1.18 |
| 626 | 0.17 | 54.70 | 57.90 | 62.82 | 56.77 | 0.94 |
| 629 | 27.89 | 47.70 | 54.50 | 75.22 | 100.00 | 0.88 |
| 630 | 11.79 | 58.10 | 41.60 | 63.68 | 63.16 | 1.40 |
| 631 | 9.98 | 59.40 | 59.10 | 62.31 | 75.13 | 1.01 |

Table 11: Provided are the measured yield components and vigor related parameters under 50% water irrigation for the tomato accessions (Varieties) according to the Correlation (Corr.) ID numbers (described in Table 9 above) as follows: 22 [50% Irrigation; Ripe fruit average weight (gr.)/Normal Irrigation; Ripe fruit average weight (gr.)]; 8 [50% Irrigation: SPAD]; 16 [Normal Irrigation; SPAD]; 5 [50% Irrigation; relative Water use efficiency]; 13 [Normal Irrigation; relative Water use efficiency]; 23 [50% Irrigation: SPAD/Normal Irrigation; SPAD].

TABLE 12

Additional measured parameters in Tomato accessions

| Variety | 21 | 4 | 12 | 3 | 11 | 20 | 19 |
|---|---|---|---|---|---|---|---|
| 612 | 0.99 | 16.67 | 5.67 | 0.37 | 1.17 | 2.94 | 0.32 |
| 613 | 0.97 | 6.50 | 19.33 | 0.41 | 0.34 | 0.34 | 1.19 |
| 617 | 1.21 | 11.67 | 9.67 | 0.55 | 0.44 | 1.21 | 1.25 |
| 618 | 0.88 | 25.33 | 8.33 | 0.31 | 11.31 | 3.04 | 0.03 |
| 622 | 1.13 | 14.67 | 10.00 | 0.30 | 0.73 | 1.47 | 0.42 |
| 623 | 0.83 | 29.67 | 7.00 | 0.31 | 0.83 | 4.24 | 0.38 |
| 626 | 1.11 | 18.33 | 5.33 | 8.36 | 1.02 | 3.44 | 8.20 |
| 629 | 0.75 | 12.67 | 9.00 | 0.44 | 0.66 | 1.41 | 0.67 |
| 630 | 1.01 | 12.67 | 10.67 | 0.27 | 0.70 | 1.19 | 0.38 |
| 631 | 0.83 | 11.33 | 9.00 | 0.43 | 0.33 | 1.26 | 1.31 |

Table 12: Provided are the measured yield components and vigor related parameters under 50% water irrigation for the tomato accessions (Varieties) according to the Correlation (Corr.) ID numbers (described in Table 9 above) as follows: 21 [50% Irrigation; relative Water use efficiency/Normal Irrigation; Water use efficiency]; 4 [50% Irrigation; number of flowers]; 12 [Normal Irrigation; number of flowers]; 3 [50% Irrigation; Inflorescence weight (gr.)]; 11 [Normal Irrigation; Inflorescence weight (gr.)]; 20 [50% Irrigation; number of flowers/Normal Irrigation; number of flowers]; 19 [50% Irrigation; Inflorescence weight (gr.)/Normal Irrigation; Inflorescence weight (gr.)].

II. Correlation of Tomato Varieties Under Stress Built Under 50% Irrigation Conditions Experimental Procedures Growth procedure—Tomato varieties were grown under normal conditions (4-6 to Liters/m² per day) until flower stage. At this time, irrigation was reduced to 50% compared to normal conditions. Tissue sample were taken during the stress developed period every two days.

RNA extraction—All 10 selected Tomato varieties were sampled per each treatment. Two tissues [leaves and flowers] growing at 50% irrigation or under normal conditions were sampled and RNA was extracted using TRIzol Reagent from Invitrogen [Hypertext Transfer Protocol://World Wide Web (dot) invitrogen (dot) com/content (dot)cfm-?pageid=469]. The Expression sets (e.g., flower and leaf) are included in Table 26 below. Extraction of RNA from tissues was performed as described in Example 2 above.

Correlation of early vigor traits across collection of tomato ecotypes under high salinity concentration—Ten tomato varieties were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to either high salinity growth conditions (100 mM NaCl solution) or to normal growth conditions [full Hogland; $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Tomato vigor related parameters under 100 mM NaCl—Following 5 weeks of growing, plant were harvested and analyzed for leaf number, plant height, and plant weight (data parameters are summarized in Table 13). Next, analyzed data was saved to text files and processed using the JMP statistical analysis software (SAS institute).

TABLE 13

Tomato correlated parameters (vectors)

| Correlated parameter with | Correlation Id |
|---|---|
| 100 mM NaCl: leaf Number | 1 |
| 100 mM NaCl: Plant height | 2 |
| 100 mM NaCl: Plant biomass | 3 |
| Normal: leaf Number | 4 |
| Normal: Plant height | 5 |
| 100 mM NaCl: leaf Number/Normal: leaf Number | 6 |
| 100 mM NaCl: Plant height/Normal: Plant height | 7 |

Table 13. Provided are the tomato correlated parameters (ID numbers 1-7).

Experimental Results 10 different Tomato varieties were grown and characterized for 7 parameters as to described above (Table 13). The average for each of the measured parameters was calculated using the JMP software and values are summarized in Tables 14 below. Subsequent correlation analysis between expression of selected genes in various transcriptom expression sets and the average measured parameters was conducted and the results were integrated to the database and provided in Table 26 hereinbelow under the vector sets: Tomato vectors bath Normal, and Tomato vectors bath Salinity.

TABLE 14

Measured parameters in tomato accessions

| | Corr. ID | | | | | | |
|---|---|---|---|---|---|---|---|
| Variety | 1 | 4 | 2 | 5 | 3 | 6 | 7 |
| 1139 | 3.56 | 6.56 | 5.60 | 45.33 | 0.36 | 0.54 | 0.12 |
| 2078 | 3.94 | 6.89 | 6.46 | 47.78 | 0.44 | 0.57 | 0.14 |
| 2958 | 5.00 | 7.33 | 8.47 | 40.78 | 0.26 | 0.68 | 0.21 |
| 5077 | 4.00 | 6.22 | 8.56 | 55.33 | 0.71 | 0.64 | 0.15 |
| 5080 | 3.56 | 6.33 | 8.87 | 56.22 | 0.46 | 0.56 | 0.16 |
| 5084 | 4.39 | 6.44 | 7.56 | 48.67 | 0.54 | 0.68 | 0.16 |
| 5085 | 3.17 | 5.89 | 8.64 | 55.78 | 0.66 | 0.54 | 0.15 |
| 5088 | 3.72 | 5.56 | 5.57 | 37.44 | 0.40 | 0.67 | 0.15 |
| 5089 | 4.00 | 6.11 | 5.82 | 49.56 | 0.52 | 0.65 | 0.12 |
| 5092 | 4.28 | 5.67 | 9.36 | 46.33 | 0.45 | 0.75 | 0.20 |

Table 14. Provided are the measured vigor related parameters under 100 mM NaCl or normal conditions for the tomato accessions (Varieties) according to the Correlation (Corr.) ID numbers (described in Table 13 above) as follows: 1 [100 mM NaCl: leaf Number]; 4 [Normal: leaf Number]; 2 [100 mM NaCl: Plant height]; 5 [Normal: Plant height]; 3 [100 mM NaCl: Plant biomass]; 6 [100 mM NaCl: leaf Number/Normal: leaf Number]; 7 [100 mM NaCl: Plant height/Normal: Plant height].

Example 5

Production of *B. juncea* Transcriptom and High Throughput Correlation Analysis with Yield Parameterrs Using 44K *B. juncea* Oligonucleotide Micro-Arrays In order to produce a high throughput correlation analysis, the present inventors utilized a *B. juncea* oligonucleotide micro-array, produced by Agilent Technologies [Hypertext Transfer Protocol://World Wide Web (dot) chem. (dot) agilent (dot) com/Scripts/PDS (dot) asp?lPage=50879]. The array oligonucleotide represents about 60,000 *B. juncea* genes and transcripts. In order to define correlations between the levels of RNA expression with yield components or vigor related parameters, various plant characteristics of 11 different *B. juncea* varieties were analyzed and used for RNA expression analysis. The correlation between the RNA levels and the characterized parameters was analyzed using Pearson correlation test.

Correlation of *B. juncea* Genes' Expression Levels with Phenotypic Characteristics Across Ecotype Experimental Procedures 11 *B. juncea* varieties were grown in three repetitive plots, in field. Briefly, the growing protocol was as follows: *B. juncea* seeds were sown in soil and grown under normal condition till harvest. In order to define correlations between the levels of RNA expression with yield components or vigor related parameters, the 11 different *B. juncea* varieties were analyzed and used for gene expression analyses.

RNA extraction—All 11 selected *B. juncea* varieties were sample per each treatment. Plant tissues [leaf, Pod, Lateral meristem and flower] growing under normal conditions were sampled and RNA was extracted as described above. The Expression sets (e.g., leaf, Pod, Lateral meristem and flower) are included in Table 26 below.

The collected data parameters were as follows:

Fresh weight (plot-harvest) [gr/plant]—total fresh weight per plot at harvest time normalized to the number of plants per plot.

Seed Weight [milligrams/plant]—total seeds from each plot was extracted, weighted and normalized for plant number in each plot.

Harvest index—The harvest index was calculated: seed weight/fresh weight

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the $20^{th}$ node from the apex of main branch.

Lateral branch—20th length—the length of the pod on the $20^{th}$ node from the apex of lateral branch.

Main branch—20th seed No.—number of seeds in the pod on the $20^{th}$ node from the apex of main branch.

Lateral branch—20th seed number—number of seeds in the pod on the $20^{th}$ node from the apex of lateral branch.

Number of lateral branches—total number of lateral branches, average of three plants per plot.

Main branch height [cm]—total length of main branch.

Min-lateral branch position—lowest node on the main branch that has developed lateral branch.

Max-lateral branch position [#node of main branch]—highest node on the main branch that has developed lateral branch.

Max-number of nodes in lateral branch—the highest number of node that a lateral branch had per plant.

Max length of lateral branch [cm]—the highest length of lateral branch per plant.

Max diameter of lateral branch [mm]—the highest base diameter that a lateral branch had per plant.

Oil Content—Indirect oil content analysis was carried out using Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)];

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Experimental Results

Eleven different *B. juncea* varieties (i.e., seed ID 646, 648, 650, 657, 661, 662, 663, 664, 669, 670, 671) were grown and characterized for 23 parameters as specified above. The average for each of the measured parameters was calculated using the JMP software and values are summarized in Table 15 below. Subsequent correlation analysis between the various transcriptom expression sets and the average parameters, was conducted. Results were then integrated to the database and selected correlations are shown in Table 26, below, under the vector set *Juncea* ecotypes vector.

TABLE 15

Measured parameters in *B. juncea* accessions

| Parameter | Seed ID | | | | | | | | | | |
|---|---|---|---|---|---|---|---|---|---|---|---|
| | 646 | 648 | 650 | 657 | 661 | 662 | 663 | 664 | 669 | 670 | 671 |
| Fresh weight (plot-harvest) [gr/plant] | 69.2 | 45.2 | 39.3 | 49.1 | 44.0 | 46.4 | 36.1 | 32.6 | 33.2 | 63.2 | 60.9 |
| Seed Weight per plant | 4.38 | 5.72 | 5.53 | 6.87 | 5.81 | 6.28 | 4.58 | 4.37 | 4.48 | 5.66 | 7.06 |
| harvest index*$10^3$ | 0.06 | 0.13 | 0.14 | 0.14 | 0.13 | 0.14 | 0.13 | 0.13 | 0.14 | 0.09 | 0.12 |
| days till bolting | 57.3 | 60.3 | 59.7 | 56.3 | 55.0 | 46.7 | 59.0 | 54.3 | 59.7 | 57.3 | 53.0 |
| days till flowering | 66.0 | 69.7 | 69.3 | 66.0 | 61.3 | 53.0 | 69.7 | 63.7 | 69.7 | 71.0 | 58.3 |
| SPAD | 33.0 | 30.0 | 32.8 | 37.5 | 41.4 | 35.4 | 33.2 | 32.9 | 34.8 | 31.8 | 41.5 |
| Main branch - average node length | 0.5 | 0.4 | 0.6 | 0.4 | 0.4 | 0.7 | 0.4 | 0.6 | 0.6 | 0.6 | 1.6 |

TABLE 15-continued

Measured parameters in B. juncea accessions

| Parameter | Seed ID | | | | | | | | | | |
|---|---|---|---|---|---|---|---|---|---|---|---|
| | 646 | 648 | 650 | 657 | 661 | 662 | 663 | 664 | 669 | 670 | 671 |
| Lateral branch - average node length | 0.7 | 0.4 | 0.7 | 0.6 | 0.6 | 0.8 | 0.6 | 0.8 | 1.0 | 0.8 | 0.9 |
| Main branch - 20th length | 4.3 | 3.7 | 3.6 | 3.5 | 2.7 | 5.2 | 3.9 | 4.0 | 3.5 | 3.7 | 4.0 |
| Lateral branch - 20th length | 4.3 | 3.7 | 4.1 | 3.4 | 3.1 | 4.0 | 4.3 | 4.2 | 4.1 | 4.0 | 3.9 |
| Main branch - 20th seed No. | 13.2 | 13.7 | 10.4 | 14.1 | 9.8 | 15.2 | 12.0 | 12.7 | 9.9 | 11.6 | 15.6 |
| Lateral branch - 20th seed number | 13.0 | 14.0 | 13.2 | 13.4 | 11.0 | 13.1 | 11.9 | 13.4 | 11.2 | 13.2 | 14.0 |
| Number of lateral branches | 15.2 | 14.9 | 13.6 | 14.9 | 14.0 | 9.8 | 16.4 | 14.3 | 14.6 | 14.1 | 16.8 |
| Main branch height [cm] | 140.7 | 125.2 | 112.4 | 133.4 | 142.0 | 101.5 | 145.4 | 131.6 | 129.9 | 131.6 | 116.4 |
| Min-Lateral branch position | 6.8 | 6.3 | 5.6 | 3.7 | 3.0 | 3.1 | 7.8 | 6.2 | 5.6 | 4.9 | 5.3 |
| Max-Lateral branch position [#node of main branch] | 15.2 | 14.9 | 13.6 | 14.9 | 14.0 | 10.9 | 16.4 | 14.3 | 14.6 | 14.1 | 16.8 |
| Max-Number of nodes in lateral branch | 5.2 | 7.0 | 5.2 | 7.0 | 6.6 | 9.4 | 6.1 | 5.2 | 5.7 | 6.6 | 6.0 |
| Max Length of lateral branch [cm] | 40.4 | 47.2 | 41.6 | 60.5 | 59.8 | 59.4 | 47.3 | 47.3 | 44.7 | 58.7 | 47.2 |
| Max Diameter of lateral branch [mm] | 4.2 | 4.9 | 4.3 | 5.7 | 5.9 | 5.7 | 4.5 | 4.9 | 4.7 | 5.6 | 5.5 |
| Oil Content | 40.2 | 40.7 | 40.9 | 38.6 | 40.1 | 42.6 | 41.3 | 40.8 | 40.8 | 38.1 | 37.2 |
| Fresh Weight (single plant) (gr/plant) | 197.8 | 142.2 | 147.2 | 243.3 | 192.3 | 163.8 | 164.4 | 181.1 | 176.2 | 217.9 | 261.1 |
| Main branch base diameter [mm] | 14.5 | 12.0 | 19.9 | 14.3 | 12.6 | 12.3 | 12.6 | 12.9 | 12.6 | 13.8 | 13.6 |
| 1000 Seeds [gr] | 3.8 | 2.2 | 3.3 | 2.4 | 2.0 | 3.1 | 3.3 | 3.1 | 3.4 | 3.4 | 2.4 |

Table 15: Provided are the values of each of the parameters (as described above) measured in B. juncea accessions (Seed ID) under normal conditions.

Example 6

Production of B. juncea Transcriptom and High Throughput Correlation Analysis with Yield Parameters of juncea Grown Under Various Population Densities Using 44K B. juncea Oligonucleotide Micro-Arrays In order to produce a high throughput correlation analysis, the present inventors utilized a B. juncea oligonucleotide micro-array, produced by Agilent Technologies [Hypertext Transfer Protocol://World Wide Web (dot) chem. (dot) agilent (dot) com/Scripts/PDS (dot) asp?lPage=50879]. The array oligonucleotide represents about 60,000 B. juncea genes and transcripts. In order to define correlations between the levels of RNA expression with yield components or vigor related parameters, various plant characteristics of two different B. juncea varieties grown under seven different population densities were analyzed and used for RNA expression analysis. The correlation between the RNA levels and the characterized parameters was analyzed using Pearson correlation test.

Correlation of B. juncea Genes' Expression Levels with Phenotypic Characteristics Across Seven Population Densities for Two Ecotypes Experimental Procedures Two B. juncea varieties (646 and 671) were grown in a field under seven population densities (10, 60, 120, 160, 200, 250 and 300 plants per m$^2$) in two repetitive plots. Briefly, the growing protocol was as follows: B. juncea seeds were sown in soil and grown under normal condition till harvest. In order to define correlations between the levels of RNA expression with yield components or vigor related parameters, the two different B. juncea varieties grown under various population densities were analyzed and used for gene expression analyses. The correlation between the RNA levels and the characterized parameters was analyzed using Pearson correlation test for each ecotype independently.

RNA extraction—the two B. juncea varieties grown under seven population densities were sample per each treatment. Plant tissues [Flower and Lateral meristem] growing under Normal conditions were sampled and RNA was extracted as described above. For convenience, each micro-array expression information tissue type has received a Set ID. The Expression sets (e.g., Flower and Lateral meristem) are included in Table 26 below.

The collected data parameters were as follows:

Fresh weight (plot-harvest) [gr/plant]—total fresh weight per plot at harvest time normalized to the number of plants per plot.

Seed weight [gr/plant]—total seeds from each plot was extracted, weighted and normalized for plant number in each plot.

Harvest index—The harvest index was calculated: seed weight/fresh weight

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the $20^{th}$ node from the apex of main branch.

Lateral branch—20th length—the length of the pod on the $20^{th}$ node from the apex of lateral branch.

Main branch—20th seed No.—number of seeds in the pod on the $20^{th}$ node from the apex of main branch.

Lateral branch—20th seed number—number of seeds in the pod on the $20^{th}$ node from the apex of lateral branch.

Number of lateral branches—total number of lateral branches, average of three plants per plot.

Main branch height [cm]—total length of main branch.

Min-Lateral branch position—lowest node on the main branch that has developed lateral branch.

Max-Lateral branch position [#node of main branch]—highest node on the main branch that has developed lateral branch.

Max-number of nodes in lateral branch—the highest number of node that a lateral branch had per plant.

Max-length of lateral branch [cm]—the highest length of lateral branch per plant.

Max diameter of lateral branch [mm]—the highest base diameter that a lateral branch had per plant.

Oil content—Indirect oil content analysis was carried out using Nuclear to Magnetic Resonance (NMR) Spectroscopy, which measures the resonance energy absorbed by hydrogen atoms in the liquid state of the sample [See for example, Conway TF. and Earle FR., 1963, Journal of the American Oil Chemists' Society; Springer Berlin/Heidelberg, ISSN: 0003-021X (Print) 1558-9331 (Online)];

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Main branch—total number of pods—total number of pods on the main branch, average of three plants per plot.

Main branch—dist. 1-20—the length between the youngest pod and pod number 20 on the main branch, average of three plants per plot.

Lateral branch—total number of pods—total number of pods on the lowest lateral branch, average of three plants per plot.

Lateral branch—dis. 1-20—the length between the youngest pod and pod number 20 on the lowest lateral branch, average of three plants per plot.

Dry weight/plant—weight of total plants per plot at harvest after three days at oven at 60° C. normalized for the number of plants per plot.

Total leaf area—Total leaf area per plot was calculated based on random three plants and normalized for number of plants per plot.

Total Perim.—total perimeter of leaves, was calculated based on random three plants and normalized for number of plants per plot.

Experimental Results

Two *B. juncea* varieties were grown under seven different population densities and characterized for 29 parameters as specified above. The average for each of the measured parameter was calculated using the JMP software and values are summarized in Table 16 below. Subsequent correlation analysis between the expression of selected genes in various transcriptom expression sets and the average parameters was conducted. Results were then integrated to the database and are provided in Table 26, below, under the vector sets *Juncea* population densities.

TABLE 16

Measured parameters in *B. juncea* accessions at various population densities

| | Popul. Density (plants per m$^2$) | | | | | | |
|---|---|---|---|---|---|---|---|
| | 10 | 60 | 120 | 160 | 200 | 250 | 300 |
| Main branch base diameter [mm] | 7.37 | 6.90 | 5.62 | 4.99 | 6.45 | 3.95 | 8.77 |
| fresh Weight (single plant) [gr/plant] | 0.07 | 0.04 | 0.03 | 0.02 | 0.04 | 0.02 | 0.07 |
| Main branch height [cm] | 116.0 | 115.5 | 111.3 | 106.0 | 117.5 | 108.0 | 157.3 |
| Number of lateral branches | 16.17 | 19.17 | 15.83 | 19.33 | 18.33 | 17.83 | 12.83 |
| Min-Lateral branch position | 5.00 | 11.00 | 7.00 | 11.00 | 9.00 | 9.00 | 3.00 |
| Max-Lateral branch position | 20.00 | 23.00 | 19.00 | 24.00 | 22.00 | 20.00 | 16.00 |
| Max-Number of nodes in lateral branch | 6.00 | 4.00 | 4.00 | 4.00 | 6.00 | 4.00 | 11.00 |
| Max-Length of lateral branch [cm] | 78.00 | 41.00 | 43.00 | 36.00 | 40.00 | 42.00 | 109.0 |
| Max-Diameter of lateral branch [mm] | 4.40 | 2.90 | 2.50 | 2.00 | 3.40 | 2.50 | 8.00 |

TABLE 16-continued

Measured parameters in *B. juncea* accessions at various population densities

| | Popul. Density (plants per m$^2$) | | | | | | |
|---|---|---|---|---|---|---|---|
| | 10 | 60 | 120 | 160 | 200 | 250 | 300 |
| Main branch-total number of pods | 15.17 | 15.33 | 17.67 | 16.50 | 23.17 | 16.83 | 33.83 |
| Main branch-dist. 1-20 | 37.58 | 27.90 | 31.22 | 26.05 | 27.72 | 31.85 | 45.25 |
| Main branch-20th length | 5.10 | 4.63 | 4.60 | 4.67 | 4.73 | 4.68 | 4.43 |
| Main branch-20th seed No. | 17.67 | 17.67 | 18.00 | 18.50 | 17.67 | 17.50 | 13.17 |
| Lateral branch-total number of pods | 14.00 | 11.67 | 10.67 | 10.17 | 12.50 | 9.83 | 18.50 |
| Lateral branch-dis. 1-20 | 28.25 | 17.53 | 19.08 | 15.65 | 15.23 | 17.73 | 21.58 |
| Lateral branch-20th length | 4.95 | 4.48 | 4.37 | 4.33 | 4.35 | 4.40 | 4.72 |
| Lateral branch-20th seed number | 14.55 | 19.33 | 17.00 | 18.83 | 15.67 | 17.17 | 11.17 |
| Oil Content | 26.78 | 29.62 | 29.57 | 30.59 | 29.87 | 25.22 | 37.55 |
| SPAD | 40.89 | 41.95 | 40.48 | 37.93 | 39.50 | 45.57 | 39.21 |
| days till bolting | 53.00 | 50.50 | 48.00 | 53.00 | 50.00 | 51.50 | 51.50 |
| days till flowering | 62.50 | 64.00 | 64.00 | 64.00 | 64.00 | 62.50 | 61.00 |
| fresh weight (at harvest)/plant | 0.05 | 0.02 | 0.01 | 0.01 | 0.01 | 0.01 | 0.04 |
| dry weight/plant | 0.01 | 0.01 | 0.00 | 0.00 | 0.00 | 0.00 | 0.01 |
| Seed Weight/plant | 0.00 | 0.00 | 0.00 | 0.00 | 0.00 | 0.00 | 0.00 |
| 1000 Seeds [gr] | 1.56 | 1.75 | 1.62 | 1.99 | 1.92 | 1.54 | 2.77 |
| Total Leaf Area | 76.39 | 37.49 | 25.00 | 14.33 | 50.79 | 29.13 | 218.2 |
| Total Perim. | 219.1 | 100.5 | 68.0 | 37.9 | 97.5 | 61.2 | 329.0 |

Table 16: Provided are the values of each of the parameters (as described above) measured in *B. juncea* (Seed ID 671) grown in seven population densities (Populat. Density) under normal conditions. Param. = parameter.

Example 7

Production of *Sorghum* Transcriptom and High Throughput Correlation Analysis with Yield, NUE, and ABST Related Parameters Measured in Fields Using 44K *Sorghum* Oligonucleotide Micro-Arrays In order to produce a high throughput correlation analysis between plant phenotype and gene expression level, the present inventors utilized a sorghum oligonucleotide microarray, produced by Agilent Technologies [Hypertext Transfer Protocol://World Wide Web (dot) chem. (dot) agilent (dot) com/Scripts/PDS (dot) asp?lPage=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test.

Correlation of *Sorghum* Varieties Across Ecotypes Grown Under Low Nitrogen, Regular Growth and Severe Drought Conditions Experimental Procedures 17 *Sorghum* varieties were grown in 3 repetitive plots, in field. Briefly, the growing protocol was as follows:

1. Regular growth conditions: sorghum plants were grown in the field using commercial fertilization and irrigation protocols.

2. Low Nitrogen fertilization conditions: sorghum plants were fertilized with 50% less amount of nitrogen in the field than the amount of nitrogen applied in the regular growth treatment. All the fertilizer was applied before flowering.

3. Drought stress: sorghum seeds were sown in soil and grown under normal condition until around 35 days from sowing, around V8. At this point, irrigation was stopped, and severe drought stress was developed. In order to define correlations between the levels of RNA expression with NUE, drought, and yield components or vigor related parameters, the 17 different sorghum varieties were analyzed. Among them, 10 varieties encompassing the observed variance were selected for RNA expression analysis. The correlation between the RNA levels and the characterized parameters was analyzed using Pearson correlation test.

Analyzed *Sorghum* tissues—All 10 selected *Sorghum* hybrids were sample per each treatment. Plant tissues [Flag leaf, Flower meristem and Flower] growing under low nitrogen, severe drought stress and plants grown under Normal conditions were sampled and RNA was extracted as described above.

The following parameters were collected using digital imaging system:

Average Grain Area (cm$^2$)—At the end of the growing period the grains were separated from the Plant 'Head'. A sample of ~200 grains were weight, photographed and images were processed using the below described image processing system. The grain area was measured from those images and was divided by the number of grains.

Average Grain Length (cm)—At the end of the growing period the grains were separated from the Plant 'Head'. A sample of ~200 grains were weight, photographed and images were processed using the below described image processing system. The sum of grain lengths (longest axis) was measured from those images and was divided by the number of grains.

Head Average Area (cm$^2$) At the end of the growing period 5 'Heads' were, photographed and images were processed using the below described image processing system. The 'Head' area was measured from those images and was divided by the number of 'Heads'.

Head Average Length (cm) At the end of the growing period 5 'Heads' were, photographed and images were processed using the below described image processing system. The 'Head' length (longest axis) was measured from those images and was to divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight per Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head per Plant gr—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr based on plot) and for 5 (FW Head/Plant gr based on 5 plants).

Plant height—Plants were characterized for height during growing period at 5 time points. In each measure, plants were measured for their height using a measuring Tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

Relative Growth Rate was calculated using Formulas X and XI as follows:

Formula X Relative growth rate of plant height=Regression coefficient of plant height along time course.

Formula XI Relative growth rate of plant leaf number=Regression coefficient of plant leaf number along time course.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative dry weight and Heads—At the end of the experiment (when Inflorescence were dry) all Inflorescence and vegetative material from plots within blocks A-C were collected. The biomass and Heads weight of each plot was separated, measured and divided by the number of Heads.

Dry weight=total weight of the vegetative portion above ground (excluding roots) after drying at 70° C. in oven for 48 hours;

Harvest Index (HI) (*Sorghum*)—The harvest index was calculated using Formula XII.

Formula XII: Harvest Index=Average grain dry weight per Head/(Average vegetative dry weight per Head+Average Head dry weight)

FW Heads/(FW Heads+FW Plants)—The total fresh weight of heads and their respective plant biomass were measured at the harvest day. The heads weight was divided by the sum of weights of heads and plants.

Experimental Results 17 different sorghum hybrids were grown and characterized for different parameters: The average for each of the measured parameter was calculated using the JMP software (Tables 17-21) and a subsequent correlation analysis was performed (Table 26 below) under the vector sets "Vectors *Sorghum* Field Normal" or Vectors *Sorghum* Field NUE".

TABLE 17

*Sorghum* correlated parameters (vectors)

| Correlation set | Correlation ID |
| --- | --- |
| Total Seed Weight/Head gr based on plot-normal | 1 |
| Total Seed Weight/Head gr based on 5 heads-normal | 2 |
| Head Average Length cm-normal | 3 |
| Average Seed Area cm2-normal | 4 |
| Average Seed Length cm-normal | 5 |
| FW Head/Plant gr based on 5 plants-normal | 6 |
| FW Head/Plant gr based on plot-normal | 7 |
| Final Plant Height cm-normal | 8 |
| Total Seed Weight/Head gr based on plot-NUE | 9 |
| Total Seed Weight/Head gr based on 5 heads-NUE | 10 |
| Head Average Area cm2-NUE | 11 |
| Head Average Perimeter cm-NUE | 12 |
| Head Average Length cm-NUE | 13 |
| Average Seed Area cm2-NUE | 14 |
| Average Seed Perimeter cm-NUE | 15 |
| Average Seed Length cm-NUE | 16 |
| Average Seed Width cm-NUE | 17 |
| Upper Ratio Average Seed Area-NUE | 18 |
| Lower Ratio Average Seed Area-NUE | 19 |
| FW Head/Plant gr based on 5 plants-NUE | 20 |
| FW Head/Plant gr based on plot-NUE | 21 |
| FW/Plant gr based on plot-NUE | 22 |
| Leaf SPAD 64 Days Post Sowing-NUE | 23 |
| FW Heads/(FW Heads + FW Plants) all plot-NUE | 24 |
| NUpE [biomass/SPAD](Low N) | 25 |
| NUE2 (total biomass/SPAD) (Low N) | 26 |
| NUE [yield/SPAD](Low N) | 27 |
| NUE [yield/SPAD](NORMAL) | 28 |
| NUE2 (total biomass/SPAD) (Normal) | 29 |
| NUpE [biomass/SPAD](NORMAL) | 30 |
| Total Seed Weight/Head gr based on plot-NUE | 9 |
| Total Seed Weight/Head gr based on 5 heads-NUE | 10 |
| Head Average Area cm2-NUE | 11 |
| Head Average Perimeter cm-NUE | 12 |
| Head Average Length cm-NUE | 13 |
| Average Seed Area cm2-NUE | 14 |
| Average Seed Perimeter cm-NUE | 15 |
| Average Seed Length cm-NUE | 16 |
| Average Seed Width cm-NUE | 17 |
| Upper Ratio Average Seed Area-NUE | 18 |
| Lower Ratio Average Seed Area-NUE | 19 |
| FW Head/Plant gr based on 5 plants-NUE | 20 |
| FW Head/Plant gr based on plot-NUE | 21 |
| FW/Plant gr based on plot-NUE | 22 |
| Leaf SPAD 64 Days Post Sowing-NUE | 23 |

TABLE 17-continued

Sorghum correlated parameters (vectors)

| Correlation set | Correlation ID |
|---|---|
| FW Heads/(FW Heads + FW Plants) all plot-NUE | 24 |
| NUpE [biomass/SPAD](Low N) | 25 |
| NUE2 (total biomass/SPAD) (Low N) | 26 |
| NUE [yield/SPAD](Low N) | 27 |
| NUE [yield/SPAD](NORMAL) | 28 |
| NUE2 (total biomass/SPAD) (Normal) | 29 |
| NUpE [biomass/SPAD](NORMAL) | 30 |
| Total Seed Weight/Head gr based on plot-Drought | 31 |
| Head Average Area cm2-Drought | 32 |
| Head Average Perimeter cm-Drought | 33 |
| Head Average Length cm-Drought | 34 |
| Head Average Width cm-Drought | 35 |
| RGR of Leaf Num-Drought | 36 |
| Final Plant Height cm-NUE | 37 |
| HI-normal | 38 |

Table 17. Provided are the Sorghum correlated parameters (vectors). "gr." = grams; "SPAD" = chlorophyll levels; "FW" = Plant Fresh weight; "DW" = Plant Dry weight; "normal" = standard growth conditions.

TABLE 18

Measured parameters in Sorghum accessions under normal conditions

| Ecotype | 1 | 2 | 3 | 4 | 5 | 6 | 7 | 8 | 38 |
|---|---|---|---|---|---|---|---|---|---|
| 20 | 31.1 | 47.4 | 25.6 | 0.105 | 0.386 | 406 | 175 | 95.2 | 201 |
| 21 | 26.4 | 46.3 | 26.8 | 0.112 | 0.402 | 518 | 223 | 79.2 | 127 |
| 22 | 18.7 | 28.4 | 21 | 0.131 | 0.445 | 148 | 56.4 | 198 | 51.8 |
| 24 | 38.4 | 70.4 | 26.8 | 0.129 | 0.45 | 423 | 112 | 234 | 122 |
| 25 | | | | | | | | 189 | 54.5 |
| 26 | | | | | | | | 195 | 93.9 |
| 27 | 47.7 | 63.5 | 31.3 | 0.11 | 0.4 | 424 | 126 | 117 | 327 |
| 28 | 31 | 44.5 | 23.2 | 0.113 | 0.405 | 386 | 108 | 92.8 | 231 |
| 29 | 40 | 56.6 | 25.7 | 0.102 | 0.384 | 410 | 124 | 113 | 241 |
| 30 | 38.4 | 60 | 28.8 | 0.118 | 0.419 | 329 | 103 | 97.5 | 304 |
| 31 | 32.1 | 45.5 | 28.1 | 0.121 | 0.43 | 391 | 82.3 | 98 | 336 |
| 32 | 32.7 | 58.2 | 23 | 0.111 | 0.4 | 436 | 77.6 | 100 | 350 |
| 33 | 32.8 | 70.6 | 28.1 | 0.117 | 0.409 | 430 | 91.2 | 106 | 293 |
| 34 | 51.5 | 70.1 | 30 | 0.108 | 0.401 | 441 | 150 | 151 | 411 |
| 35 | 35.7 | 54 | 30.5 | 0.105 | 0.395 | 416 | 109 | 117 | 285 |
| 36 | 38.3 | 59.9 | 27.2 | 0.11 | 0.395 | 430 | 108 | 124 | 283 |
| 37 | 42.4 | 52.6 | 29.3 | 0.105 | 0.392 | 428 | 131 | 126 | 204 |

Table 18: Provided are the values of each of the parameters (as described above) measured in Sorghum accessions (Seed ID) under normal conditions. Growth conditions are specified in the experimental procedure section.

TABLE 19

Measured parameters in Sorghum accessions under Low nitrogen conditions

| Ecotype | 9 | 10 | 11 | 12 | 13 | 14 | 15 | 16 | 17 | 18 | 19 |
|---|---|---|---|---|---|---|---|---|---|---|---|
| 20 | 25.90 | 50.30 | 96.20 | 56.30 | 23.20 | 0.11 | 1.19 | 0.38 | 0.35 | 1.18 | 0.82 |
| 21 | 30.60 | 50.90 | 215.00 | 79.20 | 25.60 | 0.11 | 1.23 | 0.40 | 0.35 | 1.31 | 0.77 |
| 22 | 19.40 | 36.10 | 98.60 | 53.20 | 20.90 | 0.14 | 1.37 | 0.45 | 0.39 | 1.11 | 0.81 |
| 24 | 35.60 | 73.10 | 183.00 | 76.20 | 28.40 | 0.12 | 1.29 | 0.42 | 0.37 | 1.21 | 0.79 |
| 25 | 25.20 | 37.90 | 120.00 | 67.30 | 24.30 | 0.14 | 1.41 | 0.47 | 0.38 | 1.19 | 0.78 |
| 26 | 22.20 | 36.40 | 110.00 | 59.50 | 22.60 | 0.13 | 1.40 | 0.48 | 0.36 | 1.18 | 0.80 |
| 27 | 50.00 | 71.70 | 172.00 | 79.30 | 32.10 | 0.12 | 1.27 | 0.41 | 0.37 | 1.16 | 0.83 |
| 28 | 27.50 | 35.00 | 84.80 | 51.50 | 20.40 | 0.12 | 1.26 | 0.41 | 0.36 | 1.23 | 0.79 |
| 29 | 51.10 | 76.70 | 156.00 | 69.90 | 26.70 | 0.12 | 1.26 | 0.41 | 0.36 | 1.17 | 0.81 |
| 30 | 36.80 | 57.60 | 137.00 | 66.20 | 26.30 | 0.13 | 1.35 | 0.43 | 0.38 | 1.22 | 0.77 |
| 31 | 29.40 | 42.90 | 138.00 | 67.40 | 25.40 | 0.13 | 1.38 | 0.45 | 0.37 | 1.24 | 0.74 |
| 32 | 26.70 | 36.50 | 96.50 | 57.90 | 23.10 | 0.12 | 1.28 | 0.42 | 0.36 | 1.19 | 0.80 |
| 33 | 29.40 | 68.60 | 158.00 | 70.60 | 27.90 | 0.12 | 1.27 | 0.41 | 0.36 | 1.23 | 0.79 |
| 34 | 51.10 | 71.80 | 164.00 | 73.80 | 28.90 | 0.12 | 1.26 | 0.41 | 0.36 | 1.16 | 0.82 |
| 35 | 37.00 | 49.30 | 138.00 | 66.90 | 27.60 | 0.11 | 1.23 | 0.40 | 0.34 | 1.34 | 0.80 |
| 36 | 39.90 | 43.90 | 135.00 | 65.40 | 25.50 | 0.12 | 1.28 | 0.41 | 0.37 | 1.21 | 0.81 |
| 37 | 41.80 | 52.10 | 166.00 | 76.00 | 30.30 | 0.11 | 1.22 | 0.40 | 0.35 | 1.21 | 0.81 |

Table 19: Provided are the values of each of the parameters (as described above) measured in Sorghum accessions (Seed ID) under low nitrogen conditions. Growth conditions are specified in the experimental procedure section.

TABLE 20

Additional measured parameters in Sorghum accessions under low nitrogen growth conditions

| Ecotype | 20 | 21 | 22 | 23 | 24 | 25 | 26 | 27 | 28 | 29 | 30 | 37 |
|---|---|---|---|---|---|---|---|---|---|---|---|---|
| 20 | 388.00 | 215.00 | 205.00 | 38.30 | 0.51 | 5.34 | 6.02 | 0.68 | 0.72 | 4.50 | 3.78 | 104 |
| 21 | 429.00 | 205.00 | 200.00 | 39.00 | 0.51 | 5.12 | 5.91 | 0.78 | | | | 80.9 |
| 22 | 298.00 | 73.50 | 341.00 | 42.30 | 0.17 | 8.05 | 8.50 | 0.46 | 0.43 | 8.17 | 7.74 | 205 |
| 24 | 280.00 | 123.00 | 241.00 | 40.90 | 0.39 | 5.88 | 6.75 | 0.87 | 0.86 | 7.86 | 7.01 | 125 |
| 25 | 208.00 | 153.00 | 538.00 | 43.10 | 0.21 | 12.50 | 13.00 | 0.58 | 0.58 | 10.70 | 10.10 | 225 |
| 26 | 304.00 | 93.20 | 359.00 | 39.90 | 0.19 | 9.02 | 9.58 | 0.56 | 0.69 | 8.34 | 7.65 | 208 |
| 27 | 436.00 | 134.00 | 149.00 | 42.70 | 0.48 | 3.50 | 4.67 | 1.17 | 1.05 | 4.40 | 3.34 | 121 |
| 28 | 376.00 | 77.40 | 129.00 | 43.30 | 0.38 | 2.98 | 3.61 | 0.63 | 0.69 | 3.74 | 3.05 | 100 |
| 29 | 475.00 | 130.00 | 179.00 | 39.00 | 0.42 | 4.58 | 5.89 | 1.31 | 0.93 | 4.83 | 3.90 | 121 |
| 30 | 438.00 | 99.80 | 124.00 | 42.70 | 0.44 | 2.91 | 3.77 | 0.86 | 0.84 | 3.67 | 2.83 | 94.5 |

TABLE 20-continued

Additional measured parameters in *Sorghum* accessions under low nitrogen growth conditions

| | parameter | | | | | | | | | | | |
|---|---|---|---|---|---|---|---|---|---|---|---|---|
| Ecotype | 20 | 21 | 22 | 23 | 24 | 25 | 26 | 27 | 28 | 29 | 30 | 37 |
| 31 | 383.00 | 76.90 | 101.00 | 40.10 | 0.43 | 2.53 | 3.26 | 0.74 | 0.72 | 2.89 | 2.18 | 110 |
| 32 | 375.00 | 84.20 | 132.00 | 44.00 | 0.39 | 3.00 | 3.61 | 0.61 | 0.72 | 2.91 | 2.19 | 115 |
| 33 | 425.00 | 92.20 | 118.00 | 45.40 | 0.44 | 2.59 | 3.24 | 0.65 | 0.71 | 3.12 | 2.41 | 105 |
| 34 | 434.00 | 139.00 | 177.00 | 44.80 | 0.44 | 3.95 | 5.10 | 1.14 | 1.17 | 4.75 | 3.58 | 174 |
| 35 | 409.00 | 113.00 | 144.00 | 42.60 | 0.44 | 3.37 | 4.24 | 0.87 | 0.79 | 3.69 | 2.90 | 116 |
| 36 | 378.00 | 95.50 | 127.00 | 43.80 | 0.43 | 2.90 | 3.81 | 0.91 | 0.85 | 3.85 | 3.01 | 139 |
| 37 | 432.00 | 129.00 | 180.00 | 46.70 | 0.42 | 3.86 | 4.76 | 0.89 | 0.98 | 5.84 | 4.85 | 144 |

Table 20: Provided are the values of each of the parameters (as described above) measured in *Sorghum* accessions (Seed ID) under low nitrogen conditions. Growth conditions are specified in the experimental procedure section.

TABLE 21

Measured parameters in *Sorghum* accessions under drought conditions

| | parameter | | | | | |
|---|---|---|---|---|---|---|
| Ecotype | 31 | 32 | 33 | 34 | 35 | 36 |
| 20 | 22.1 | 83.1 | 52.8 | 21.6 | 4.83 | 0.0971 |
| 21 | 16.8 | 108 | 64.5 | 21.9 | 6.31 | 0.178 |
| 22 | 9.19 | 88.7 | 56.6 | 21.6 | 5.16 | 0.162 |
| 24 | 104 | 136 | 64.4 | 22 | 7.78 | 0.212 |
| | | | | | | 0.167 |
| 26 | 3.24 | 90.8 | 53.2 | 21 | 5.28 | 0.21 |
| 27 | 22 | 124 | 71.7 | 28.6 | 5.49 | 0.149 |
| 28 | 9.97 | 86.1 | 55.6 | 21.3 | 5.04 | 0.0808 |
| 29 | 18.6 | 85.2 | 53 | 20.8 | 5.07 | 0.138 |
| 30 | 29.3 | 113 | 69.8 | 24.7 | 5.77 | |
| 31 | 10.5 | 101 | 65.1 | 24.3 | 5.37 | 0.108 |
| 32 | 14.8 | 80.4 | 55.3 | 21.9 | 4.66 | 0.117 |
| 33 | 12.9 | 127 | 69.1 | 25 | 6.35 | 0.108 |
| 34 | 18.2 | 86.4 | 53.3 | 19.5 | 5.58 | 0.265 |
| 35 | 11.6 | 92.3 | 56.3 | 20.4 | 5.76 | 0.125 |
| 36 | 18.6 | 77.9 | 49.1 | 16.8 | 5.86 | 0.12 |
| 37 | 16.4 | 76.9 | 51.9 | 18.9 | 5.1 | |

Table 21: Provided are the values of each of the parameters (as described above) measured in *Sorghum* accessions (Seed ID) under drought conditions. Growth conditions are specified in the experimental procedure section.

Example 8

Production of Maize Transcriptom and High Throughput Correlation Analysis with Yield Related Parameters Using 44K Maize Oligonucleotide Micro-Arrays In order to produce a high throughput correlation analysis between plant phenotype and gene expression level, the present inventors utilized a maize oligonucleotide microarray, produced by Agilent Technologies [Hypertext Transfer Protocol://World Wide Web (dot) chem. (dot) agilent (dot) com/Scripts/PDS (dot) asp?lPage=50879]. The array oligonucleotide represents about 44,000 maize genes and transcripts. In order to define correlations between the levels of RNA expression with yield and NUE components or vigor related parameters, various plant characteristics of 12 different maize hybrids were analyzed. Among them, 10 hybrids encompassing the observed variance were selected for RNA expression analysis. The correlation between the RNA levels and the characterized parameters was analyzed using Pearson correlation test.

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with NUE and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test.

Analyzed *Sorghum* tissues—All 10 selected maize hybrids were sample per each treatment. Plant tissues [Flag leaf, Flower meristem, Grain, Cobs, Internodes] growing under Normal conditions were sampled and RNA was extracted as described above.

The following parameters were collected using digital imaging system:

Grain Area ($cm^2$)—At the end of the growing period the grains were separated to from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was divided by the number of grains.

Ear Area ($cm^2$)—At the end of the growing period 5 ears were, photographed and images were processed using the below described image processing system. The Ear area was measured from those images and was divided by the number of Ears.

Ear Length and Ear Width (cm) At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

Relative Growth Rate was calculated using Formulas X and XI (described above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS)

Dry weight per plant—At the end of the experiment (when Inflorescence were dry) all vegetative material from plots within blocks A-C were collected.

Dry weight=total weight of the vegetative portion above ground (excluding roots) after drying at 70° C. in oven for 48 hours;

Harvest Index (HI) (Maize)—The harvest index was calculated using Formula XIII.

Harvest Index=Average grain dry weight per Ear/ (Average vegetative dry weight per Ear+Average Ear dry weight)   Formula XIII Percent Filled Ear [%]—it was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 12 different maize hybrids were grown and characterized for different to parameters: The average for each of the measured parameter was calculated using the JMP software (Tables 22-25) and a subsequent correlation analysis was performed (Table 26) using the "Vectors Maize normal".

TABLE 22

Maize correlated parameters (vectors)

| Correlations | Correlation ID |
|---|---|
| Normal-Ear weight per plot (42 plants per plot) [0-RH] | 1 |
| Normal-seed yield per 1 plant rest of the plot [0-RH in Kg] | 2 |
| Normal-Seed yield per dunam [kg] | 3 |
| Normal-Plant Height 19.7.09 | 4 |
| Normal-Plant Height 29.07.09 | 5 |
| Normal-Plant Height 03.08.09 | 6 |
| Normal-Plant Height 10.08.09 | 7 |
| Normal-Final Plant Height | 8 |
| Normal-Final Main Ear Height | 9 |
| Normal-Leaf No 3.08.09 | 10 |
| Normal-Final Leaf Number | 11 |
| Normal-Stalk width 20/08/09 close to TP5 | 12 |
| Normal-Ear Length cm | 13 |
| Normal-Ear with mm | 14 |
| Normal-Ear length of filled area cm | 15 |
| Normal-No of rows per ear | 16 |
| Normal-SPAD 29.7.09 | 17 |
| Normal-SPAD 3.8.09 | 18 |
| Normal-SPAD 10.8.09 | 19 |
| Normal-SPAD 1.9.09 R1-2 | 20 |
| Normal-SPAD 6.9.09 R3-R4 | 21 |
| Normal-NUE yield kg/N applied in soil kg | 22 |
| Normal-NUE at grain filling [R3-R4] yield Kg/N in plant SPAD | 23 |
| Normal-NUE at early grain filling [R1-R2] yield Kg/N in plant SPAD | 24 |
| Normal-Yield/stalk width | 25 |
| Normal-LAI | 26 |
| Normal-Yield/LAI | 27 |

Table 22. SPAD 46DPS and SPAD 54DPS: Chlorophyl level after 46 and 54 days after sowing (DPS).

TABLE 23

Measured parameters in Maize accessions under normal conditions

| | parameter | | | | | | | | | |
|---|---|---|---|---|---|---|---|---|---|---|
| ecotype | 1 | 2 | 3 | 4 | 5 | 6 | 7 | 8 | 9 | 10 |
| 30G54 | 8.94 | 0.167 | 1340 | 27 | 19.8 | 74.3 | 101 | 273 | 130 | 9.39 |
| 32P75 | 7.02 | 0.136 | 1090 | 70.7 | 45.3 | 33.4 | 168 | 260 | 122 | 11.1 |
| 32W86 | 7.53 | 0.15 | 1200 | 70.2 | 48 | 75.8 | 183 | 288 | 128 | 11.8 |
| 32Y52 | 7.99 | 0.159 | 1270 | 67.5 | 45.7 | 55.9 | 160 | 238 | 113 | 11.3 |
| 3394 | 8.48 | 0.15 | 1200 | 23.8 | 16.9 | 72.3 | 102 | 287 | 135 | 9 |
| Brasco | 5.63 | 0.117 | 937 | 63.2 | 44.9 | 58.1 | 174 | 225 | 94.3 | 11.4 |
| Oropesa | 6.1 | 0.123 | 986 | 59.4 | 38.8 | 62.2 | 157 | 264 | 121 | 11.2 |
| Pampero | 6.66 | 0.131 | 1050 | 65.1 | 48.6 | 58.7 | 185 | 252 | 108 | 11.8 |
| SC7201 | 8.21 | 0.153 | 1230 | 25.1 | 17.9 | 75.7 | 122 | 279 | 140 | 9.28 |

TABLE 23-continued

Measured parameters in Maize accessions under normal conditions

| ecotype | 1 | 2 | 3 | 4 | 5 | 6 | 7 | 8 | 9 | 10 |
|---|---|---|---|---|---|---|---|---|---|---|
| Simon | 8.4 | 0.171 | 1370 | 58.7 | 45.4 | 51.6 | 178 | 278 | 112 | 12 |
| SSC5007 | 1.88 | 0.0376 | 301 | 61.2 | 40.9 | 64.3 | 153 | 164 | 60.4 | 10.8 |

Table 23. Provided are the values of each of the parameters (as described above) measured in maize accessions (Seed ID) under regular growth conditions. Growth conditions are specified in the experimental procedure section.

TABLE 24

Additional measured parameters in Maize accessions under regular growth conditions

| ecotype | 11 | 12 | 13 | 14 | 15 | 16 | 17 | 18 | 19 | 20 |
|---|---|---|---|---|---|---|---|---|---|---|
| 30G54 | 11.8 | 2.91 | 19.9 | 51.1 | 16.2 | 16.1 | 49.6 | 50.9 | 60.3 | 56.9 |
| 32P75 | 11.1 | 2.64 | 20.2 | 46.3 | 17.5 | 14.7 | 48.4 | 46.7 | 55.8 | 57.2 |
| 32W86 | 13.3 | 2.71 | 18.1 | 45.9 | 17.7 | 15.4 | 45.7 | 43.7 | 60.3 | 59.3 |
| 32Y52 | 11.8 | 2.9 | 19.9 | 47.6 | 18.4 | 15.9 | 49.8 | 50.5 | 58.6 | 61.6 |
| 3394 | 11.9 | 2.7 | 19.5 | 51.4 | 15.7 | 16.2 | 48.3 | 51 | 60.4 | 58.6 |
| Brasco | 12.3 | 2.62 | 17.7 | 47.4 | 14.7 | 15.2 | 48.2 | 49 | 53.7 | 61.2 |
| Oropesa | 12.4 | 2.92 | 17.7 | 47.3 | 12.9 | 16 | 45.4 | 46.5 | 56.1 | 60.2 |
| Pampero | 12.2 | 2.72 | 17.3 | 46.8 | 14 | 14.8 | 47.9 | 46.7 | 55.2 | 61.1 |
| SC7201 | 11.7 | 2.66 | 17.5 | 48.3 | 12.3 | 17.7 | 48.9 | 50.9 | 57.3 | 57.5 |
| Simon | 12.6 | 2.84 | 20.5 | 49.3 | 18.8 | 15.4 | 46.2 | 49.4 | 52.8 | 62.2 |
| SSC5007 | 9.28 | 2.26 | 19.9 | 41.8 | 16.1 | 14.3 | 42.4 | 45.9 | 57.2 | 52 |

Table 24. Provided are the values of each of the parameters (as described above) measured in maize accessions (Seed ID) under regular growth conditions. Growth conditions are specified in the experimental procedure section.

TABLE 25

Additional measured parameters in Maize accessions under regular growth conditions

| ecotype | 21 | 22 | 23 | 24 | 25 | 26 | 27 |
|---|---|---|---|---|---|---|---|
| 30G54 | 59.9 | 4.45 | 25 | 23.4 | 457 | 3.21 | 426 |
| 32P75 | 60.9 | 3.62 | 17.8 | 19.1 | 412 | 3.95 | 313 |
| 32W86 | 56.9 | 4.01 | 20.3 | 20.3 | 443 | 3.33 | 307 |
| 32Y52 | 58.7 | 4.24 | 20 | 20.7 | 439 | 4.01 | 362 |
| 3394 | 58.7 | 4.01 | 19 | 20.5 | 447 | 3.86 | 314 |
| Brasco | 63.2 | 3.12 | 13.9 | 15.4 | 357 | 4.19 | 225 |
| Oropesa | 59.8 | 3.29 | 16.2 | 16.4 | 337 | 3.97 | 266 |
| Pampero | 62.4 | 3.5 | 17.2 | 17.2 | 386 | 4.32 | 262 |
| SC7201 | 57.2 | 4.09 | 21.5 | 21 | 472 | 4.31 | |
| Simon | 61.9 | 4.55 | 21 | 22 | 482 | 2.89 | 482 |
| SSC5007 | 49.3 | 1 | 5.52 | 5.72 | 140 | | |

Table 25. Provided are the values of each of the parameters (as described above) measured in maize accessions (Seed ID) under regular growth conditions. Growth conditions are specified in the experimental procedure section.

Example 9

Correlation Analyses

Table 26 hereinbelow provides representative results of the correlation analyses described in Examples 2-8 above.

TABLE 26

Correlation analyses

| Gene Name | Vector Set | Expression Set | Correlation Vector | R | P |
|---|---|---|---|---|---|
| LYD1 | Arabidopsis 2 NUE | stem | N 1.5 mM seed yield per rossete area day 10 | −0.90 | 1.09E−03 |
| LYD1 | Arabidopsis 2 NUE | stem | N 1.5 mM seed yield per leaf blead | −0.88 | 1.94E−03 |
| LYD1 | Arabidopsis 2 NUE | leaf | N 1.5 mM Leaf Blade Area 10 day | −0.81 | 4.87E−03 |
| LYD10 | Arabidopsis 1 | seed5daf | Lamina width | −0.87 | 0.01 |
| LYD10 | Arabidopsis 1 | seed5daf | Total Leaf Area per plant | −0.85 | 0.02 |
| LYD10 | Arabidopsis 2 NUE | leaf | N 1.5 mM t50 Flowering | −0.80 | 0.01 |

TABLE 26-continued

Correlation analyses

| Gene Name | Vector Set | Expression Set | Correlation Vector | R | P |
|---|---|---|---|---|---|
| LYD101 | Arabidopsis 2 | leaf | N 6 mM spad/DW (gN/g plant) | −0.89 | 0.04 |
| LYD101 | Arabidopsis 2 | stem | N 6 mMSpad/FW | −0.89 | 0.04 |
| LYD101 | Arabidopsis 2 | stem | N 6 mM spad/DW (gN/g plant) | −0.89 | 0.04 |
| LYD102 | Arabidopsis 2 | stem | N 6 mM spad/DW (gN/g plant) | −0.95 | 0.01 |
| LYD102 | Arabidopsis 2 | stem | N 1.5 mM Spad/FW | −0.85 | 0.07 |
| LYD102 | Arabidopsis 2 | stem | N 6 mM Seed yield/N unit | −0.84 | 0.07 |
| LYD103 | Arabidopsis 1 | seed5daf | Harvest Index | −0.86 | 0.01 |
| LYD103 | Arabidopsis 2 NUE | leaf | N 6 mM Dry Weight | 0.71 | 0.02 |
| LYD103 | Arabidopsis 1 | root | fresh weight | 0.71 | 0.05 |
| LYD104 | Arabidopsis 1 | seed5daf | seed yield per plant | 0.70 | 0.08 |
| LYD104 | Arabidopsis 2 NUE | leaf | N 6 mM RGR of Rosette Area 3 day | 0.70 | 0.02 |
| LYD104 | Arabidopsis 2 NUE | stem | N 6 mM 1000 Seeds weight | 0.71 | 0.03 |
| LYD105 | Arabidopsis 2 | leaf | N 1.5 mM seed yield/spad | −0.91 | 0.03 |
| LYD105 | Arabidopsis 2 | stem | N 1.5 mM DW/SPAD | −0.86 | 0.06 |
| LYD105 | Arabidopsis 2 NUE | leaf | N 1.5 mM seed yield per rossete area day 10 | −0.85 | 1.94E−03 |
| LYD106 | Arabidopsis 2 | leaf | N 1.5 mM seed yield/spad | −0.98 | 4.57E−03 |
| LYD106 | Arabidopsis 2 | leaf | N 6 mM Seed yield/N unit | −0.97 | 0.01 |
| LYD106 | Arabidopsis 2 NUE | stem | N 1.5 mM Leaf Blade Area 10 day | −0.79 | 0.01 |
| LYD107 | Arabidopsis 2 | leaf | N 6 mMSpad/FW | −0.97 | 0.01 |
| LYD107 | Arabidopsis 2 | leaf | N 1.5 mM Spad/FW | −0.88 | 0.05 |
| LYD107 | Arabidopsis 2 | leaf | N 6 mM spad/DW (gN/g plant) | −0.82 | 0.09 |
| LYD109 | Juncea ecotypes vector | Mature flower | Min-Lateral branch position | −0.96 | 0.01 |
| LYD109 | Juncea ecotypes vector | Mature flower | Min-Lateral branch position | −0.96 | 0.01 |
| LYD109 | Juncea ecotypes vector | Mature flower | Min-Lateral branch position | −0.94 | 0.02 |
| LYD11 | Arabidopsis 2 | stem | N 6 mMSpad/FW | −0.94 | 0.02 |
| LYD11 | Arabidopsis 1 | seed5daf | Lamina length | −0.90 | 0.01 |
| LYD11 | Arabidopsis 2 | leaf | N 6 mMSpad/FW | −0.88 | 0.05 |
| LYD110 | Juncea ecotypes vector | Mature flower | Lateral branch-average node length | −0.99 | 2.13E−03 |
| LYD110 | Juncea ecotypes vector | Mature flower | Lateral branch-average node length | −0.91 | 0.03 |
| LYD110 | Juncea ecotypes vector | Mature flower | Main branch-average node length | −0.89 | 0.04 |
| LYD112 | Juncea ecotypes vector | Mature flower | SPAD | −0.88 | 0.05 |
| LYD112 | Juncea ecotypes vector | Mature flower | Max-Length of lateral branch [cm] | −0.83 | 0.08 |
| LYD112 | Juncea ecotypes vector | Mature flower | Max-Diameter of lateral branch [mm] | −0.83 | 0.08 |
| LYD113 | Juncea ecotypes vector | Flower | Days till flowering | −0.92 | 0.01 |
| LYD113 | Juncea ecotypes vector | Flower | Days till flowering | −0.92 | 0.01 |
| LYD113 | Juncea ecotypes vector | Flower | Days till flowering | −0.91 | 0.01 |
| LYD114 | Juncea population densities | flower | days till flowering | −0.93 | 0.02 |
| LYD114 | Juncea population densities | flower | Oil content | −0.91 | 0.03 |
| LYD114 | Juncea ecotypes vector | Mature flower | Lateral branch-20th length | −0.88 | 0.05 |
| LYD115 | Juncea ecotypes vector | Flower | Fresh weight (plot-harvest) [gr/plant] | −0.82 | 0.05 |
| LYD115 | Juncea ecotypes vector | Mature flower | Lateral branch-20th seed number | −0.80 | 0.10 |
| LYD115 | Juncea ecotypes vector | Mature flower | Lateral branch-20th seed number | −0.80 | 0.10 |
| LYD117 | Juncea ecotypes vector | Mature flower | 1000 Seeds [gr] | −0.92 | 0.03 |

TABLE 26-continued

Correlation analyses

| Gene Name | Vector Set | Expression Set | Correlation Vector | R | P |
|---|---|---|---|---|---|
| LYD117 | *Juncea* ecotypes vector | Mature flower | 1000 Seeds [gr] | −0.91 | 0.03 |
| LYD117 | *Juncea* ecotypes vector | Mature flower | Lateral branch-20th length | −0.88 | 0.05 |
| LYD118 | *Juncea* population densities | flower | Main branch-total number of pods | −0.92 | 0.03 |
| LYD118 | *Juncea* ecotypes vector | Mature flower | Lateral branch-20th seed number | −0.83 | 0.09 |
| LYD118 | *Juncea* population densities | meristem | days till bolting | −0.79 | 0.03 |
| LYD119 | *Juncea* ecotypes vector | Flower | Main branch-20th seed number | −0.97 | 1.05E−03 |
| LYD119 | *Juncea* ecotypes vector | Flower | Main branch-20th seed number | −0.97 | 1.23E−03 |
| LYD119 | *Juncea* population densities | flower | Main branch-total number of pods | −0.96 | 0.01 |
| LYD12 | *Arabidopsis* 1 | flower | Lamina width | −0.85 | 0.01 |
| LYD12 | *Arabidopsis* 1 | flower | fresh weight | −0.78 | 0.02 |
| LYD12 | *Arabidopsis* 1 | flower | Total Leaf Area per plant | −0.78 | 0.02 |
| LYD120 | *Juncea* ecotypes vector | Mature flower | Lateral branch-average node length | −0.98 | 2.56E−03 |
| LYD120 | *Juncea* ecotypes vector | Mature flower | Main branch-average node length | −0.95 | 0.01 |
| LYD120 | *Juncea* ecotypes vector | Mature flower | Lateral branch-average node length | −0.89 | 0.04 |
| LYD122 | *Juncea* ecotypes vector | Mature flower | Max-Lateral branch position [#node of main branch] | −0.99 | 1.78E−03 |
| LYD122 | *Juncea* ecotypes vector | Mature flower | Number of lateral branches | −0.99 | 1.91E−03 |
| LYD122 | *Juncea* ecotypes vector | Mature flower | Days till bolting | −0.98 | 3.54E−03 |
| LYD123 | *Juncea* ecotypes vector | Mature flower | Lateral branch-20th seed number | −0.81 | 0.10 |
| LYD123 | *Juncea* ecotypes vector | Mature flower | Lateral branch-20th seed number | −0.80 | 0.10 |
| LYD123 | *Juncea* ecotypes vector | Flower | Lateral branch-average node length | −0.78 | 0.07 |
| LYD124 | *Juncea* ecotypes vector | Mature flower | Lateral branch-average node length | −0.97 | 0.01 |
| LYD124 | *Juncea* ecotypes vector | Mature flower | Main branch-average node length | −0.94 | 0.02 |
| LYD124 | *Juncea* population densities | meristem | Main branch-dist. 1-20 | −0.93 | 2.35E−03 |
| LYD13 | *Arabidopsis* 2 | leaf | N 1.5 mM DW/SPAD | −0.98 | 2.80E−03 |
| LYD13 | *Arabidopsis* 2 | stem | N 1.5 mM seed yield/spad | −0.89 | 0.04 |
| LYD13 | *Arabidopsis* 2 | stem | N 6 mM spad/DW (gN/g plant) | −0.89 | 0.05 |
| LYD14 | *Arabidopsis* 2 NUE | leaf | N 6 mM seed yield/leaf blade | 0.70 | 0.02 |
| LYD14 | *Arabidopsis* 2 NUE | stem | N 1.5 mM Seed Yield | 0.70 | 0.04 |
| LYD14 | *Arabidopsis* 2 NUE | stem | N 1.5 mM Harvest Index | 0.71 | 0.02 |
| LYD142 | Tomato vectors bath Normal | leaf | SPAD Normal | −0.74 | 0.04 |
| LYD142 | Tomato vectors bath Normal | root | leaf No Normal | 0.72 | 0.04 |
| LYD142 | Tomato vectors field Normal | leaf | Weight Flower clusters (Normal) | 0.97 | 2.66E−06 |
| LYD144 | Tomato vectors bath Salinity | leaf | LeafNo NaCl/Normal | −0.75 | 0.01 |
| LYD144 | Tomato vectors bath Normal | root | leaf No Normal | 0.72 | 0.05 |
| LYD144 | Tomato vectors bath Salinity | root | Plant biomass NaCl | 0.74 | 0.01 |
| LYD146 | Tomato vectors field Normal | flower | Weight Flower clusters (Normal) | 0.71 | 0.02 |
| LYD146 | Tomato vectors field Normal | flower | Weight Flower clusters (Normal) | 0.75 | 0.01 |
| LYD146 | Tomato vectors field Normal | leaf | average red fruit weight (Normal) | 0.78 | 0.01 |
| LYD149 | *Arabidopsis* 2 | stem | N 1.5 mM seed yield/spad | −0.99 | 1.18E−03 |
| LYD149 | *Arabidopsis* 2 | stem | N 1.5 mM seed yield/spad | −0.98 | 4.29E−03 |

TABLE 26-continued

Correlation analyses

| Gene Name | Vector Set | Expression Set | Correlation Vector | R | P |
|---|---|---|---|---|---|
| LYD149 | Arabidopsis 2 | stem | N 6 mM Seed yield/N unit | −0.94 | 0.02 |
| LYD150 | Arabidopsis 1 | seed5daf | Lamina length | −0.99 | 2.07E−05 |
| LYD150 | Arabidopsis 1 | seed5daf | fresh weight | −0.93 | 2.61E−03 |
| LYD150 | Arabidopsis 2 | leaf | N 1.5 mM DW/SPAD | −0.90 | 0.04 |
| LYD152 | Arabidopsis 2 | stem | N 1.5 mM seed yield/spad | −0.94 | 0.02 |
| LYD152 | Arabidopsis 1 | seed5daf | root length day 13 | −0.89 | 0.01 |
| LYD152 | Arabidopsis 2 | stem | N 6 mM Seed yield/N unit | −0.85 | 0.07 |
| LYD153 | Arabidopsis 2 | stem | N 6 mM spad/DW (gN/g plant) | −0.86 | 0.06 |
| LYD153 | Arabidopsis 2 | stem | N 1.5 mM seed yield/spad | −0.84 | 0.08 |
| LYD153 | Arabidopsis 2 NUE | leaf | N 1.5 mM Leaf Blade Area 10 day | −0.77 | 0.01 |
| LYD156 | Tomato vectors field Normal | leaf | RWC (Normal) | −0.73 | 0.02 |
| LYD156 | Tomato vectors field Normal | flower | SPAD 100% RWC (Normal) | −0.70 | 0.02 |
| LYD156 | Tomato vectors bath Normal | leaf | leaf No Normal | 0.70 | 0.05 |
| LYD157 | Tomato vectors field Drought | flower | Num of flowers (Drought) | 0.71 | 0.02 |
| LYD157 | Tomato vectors field Drought | flower | Num of Flower Drought/Normal | 0.74 | 0.01 |
| LYD157 | Tomato vectors field Normal | leaf | Weight Flower clusters (Normal) | 0.75 | 0.01 |
| LYD158 | Tomato vectors bath Salinity | root | Plant height NaCl | −0.79 | 0.01 |
| LYD158 | Tomato vectors field Drought | leaf | FW drought/Normal | 0.74 | 0.01 |
| LYD158 | Tomato vectors field Normal | flower | Weight Flower clusters (Normal) | 0.78 | 0.01 |
| LYD159 | Juncea population densities | flower | Min-Lateral branch position | −0.93 | 0.02 |
| LYD159 | Juncea population densities | flower | Number of lateral branches | −0.90 | 0.04 |
| LYD159 | Juncea population densities | flower | Min-Lateral branch position | −0.90 | 0.04 |
| LYD16 | Arabidopsis 1 | seed12 daf | Lamina length | −0.83 | 0.01 |
| LYD16 | Arabidopsis 2 NUE | stem | N 1.5 mM t50 Flowering | −0.81 | 0.01 |
| LYD16 | Arabidopsis 2 NUE | stem | N 6 mM t50 Flowering | −0.78 | 0.01 |
| LYD166 | Juncea population densities | flower | days till flowering | −0.96 | 0.01 |
| LYD166 | Juncea ecotypes vector | Meristem | Harvest index | −0.96 | 4.90E−05 |
| LYD166 | Juncea ecotypes vector | Mature flower | Main branch-average node length | −0.95 | 0.01 |
| LYD167 | Juncea ecotypes vector | Mature flower | Lateral branch-20th length | −0.92 | 0.03 |
| LYD167 | Juncea ecotypes vector | Mature flower | 1000 Seeds [gr] | −0.92 | 0.03 |
| LYD167 | Juncea ecotypes vector | Mature flower | 1000 Seeds [gr] | −0.89 | 0.05 |
| LYD172 | Juncea ecotypes vector | Mature flower | Oil content | −0.96 | 0.01 |
| LYD172 | Juncea ecotypes vector | Mature flower | Oil content | −0.95 | 0.01 |
| LYD172 | Juncea population densities | meristem | Main branch-dist. 1-20 | −0.92 | 3.48E−03 |
| LYD173 | Juncea ecotypes vector | Flower | Days till flowering | −0.96 | 2.00E−03 |
| LYD173 | Juncea ecotypes vector | Flower | Main branch-20th seed number | −0.95 | 3.45E−03 |
| LYD173 | Juncea ecotypes vector | Flower | Main branch-average node length | −0.94 | 0.01 |
| LYD174 | Juncea ecotypes vector | Flower | Oil content | −0.95 | 3.82E−03 |
| LYD174 | Juncea ecotypes vector | Mature flower | Fresh weight (single plant) [gr/plant] | −0.90 | 0.04 |
| LYD174 | Juncea ecotypes vector | Mature flower | Main branch base diameter [mm] | −0.89 | 0.04 |

TABLE 26-continued

Correlation analyses

| Gene Name | Vector Set | Expression Set | Correlation Vector | R | P |
|---|---|---|---|---|---|
| LYD176 | *Juncea* population densities | meristem | Lateral branch-20th length | −0.97 | 3.50E−04 |
| LYD176 | *Juncea* population densities | meristem | Lateral branch-20th length | −0.95 | 8.42E−04 |
| LYD176 | *Juncea* ecotypes vector | Flower | Oil content | −0.95 | 3.65E−03 |
| LYD177 | *Juncea* ecotypes vector | Mature flower | Oil content | −0.98 | 2.20E−03 |
| LYD177 | *Juncea* population densities | meristem | Main branch-dist. 1-20 | −0.97 | 2.64E−04 |
| LYD177 | *Juncea* ecotypes vector | Mature flower | Oil content | −0.95 | 0.01 |
| LYD178 | *Juncea* ecotypes vector | Flower | Oil content | −0.98 | 5.68E−04 |
| LYD178 | *Juncea* population densities | meristem | Max-Number of nodes in lateral branch | −0.93 | 2.41E−03 |
| LYD178 | *Juncea* population densities | meristem | Total leaf area | −0.91 | 4.77E−03 |
| LYD18 | *Arabidopsis* 2 | stem | N 1.5 mM seed yield/spad | −0.94 | 0.02 |
| LYD18 | *Arabidopsis* 2 NUE | leaf | N 1.5 mM Harvest Index | −0.93 | 9.33E−05 |
| LYD18 | *Arabidopsis* 2 NUE | leaf | N 1.5 mM Seed Yield | −0.93 | 1.09E−04 |
| LYD180 | *Juncea* ecotypes vector | Mature flower | Oil content | −0.99 | 7.31E−04 |
| LYD180 | *Juncea* population densities | flower | Dry weight/hectare | −0.98 | 3.24E−03 |
| LYD180 | *Juncea* population densities | flower | Seed weight/hectare | −0.97 | 0.01 |
| LYD184 | *Juncea* population densities | meristem | Number of lateral branches | −0.88 | 0.01 |
| LYD184 | *Juncea* population densities | flower | Main branch-total number of pods | −0.85 | 0.07 |
| LYD184 | *Juncea* population densities | meristem | Max-Lateral branch position | −0.84 | 0.02 |
| LYD185 | *Juncea* population densities | flower | Main branch height [cm] | −0.96 | 0.01 |
| LYD185 | *Juncea* population densities | flower | Main branch height [cm] | −0.93 | 0.02 |
| LYD185 | *Juncea* population densities | meristem | Min-Lateral branch position | −0.93 | 2.59E−03 |
| LYD186 | *Juncea* ecotypes vector | Mature flower | SPAD | −0.99 | 1.20E−03 |
| LYD186 | *Juncea* population densities | meristem | days till bolting | −0.93 | 2.05E−03 |
| LYD186 | *Juncea* ecotypes vector | Mature flower | Main branch base diameter [mm] | −0.93 | 0.02 |
| LYD187 | *Juncea* ecotypes vector | Mature flower | Main branch-average node length | −0.98 | 2.49E−03 |
| LYD187 | *Juncea* population densities | meristem | Lateral branch-20th length | −0.98 | 1.34E−04 |
| LYD187 | *Juncea* ecotypes vector | Mature flower | Lateral branch-average node length | −0.97 | 0.01 |
| LYD188 | *Juncea* ecotypes vector | Mature flower | Oil content | −0.86 | 0.06 |
| LYD188 | *Juncea* ecotypes vector | Mature flower | Oil content | −0.85 | 0.07 |
| LYD188 | *Juncea* ecotypes vector | Flower | Max-Diameter of lateral branch [mm] | −0.74 | 0.09 |
| LYD190 | *Juncea* population densities | flower | Main branch-total number of pods | −0.98 | 3.93E−03 |
| LYD190 | *Juncea* population densities | flower | Main branch-total number of pods | −0.84 | 0.08 |
| LYD190 | *Juncea* ecotypes vector | Meristem | Oil content | −0.81 | 0.01 |
| LYD192 | *Juncea* ecotypes vector | Mature flower | Number of lateral branches | −0.96 | 0.01 |
| LYD192 | *Juncea* ecotypes vector | Mature flower | Days till flowering | −0.96 | 0.01 |
| LYD192 | *Juncea* ecotypes vector | Mature flower | Max-Lateral branch position [#node of main branch] | −0.95 | 0.01 |
| LYD193 | *Juncea* population densities | meristem | Lateral branch-20th length | −0.98 | 1.68E−04 |
| LYD193 | *Juncea* ecotypes vector | Flower | Oil content | −0.96 | 2.40E−03 |

TABLE 26-continued

Correlation analyses

| Gene Name | Vector Set | Expression Set | Correlation Vector | R | P |
|---|---|---|---|---|---|
| LYD193 | *Juncea* ecotypes vector | Flower | Oil content | −0.94 | 0.01 |
| LYD194 | *Juncea* population densities | meristem | Fresh weight (at harvest)/plant | −0.97 | 3.34E−04 |
| LYD194 | *Juncea* population densities | meristem | Seed weight/plant | −0.97 | 4.26E−04 |
| LYD194 | *Juncea* population densities | meristem | Fresh Weight (single plant) [gr/plant] | −0.96 | 4.67E−04 |
| LYD195 | Tomato vectors bath Normal | root | leaf No Normal | −0.74 | 0.04 |
| LYD195 | Tomato vectors field Normal | flower | average red fruit weight (Normal) | 0.71 | 0.02 |
| LYD195 | Tomato vectors field Normal | flower | Weight Flower clusters (Normal) | 0.85 | 1.98E−03 |
| LYD197 | *Arabidopsis* 2 NUE | stem | N 1.5 mM Rosette Area 8 day | −0.90 | 9.86E−04 |
| LYD197 | *Arabidopsis* 2 NUE | stem | N 1.5 mM Rosette Area 10 day | −0.85 | 3.86E−03 |
| LYD197 | *Arabidopsis* 2 NUE | stem | N 1.5 mM t50 Flowering | −0.83 | 2.68E−03 |
| LYD2 | *Arabidopsis* 2 | leaf | N 1.5 mM seed yield/spad | −0.92 | 0.03 |
| LYD2 | *Arabidopsis* 2 | leaf | N 6 mM Seed yield/N unit | −0.85 | 0.07 |
| LYD2 | *Arabidopsis* 2 | leaf | N 1.5 mM seed yield/spad | −0.85 | 0.07 |
| LYD20 | *Arabidopsis* 2 | stem | N 6 mMSpad/FW | −0.92 | 0.03 |
| LYD20 | *Arabidopsis* 2 | stem | N 6 mM spad/DW (gN/g plant) | −0.84 | 0.07 |
| LYD20 | *Arabidopsis* 1 | seed5daf | Dry matter per plant | −0.81 | 0.03 |
| LYD200 | *Juncea* population densities | meristem | days till flowering | −0.93 | 2.17E−03 |
| LYD200 | *Juncea* population densities | meristem | Main branch-20th seed number | −0.90 | 0.01 |
| LYD200 | *Juncea* population densities | meristem | Main branch base diameter [mm] | −0.88 | 0.01 |
| LYD201 | *Juncea* population densities | flower | Main branch-20th length | −0.99 | 2.18E−03 |
| LYD201 | *Juncea* population densities | flower | SPAD | −0.98 | 3.77E−03 |
| LYD201 | *Juncea* ecotypes vector | Mature flower | Number of lateral branches | −0.98 | 4.51E−03 |
| LYD202 | *Juncea* ecotypes vector | Mature flower | Oil content | −0.98 | 3.86E−03 |
| LYD202 | *Juncea* ecotypes vector | Mature flower | Oil content | −0.97 | 0.01 |
| LYD202 | *Juncea* ecotypes vector | Mature flower | Main branch-20th length | −0.92 | 0.03 |
| LYD204 | *Juncea* ecotypes vector | Flower | Oil content | −0.96 | 1.88E−03 |
| LYD204 | *Juncea* ecotypes vector | Flower | Oil content | −0.96 | 2.82E−03 |
| LYD204 | *Juncea* ecotypes vector | Mature flower | Main branch base diameter [mm] | −0.95 | 0.01 |
| LYD206 | *Juncea* population densities | meristem | Main branch-dist. 1-20 | −0.93 | 2.14E−03 |
| LYD206 | *Juncea* population densities | meristem | Main branch-20th length | −0.91 | 4.19E−03 |
| LYD206 | *Juncea* population densities | meristem | Lateral branch-20th length | −0.90 | 0.01 |
| LYD208 | *Juncea* population densities | meristem | Min-Lateral branch position | −0.93 | 2.48E−03 |
| LYD208 | *Juncea* ecotypes vector | Meristem | Main branch-20th seed number | −0.92 | 5.22E−04 |
| LYD208 | *Juncea* population densities | meristem | Min-Lateral branch position | −0.91 | 4.45E−03 |
| LYD209 | *Juncea* population densities | flower | Seed weight/plant | −0.99 | 1.23E−03 |
| LYD209 | *Juncea* population densities | flower | Dry weight/plant | −0.99 | 1.57E−03 |
| LYD209 | *Juncea* population densities | flower | Fresh weight (at harvest)/plant | −0.99 | 1.93E−03 |
| LYD21 | *Arabidopsis* 2 NUE | stem | N 1.5 mM RGR of Rosette Area 3 day | 0.70 | 0.02 |
| LYD21 | *Arabidopsis* 2 NUE | leaf | N 1.5 mM RGR of Rosette Area 3 day | 0.71 | 0.02 |

TABLE 26-continued

Correlation analyses

| Gene Name | Vector Set | Expression Set | Correlation Vector | R | P |
|---|---|---|---|---|---|
| LYD21 | Arabidopsis 1 | seed12daf | root length day 13 | 0.72 | 0.04 |
| LYD212 | Arabidopsis 2 | leaf | N 1.5 mM seed yield/spad | −0.94 | 0.02 |
| LYD212 | Arabidopsis 2 NUE | leaf | N 1.5 mM Harvest Index | −0.94 | 7.06E−05 |
| LYD212 | Arabidopsis 2 | leaf | N 6 mM Seed yield/N unit | −0.92 | 0.03 |
| LYD213 | Arabidopsis 2 | leaf | N 6 mM spad/DW (gN/g plant) | −0.93 | 0.02 |
| LYD213 | Arabidopsis 1 | seed5daf | Oil % per seed | −0.92 | 3.48E−03 |
| LYD213 | Arabidopsis 2 | leaf | N 6 mM Seed yield/N unit | −0.89 | 0.04 |
| LYD214 | Arabidopsis 2 NUE | leaf | N 1.5 mM Biomass reduction compared to 6 mM | −0.81 | 4.74E−03 |
| LYD214 | Arabidopsis 2 | stem | N 1.5 mM seed yield/spad | −0.80 | 0.10 |
| LYD214 | Arabidopsis 2 | stem | N 6 mM Seed yield/N unit | −0.76 | 0.14 |
| LYD215 | Arabidopsis 2 | stem | N 1.5 mM DW/SPAD | −0.88 | 0.05 |
| LYD215 | Arabidopsis 1 | seed5daf | Dry matter per plant | −0.80 | 0.03 |
| LYD215 | Arabidopsis 2 | leaf | N 1.5 mM DW/SPAD | −0.79 | 0.11 |
| LYD216 | Arabidopsis 2 | leaf | N 6 mM spad/DW (gN/g plant) | −0.97 | 0.01 |
| LYD216 | Arabidopsis 2 | leaf | N 1.5 mM Spad/FW | −0.87 | 0.06 |
| LYD216 | Arabidopsis 2 | leaf | N 6 mMSpad/FW | −0.85 | 0.07 |
| LYD217 | Arabidopsis 2 | leaf | N 6 mM spad/DW (gN/g plant) | −0.88 | 0.05 |
| LYD217 | Arabidopsis 2 | leaf | N 6 mM Seed yield/N unit | −0.87 | 0.06 |
| LYD217 | Arabidopsis 2 | leaf | N 1.5 mM seed yield/spad | −0.82 | 0.09 |
| LYD219 | Arabidopsis 2 NUE | stem | N 1.5 mM Leaf Blade Area 10 day | −0.86 | 3.09E−03 |
| LYD219 | Arabidopsis 2 NUE | stem | N 6 mM Leaf Blade Area 10 day | −0.82 | 0.01 |
| LYD219 | Arabidopsis 2 NUE | stem | N 6 mM Rosette Area 8 day | −0.82 | 0.01 |
| LYD22 | Arabidopsis 2 | stem | N 1.5 mM DW/SPAD | −0.97 | 0.01 |
| LYD22 | Arabidopsis 2 | leaf | N 1.5 mM DW/SPAD | −0.94 | 0.02 |
| LYD22 | Arabidopsis 2 | stem | N 1.5 mM DW/SPAD | −0.94 | 0.02 |
| LYD220 | Arabidopsis 2 NUE | stem | N 1.5 mM Leaf Blade Area 10 day | −0.90 | 1.06E−03 |
| LYD220 | Arabidopsis 2 NUE | leaf | N 1.5 mM Leaf Number 10 day | −0.73 | 0.02 |
| LYD220 | Arabidopsis 1 | root | Oil % per seed | −0.72 | 0.05 |
| LYD221 | Arabidopsis 2 | leaf | N 6 mM spad/DW (gN/g plant) | −0.93 | 0.02 |
| LYD221 | Arabidopsis 2 NUE | leaf | N 1.5 mM seed yield per rossete area day 10 | −0.85 | 2.02E−03 |
| LYD221 | Arabidopsis 2 | leaf | N 6 mM Seed yield/N unit | −0.84 | 0.08 |
| LYD222 | Arabidopsis 2 | leaf | N 1.5 mM SPAD/DW | −0.96 | 0.01 |
| LYD222 | Arabidopsis 1 | seed5daf | seed yield per plant | −0.86 | 0.01 |
| LYD222 | Arabidopsis 1 | seed5daf | Oil yield per plant | −0.84 | 0.02 |
| LYD223 | Arabidopsis 1 | leaf | root length day 13 | −0.87 | 0.01 |
| LYD223 | Arabidopsis 1 | leaf | Lamina width | −0.86 | 0.01 |
| LYD223 | Arabidopsis 1 | leaf | Total Leaf Area per plant | −0.84 | 0.01 |
| LYD224 | Arabidopsis 2 NUE | stem | N 1.5 mM Rosette Area 8 day | −0.86 | 2.64E−03 |
| LYD224 | Arabidopsis 1 | seed12daf | Vegetative growth rate | −0.85 | 0.01 |
| LYD224 | Arabidopsis 2 NUE | stem | N 1.5 mM Rosette Area 10 day | −0.82 | 0.01 |
| LYD23 | Arabidopsis 2 | leaf | N 1.5 mM DW/SPAD | −0.79 | 0.11 |
| LYD23 | Arabidopsis 1 | leaf | Lamina length | −0.76 | 0.03 |
| LYD23 | Arabidopsis 1 | flower | seed weight | −0.76 | 0.03 |
| LYD232 | Tomato vectors field Normal | flower | Weight Flower clusters (Normal) | 0.81 | 4.44E−03 |
| LYD232 | Tomato vectors bath Normal | root | leaf No Normal | 0.89 | 3.36E−03 |
| LYD233 | Tomato vectors field Normal | leaf | average red fruit weight (Normal) | 0.71 | 0.02 |
| LYD233 | Tomato vectors field Normal | leaf | Weight Flower clusters (Normal) | 0.88 | 7.54E−04 |
| LYD233 | Tomato vectors field Normal | leaf | Weight Flower clusters (Normal) | 0.90 | 4.31E−04 |

TABLE 26-continued

Correlation analyses

| Gene Name | Vector Set | Expression Set | Correlation Vector | R | P |
|---|---|---|---|---|---|
| LYD234 | Tomato vectors bath Salinity | leaf | leaf No NaCl | −0.78 | 0.01 |
| LYD234 | Tomato vectors field Drought | flower | Num of Flower Drought/NUE | 0.70 | 0.02 |
| LYD234 | Tomato vectors field Drought | flower | flower cluster weight Drought/NUE | 0.77 | 0.01 |
| LYD235 | Tomato vectors field Normal | leaf | average red fruit weight (Normal) | 0.76 | 0.01 |
| LYD235 | Tomato vectors field Normal | leaf | average red fruit weight (Normal) | 0.76 | 0.01 |
| LYD235 | Tomato vectors field Normal | leaf | Weight Flower clusters (Normal) | 0.94 | 5.12E−05 |
| LYD236 | Tomato vectors bath Salinity | leaf | Plant biomass NaCl | −0.72 | 0.02 |
| LYD236 | Tomato vectors field Normal | flower | Fruit yield/Plant (Normal) | 0.71 | 0.02 |
| LYD236 | Tomato vectors field Drought | flower | Num of Flower Drought/Normal | 0.72 | 0.02 |
| LYD244 | *Arabidopsis* 2 | leaf | N 6 mM spad/DW (gN/g plant) | −0.90 | 0.04 |
| LYD244 | *Arabidopsis* 2 | leaf | N 6 mM Seed yield/N unit | −0.89 | 0.04 |
| LYD244 | *Arabidopsis* 2 NUE | stem | N 1.5 mM Rosette Area 8 day | −0.86 | 2.96E−03 |
| LYD245 | *Arabidopsis* 1 | root | Lamina length | −0.76 | 0.03 |
| LYD245 | *Arabidopsis* 2 NUE | leaf | N 1.5 mM 1000 Seeds weight | −0.74 | 0.01 |
| LYD245 | *Arabidopsis* 2 NUE | leaf | N 6 mM Seed Yield | 0.71 | 0.02 |
| LYD246 | *Arabidopsis* 1 | leaf | Lamina length | −0.87 | 0.01 |
| LYD246 | *Arabidopsis* 1 | seed5daf | fresh weight | −0.82 | 0.02 |
| LYD246 | *Arabidopsis* 1 | seed5daf | Total Leaf Area per plant | −0.82 | 0.02 |
| LYD248 | *Juncea* ecotypes vector | Flower | Min-Lateral branch position | −0.95 | 4.36E−03 |
| LYD248 | *Juncea* ecotypes vector | Flower | Min-Lateral branch position | −0.94 | 0.01 |
| LYD248 | *Juncea* ecotypes vector | Flower | Min-Lateral branch position | −0.93 | 0.01 |
| LYD250 | *Juncea* ecotypes vector | Flower | Harvest index | −0.91 | 0.01 |
| LYD250 | *Juncea* population densities | meristem | days till bolting | −0.89 | 0.01 |
| LYD250 | *Juncea* ecotypes vector | Mature flower | Main branch base diameter [mm] | −0.86 | 0.06 |
| LYD252 | *Juncea* ecotypes vector | Flower | Seed weight per plant | −0.95 | 3.69E−03 |
| LYD252 | *Juncea* ecotypes vector | Flower | Main branch-average node length | −0.82 | 0.05 |
| LYD252 | *Juncea* population densities | meristem | Min-Lateral branch position | −0.80 | 0.03 |
| LYD253 | *Juncea* ecotypes vector | Mature flower | Max-Lateral branch position [#node of main branch] | −0.97 | 0.01 |
| LYD253 | *Juncea* ecotypes vector | Mature flower | Number of lateral branches | −0.96 | 0.01 |
| LYD253 | *Juncea* ecotypes vector | Mature flower | Days till bolting | −0.96 | 0.01 |
| LYD256 | *Juncea* ecotypes vector | Mature flower | Harvest index | −0.99 | 1.47E−03 |
| LYD256 | *Juncea* population densities | meristem | Max-Lateral branch position | −0.90 | 0.01 |
| LYD256 | *Juncea* ecotypes vector | Leaf | Harvest index | −0.90 | 3.57E−04 |
| LYD257 | *Juncea* ecotypes vector | Mature flower | Oil content | −0.94 | 0.02 |
| LYD257 | *Juncea* ecotypes vector | Flower | Main branch height [cm] | −0.92 | 0.01 |
| LYD257 | *Juncea* population densities | meristem | Main branch-dist. 1-20 | −0.89 | 0.01 |
| LYD259 | *Juncea* ecotypes vector | Mature flower | Main branch-20th seed number | −0.81 | 0.10 |
| LYD259 | *Juncea* ecotypes vector | Mature flower | Max-Number of nodes in lateral branch | −0.78 | 0.12 |
| LYD259 | *Juncea* ecotypes vector | Mature flower | Main branch-20th length | −0.78 | 0.12 |

TABLE 26-continued

Correlation analyses

| Gene Name | Vector Set | Expression Set | Correlation Vector | R | P |
|---|---|---|---|---|---|
| LYD260 | Juncea ecotypes vector | Flower | Main branch height [cm] | −0.89 | 0.02 |
| LYD260 | Juncea ecotypes vector | Mature flower | Oil content | −0.82 | 0.09 |
| LYD260 | Juncea ecotypes vector | Mature flower | Oil content | −0.79 | 0.11 |
| LYD261 | Juncea ecotypes vector | Mature flower | Main branch-average node length | −0.99 | 5.05E−04 |
| LYD261 | Juncea ecotypes vector | Mature flower | Main branch-average node length | −0.99 | 2.01E−03 |
| LYD261 | Juncea ecotypes vector | Mature flower | Main branch-average node length | −0.97 | 0.01 |
| LYD262 | Juncea ecotypes vector | Flower | Number of lateral branches | −0.94 | 0.01 |
| LYD262 | Juncea ecotypes vector | Flower | Max-Lateral branch position [#node of main branch] | −0.94 | 0.01 |
| LYD262 | Juncea ecotypes vector | Mature flower | Days till bolting | −0.78 | 0.12 |
| LYD264 | Juncea ecotypes vector | Flower | Lateral branch-average node length | −0.89 | 0.02 |
| LYD264 | Juncea population densities | meristem | Min-Lateral branch position | −0.81 | 0.03 |
| LYD264 | Juncea ecotypes vector | Flower | Main branch-average node length | −0.80 | 0.06 |
| LYD265 | Juncea population densities | meristem | Min-Lateral branch position | −0.85 | 0.02 |
| LYD265 | Juncea ecotypes vector | Mature flower | Oil content | −0.81 | 0.10 |
| LYD265 | Juncea ecotypes vector | Meristem | SPAD | −0.75 | 0.02 |
| LYD266 | Juncea ecotypes vector | Flower | Fresh weight (plot-harvest) [gr/plant] | −0.98 | 5.15E−04 |
| LYD266 | Juncea ecotypes vector | Mature flower | Main branch-average node length | −0.94 | 0.02 |
| LYD266 | Juncea ecotypes vector | Flower | Fresh weight (single plant) [gr/plant] | −0.93 | 0.01 |
| LYD267 | Juncea population densities | meristem | Seed weight/hectare | −0.86 | 0.01 |
| LYD267 | Juncea population densities | meristem | Dry weight/hectare | −0.85 | 0.02 |
| LYD267 | Juncea ecotypes vector | Flower | Main branch-20th length | −0.82 | 0.05 |
| LYD268 | Juncea ecotypes vector | Mature flower | Lateral branch-20th length | −0.98 | 4.50E−03 |
| LYD268 | Juncea ecotypes vector | Mature flower | 1000 Seeds [gr] | −0.95 | 0.01 |
| LYD268 | Juncea population densities | meristem | Lateral branch-20th length | −0.89 | 0.01 |
| LYD269 | Juncea ecotypes vector | Mature flower | Fresh weight (plot-harvest) [gr/plant] | −0.71 | 0.18 |
| LYD269 | Juncea population densities | meristem | Min-Lateral branch position | −0.71 | 0.07 |
| LYD269 | Juncea ecotypes vector | Leaf | Lateral branch-20th length | 0.70 | 0.02 |
| LYD270 | Juncea population densities | flower | Number of lateral branches | −0.92 | 0.03 |
| LYD270 | Juncea population densities | flower | Min-Lateral branch position | −0.91 | 0.03 |
| LYD270 | Juncea population densities | flower | Min-Lateral branch position | −0.85 | 0.07 |
| LYD271 | Juncea population densities | flower | Seed weight/hectare | −0.92 | 0.03 |
| LYD271 | Juncea ecotypes vector | Leaf | Min-Lateral branch position | −0.90 | 4.47E−04 |
| LYD271 | Juncea population densities | meristem | Main branch-dist. 1-20 | −0.88 | 0.01 |
| LYD273 | Juncea ecotypes vector | Mature flower | Lateral branch-20th length | −0.98 | 2.82E−03 |
| LYD273 | Juncea population densities | flower | Max-Number of nodes in lateral branch | −0.91 | 0.03 |
| LYD273 | Juncea population densities | flower | Lateral branch-total number of pods | −0.88 | 0.05 |
| LYD275 | Juncea population densities | flower | Fresh weight (at harvest)/plant | −0.96 | 0.01 |

TABLE 26-continued

Correlation analyses

| Gene Name | Vector Set | Expression Set | Correlation Vector | R | P |
|---|---|---|---|---|---|
| LYD275 | Juncea population densities | flower | Dry weight/plant | −0.96 | 0.01 |
| LYD275 | Juncea population densities | flower | Seed weight/plant | −0.95 | 0.01 |
| LYD276 | Juncea population densities | meristem | Main branch-dist. 1-20 | −0.92 | 3.81E−03 |
| LYD276 | Juncea ecotypes vector | Mature flower | Lateral branch-20th length | −0.92 | 0.03 |
| LYD276 | Juncea population densities | meristem | Lateral branch-20th length | −0.90 | 0.01 |
| LYD278 | Juncea ecotypes vector | Mature flower | Main branch-20th length | −0.98 | 3.28E−03 |
| LYD278 | Juncea population densities | flower | Main branch base diameter [mm] | −0.98 | 4.41E−03 |
| LYD278 | Juncea population densities | flower | Main branch base diameter [mm] | −0.97 | 0.01 |
| LYD279 | Juncea population densities | meristem | Main branch-20th length | −0.98 | 1.19E−04 |
| LYD279 | Juncea population densities | flower | days till bolting | −0.94 | 0.02 |
| LYD279 | Juncea ecotypes vector | Mature flower | Oil content | −0.93 | 0.02 |
| LYD282 | Juncea ecotypes vector | Mature flower | Main branch-average node length | −0.99 | 1.73E−03 |
| LYD282 | Juncea ecotypes vector | Mature flower | Main branch-average node length | −0.98 | 2.52E−03 |
| LYD282 | Juncea ecotypes vector | Mature flower | Main branch-average node length | −0.98 | 4.09E−03 |
| LYD283 | Juncea population densities | flower | Main branch-total number of pods | −0.99 | 9.63E−04 |
| LYD283 | Juncea ecotypes vector | Mature flower | Main branch-average node length | −0.94 | 0.02 |
| LYD283 | Juncea population densities | meristem | Main branch-20th length | −0.91 | 4.46E−03 |
| LYD285 | Juncea ecotypes vector | Mature flower | Main branch-20th length | −1.00 | 3.85E−04 |
| LYD285 | Juncea population densities | flower | days till bolting | −0.97 | 0.01 |
| LYD285 | Juncea ecotypes vector | Mature flower | Main branch-20th length | −0.93 | 0.02 |
| LYD286 | Juncea population densities | flower | 1000Seeds [gr] | −1.00 | 1.73E−05 |
| LYD286 | Juncea ecotypes vector | Flower | Oil content | −0.95 | 3.31E−03 |
| LYD286 | Juncea population densities | flower | Max-Lateral branch position | 0.90 | 0.04 |
| LYD287 | Arabidopsis 2 | leaf | N 1.5 mM seed yield/spad | −0.99 | 1.85E−03 |
| LYD287 | Arabidopsis 2 | leaf | N 6 mMSpad/FW | −0.98 | 4.23E−03 |
| LYD287 | Arabidopsis 2 | leaf | N 6 mM spad/DW (gN/g plant) | −0.96 | 0.01 |
| LYD288 | Juncea population densities | meristem | Min-Lateral branch position | −0.87 | 0.01 |
| LYD288 | Juncea ecotypes vector | Meristem | SPAD | −0.87 | 2.28E−03 |
| LYD288 | Juncea ecotypes vector | Leaf | Seed weight per plant | −0.85 | 1.74E−03 |
| LYD3 | Arabidopsis 2 | stem | N 1.5 mM seed yield/spad | −0.98 | 4.15E−03 |
| LYD3 | Arabidopsis 2 | leaf | N 1.5 mM seed yield/spad | −0.93 | 0.02 |
| LYD3 | Arabidopsis 2 | stem | N 1.5 mM SPAD/DW | −0.90 | 0.04 |
| LYD33 | Tomato vectors field Normal | flower | FW/Plant (Normal) | −0.79 | 0.01 |
| LYD33 | Tomato vectors field Normal | flower | FW/Plant (Normal) | −0.72 | 0.02 |
| LYD33 | Tomato vectors field Normal | flower | average red fruit weight (Normal) | 0.70 | 0.02 |
| LYD34 | Tomato vectors bath Salinity | leaf | Plant biomass NaCl | −0.84 | 2.15E−03 |
| LYD34 | Tomato vectors bath Salinity | leaf | Plant biomass NaCl | −0.83 | 3.15E−03 |
| LYD34 | Tomato vectors field Normal | leaf | Weight Flower clusters (Normal) | 0.71 | 0.02 |

TABLE 26-continued

Correlation analyses

| Gene Name | Vector Set | Expression Set | Correlation Vector | R | P |
|---|---|---|---|---|---|
| LYD35 | Tomato vectors bath Salinity | leaf | Plant biomass NaCl | −0.82 | 3.39E−03 |
| LYD35 | Tomato vectors field Normal | leaf | Fruit yield/Plant (Normal) | 0.71 | 0.02 |
| LYD35 | Tomato vectors field Normal | leaf | Fruit yield/Plant (Normal) | 0.72 | 0.02 |
| LYD36 | Tomato vectors field Drought | flower | FW drought/Normal | 0.71 | 0.02 |
| LYD36 | Tomato vectors field Normal | leaf | average red fruit weight (Normal) | 0.71 | 0.02 |
| LYD36 | Tomato vectors field Drought | flower | FW/Plant Drought | 0.72 | 0.02 |
| LYD37 | Tomato vectors field Drought | flower | FW/Plant Drought | 0.73 | 0.02 |
| LYD37 | Tomato vectors field Normal | flower | average red fruit weight (Normal) | 0.73 | 0.02 |
| LYD37 | Tomato vectors field Normal | leaf | Weight Flower clusters (Normal) | 0.74 | 0.02 |
| LYD38 | Tomato vectors field Normal | leaf | average red fruit weight (Normal) | 0.70 | 0.02 |
| LYD38 | Tomato vectors field Normal | flower | Weight Flower clusters (Normal) | 0.70 | 0.02 |
| LYD38 | Tomato vectors field Normal | leaf | Weight Flower clusters (Normal) | 0.72 | 0.02 |
| LYD4 | Arabidopsis 2 NUE | stem | N 6 mM t50 Flowering | −0.81 | 0.01 |
| LYD4 | Arabidopsis 2 NUE | stem | N 1.5 mM Seed yield reduction compared to 6 mM | −0.73 | 0.03 |
| LYD4 | Arabidopsis 2 NUE | stem | N 1.5 mM t50 Flowering | −0.73 | 0.03 |
| LYD40 | Tomato vectors bath Normal | leaf | leaf No Normal | 0.70 | 0.05 |
| LYD40 | Tomato vectors field Drought | leaf | Num of Flower Drought/Normal | 0.72 | 0.02 |
| LYD40 | Tomato vectors field Normal | leaf | Weight Flower clusters (Normal) | 0.80 | 0.01 |
| LYD41 | Tomato vectors field Drought | flower | FW/Plant Drought | 0.77 | 0.01 |
| LYD41 | Tomato vectors field Normal | flower | average red fruit weight (Normal) | 0.78 | 0.01 |
| LYD41 | Tomato vectors field Drought | flower | FW drought/Normal | 0.83 | 2.70E−03 |
| LYD42 | Tomato vectors bath Salinity | leaf | LeafNo NaCl/Normal | −0.80 | 0.01 |
| LYD42 | Tomato vectors field Drought | leaf | FW/Plant Drought | 0.71 | 0.02 |
| LYD42 | Tomato vectors field Drought | flower | Num of flowers (Drought) | 0.72 | 0.02 |
| LYD43 | Tomato vectors field Drought | flower | FW drought/Normal | 0.70 | 0.02 |
| LYD43 | Tomato vectors field Normal | flower | average red fruit weight (Normal) | 0.73 | 0.02 |
| LYD43 | Tomato vectors field Normal | leaf | Weight Flower clusters (Normal) | 0.74 | 0.02 |
| LYD44 | Tomato vectors field Normal | leaf | Fruit yield/Plant (Normal) | 0.72 | 0.02 |
| LYD44 | Tomato vectors field Drought | leaf | flower cluster weight Drought/NUE | 0.83 | 2.79E−03 |
| LYD44 | Tomato vectors field Drought | leaf | Weight flower clusters (Drought) | 0.84 | 2.55E−03 |
| LYD45 | Tomato vectors bath Normal | leaf | Plant height Normal | 0.71 | 0.05 |
| LYD45 | Tomato vectors field Normal | flower | average red fruit weight (Normal) | 0.74 | 0.01 |
| LYD45 | Tomato vectors bath Normal | root | leaf No Normal | 0.76 | 0.03 |
| LYD47 | Tomato vectors bath Salinity | leaf | Plant Height NaCl/NUE | 0.71 | 0.02 |
| LYD47 | Tomato vectors bath Salinity | leaf | Plant Height NaCl/NUE | 0.72 | 0.02 |
| LYD47 | Tomato vectors field Normal | leaf | average red fruit weight (Normal) | 0.72 | 0.02 |
| LYD48 | Tomato vectors field Normal | flower | average red fruit weight (Normal) | 0.75 | 0.01 |
| LYD48 | Tomato vectors field Normal | flower | average red fruit weight (Normal) | 0.78 | 0.01 |

TABLE 26-continued

Correlation analyses

| Gene Name | Vector Set | Expression Set | Correlation Vector | R | P |
|---|---|---|---|---|---|
| LYD48 | Tomato vectors field Normal | leaf | Fruit yield/Plant (Normal) | 0.84 | 2.27E−03 |
| LYD49 | Tomato vectors bath Salinity | leaf | LeafNo NaCl/Normal | −0.79 | 0.01 |
| LYD49 | Tomato vectors bath Salinity | leaf | LeafNo NaCl/Normal | −0.78 | 0.01 |
| LYD49 | Tomato vectors field Normal | leaf | Weight Flower clusters (Normal) | 0.71 | 0.02 |
| LYD5 | Arabidopsis 1 | seed5daf | root length day 7 | −0.96 | 7.18E−04 |
| LYD5 | Arabidopsis 2 | leaf | N 1.5 mM DW/SPAD | −0.95 | 0.01 |
| LYD5 | Arabidopsis 2 | stem | N 1.5 mM seed yield/spad | −0.95 | 0.01 |
| LYD50 | Tomato vectors field Normal | flower | FW/Plant (Normal) | −0.71 | 0.02 |
| LYD50 | Tomato vectors field Drought | leaf | FW drought/Normal | 0.71 | 0.02 |
| LYD50 | Tomato vectors field Drought | flower | FW/Plant Drought | 0.71 | 0.02 |
| LYD51 | Tomato vectors field Drought | leaf | FW drought/Normal | 0.70 | 0.02 |
| LYD51 | Tomato vectors field Normal | leaf | Weight Flower clusters (Normal) | 0.71 | 0.02 |
| LYD51 | Tomato vectors bath Salinity | leaf | Plant Height NaCl/NUE | 0.75 | 0.01 |
| LYD52 | Tomato vectors bath Normal | leaf | SPAD Normal | −0.78 | 0.02 |
| LYD52 | Tomato vectors field Drought | leaf | Num of Flower Drought/Normal | 0.72 | 0.02 |
| LYD52 | Tomato vectors field Normal | flower | average red fruit weight (Normal) | 0.73 | 0.02 |
| LYD53 | Tomato vectors field Drought | leaf | Fruit Yield Drought/Normal | −0.70 | 0.02 |
| LYD53 | Tomato vectors field Normal | leaf | Fruit yield/Plant (Normal) | 0.71 | 0.02 |
| LYD53 | Tomato vectors field Drought | leaf | flower cluster weight Drought/NUE | 0.72 | 0.02 |
| LYD55 | Tomato vectors field Normal | flower | average red fruit weight (Normal) | 0.73 | 0.02 |
| LYD55 | Tomato vectors field Normal | leaf | average red fruit weight (Normal) | 0.78 | 0.01 |
| LYD55 | Tomato vectors field Normal | leaf | Weight Flower clusters (Normal) | 0.78 | 0.01 |
| LYD57 | Tomato vectors bath Salinity | root | Plant biomass NaCl | −0.74 | 0.01 |
| LYD57 | Tomato vectors field Normal | leaf | average red fruit weight (Normal) | 0.71 | 0.02 |
| LYD57 | Tomato vectors field Normal | flower | average red fruit weight (Normal) | 0.73 | 0.02 |
| LYD58 | Tomato vectors field Normal | flower | Fruit yield/Plant (Normal) | 0.74 | 0.02 |
| LYD58 | Tomato vectors field Drought | flower | Num of Flower Drought/Normal | 0.77 | 0.01 |
| LYD58 | Tomato vectors field Drought | flower | Num of Flower Drought/Normal | 0.78 | 0.01 |
| LYD59 | Tomato vectors bath Normal | leaf | Plant height Normal | −0.80 | 0.02 |
| LYD59 | Tomato vectors field Normal | flower | Fruit yield/Plant (Normal) | 0.74 | 0.02 |
| LYD59 | Tomato vectors field Drought | flower | Num of Flower Drought/Normal | 0.74 | 0.01 |
| LYD6 | Arabidopsis 2 | stem | N 1.5 mM seed yield/spad | −0.97 | 0.01 |
| LYD6 | Arabidopsis 2 | stem | N 6 mM Seed yield/N unit | −0.96 | 0.01 |
| LYD6 | Arabidopsis 2 | leaf | N 6 mM Seed yield/N unit | −0.91 | 0.03 |
| LYD61 | Tomato vectors field Drought | flower | FW/Plant Drought | 0.70 | 0.02 |
| LYD61 | Tomato vectors field Normal | flower | average red fruit weight (Normal) | 0.74 | 0.01 |
| LYD61 | Tomato vectors bath Normal | leaf | leaf No Normal | 0.76 | 0.03 |
| LYD62 | Tomato vectors field Normal | flower | Fruit yield/Plant (Normal) | 0.77 | 0.01 |

TABLE 26-continued

Correlation analyses

| Gene Name | Vector Set | Expression Set | Correlation Vector | R | P |
|---|---|---|---|---|---|
| LYD62 | Tomato vectors field Normal | flower | average red fruit weight (Normal) | 0.80 | 0.01 |
| LYD63 | Tomato vectors field Normal | flower | Fruit yield/Plant (Normal) | 0.70 | 0.02 |
| LYD63 | Tomato vectors field Normal | flower | Weight Flower clusters (Normal) | 0.71 | 0.02 |
| LYD63 | Tomato vectors field Drought | leaf | Num of Flower Drought/NUE | 0.72 | 0.02 |
| LYD65 | Tomato vectors field Normal | leaf | average red fruit weight (Normal) | 0.71 | 0.02 |
| LYD65 | Tomato vectors field Normal | leaf | Fruit yield/Plant (Normal) | 0.73 | 0.02 |
| LYD66 | Tomato vectors bath Normal | root | leaf No Normal | −0.81 | 0.02 |
| LYD66 | Tomato vectors field Drought | leaf | FW/Plant Drought | 0.70 | 0.02 |
| LYD66 | Tomato vectors field Normal | flower | average red fruit weight (Normal) | 0.72 | 0.02 |
| LYD67 | Tomato vectors bath Normal | leaf | leaf No Normal | 0.73 | 0.04 |
| LYD67 | Tomato vectors bath Normal | root | leaf No Normal | 0.81 | 0.02 |
| LYD67 | Tomato vectors field Normal | flower | average red fruit weight (Normal) | 0.84 | 2.62E−03 |
| LYD69 | *Arabidopsis* 2 NUE | stem | N 1.5 mM Rosette Area 10 day | −0.88 | 1.64E−03 |
| LYD69 | *Arabidopsis* 2 NUE | leaf | N 1.5 mM t50 Flowering | −0.88 | 8.38E−04 |
| LYD69 | *Arabidopsis* 2 NUE | leaf | N 1.5 mM Seed yield reduction compared to 6 mM | −0.85 | 1.64E−03 |
| LYD7 | *Arabidopsis* 2 | stem | N 1.5 mM seed yield/spad | −0.88 | 0.05 |
| LYD7 | *Arabidopsis* 2 | leaf | N 1.5 mM SPAD/DW | −0.79 | 0.11 |
| LYD7 | *Arabidopsis* 2 NUE | stem | N 1.5 mM Biomass reduction compared to 6 mM | −0.74 | 0.02 |
| LYD73 | Tomato vectors bath Salinity | leaf | LeafNo NaCl/Normal | −0.84 | 2.20E−03 |
| LYD73 | Tomato vectors bath Salinity | leaf | LeafNo NaCl/Normal | −0.79 | 0.01 |
| LYD73 | Tomato vectors bath Salinity | leaf | leaf No NaCl | −0.75 | 0.01 |
| LYD74 | Tomato vectors bath Salinity | root | Plant height NaCl | −0.83 | 2.69E−03 |
| LYD74 | Tomato vectors field Normal | leaf | average red fruit weight (Normal) | 0.72 | 0.02 |
| LYD74 | Tomato vectors field Normal | flower | average red fruit weight (Normal) | 0.73 | 0.02 |
| LYD75 | Tomato vectors bath Salinity | leaf | LeafNo NaCl/Normal | −0.72 | 0.02 |
| LYD75 | Tomato vectors bath Salinity | leaf | LeafNo NaCl/Nue | −0.70 | 0.02 |
| LYD75 | Tomato vectors field Normal | flower | Fruit yield/Plant (Normal) | 0.71 | 0.02 |
| LYD76 | Tomato vectors bath Salinity | root | Plant biomass NaCl | −0.73 | 0.02 |
| LYD76 | Tomato vectors bath Salinity | leaf | Plant Height NaCl/NUE | 0.71 | 0.02 |
| LYD76 | Tomato vectors field Drought | leaf | FW drought/Normal | 0.75 | 0.01 |
| LYD80 | *Arabidopsis* 2 | leaf | N 1.5 mM SPAD/DW | −0.85 | 0.07 |
| LYD80 | *Arabidopsis* 2 | leaf | N 1.5 mM SPAD/DW | −0.83 | 0.08 |
| LYD80 | *Arabidopsis* 2 NUE | leaf | N 1.5 mM t50 Flowering | −0.82 | 3.45E−03 |
| LYD82 | Tomato vectors field Drought | leaf | Num of Flower Drought/NUE | −0.73 | 0.02 |
| LYD82 | Tomato vectors field Normal | flower | average red fruit weight (Normal) | 0.71 | 0.02 |
| LYD82 | Tomato vectors bath Normal | leaf | leaf No Normal | 0.73 | 0.04 |
| LYD84 | *Arabidopsis* 2 NUE | stem | N 1.5 mM Rosette Area 8 day | −0.82 | 0.01 |
| LYD84 | *Arabidopsis* 2 NUE | stem | N 1.5 mM Leaf Blade Area 10 day | −0.75 | 0.02 |
| LYD84 | *Arabidopsis* 2 NUE | stem | N 1.5 mM seed yield per leaf blead | 0.70 | 0.02 |
| LYD85 | *Arabidopsis* 2 NUE | stem | N 1.5 mM Seed yield reduction compared to 6 mM | −0.81 | 0.01 |

TABLE 26-continued

Correlation analyses

| Gene Name | Vector Set | Expression Set | Correlation Vector | R | P |
|---|---|---|---|---|---|
| LYD85 | Arabidopsis 2 NUE | stem | N 6 mM t50 Flowering | −0.78 | 0.01 |
| LYD85 | Arabidopsis 1 | root | Lamina length | −0.78 | 0.02 |
| LYD86 | Arabidopsis 2 | leaf | N 6 mMSpad/FW | −0.98 | 4.21E−03 |
| LYD86 | Arabidopsis 2 | leaf | N 6 mM spad/DW (gN/g plant) | −0.92 | 0.03 |
| LYD86 | Arabidopsis 2 | leaf | N 1.5 mM Spad/FW | −0.88 | 0.05 |
| LYD87 | Tomato vectors bath Salinity | leaf | Plant Height NaCl/NUE | 0.70 | 0.02 |
| LYD87 | Tomato vectors bath Normal | leaf | leaf No Normal | 0.72 | 0.05 |
| LYD87 | Tomato vectors field Drought | leaf | FW/Plant Drought | 0.76 | 0.01 |
| LYD88 | Arabidopsis 2 | leaf | N 1.5 mM seed yield/spad | −0.73 | 0.16 |
| LYD88 | Arabidopsis 1 | seed5daf | Total Leaf Area per plant | −0.71 | 0.08 |
| LYD88 | Arabidopsis 2 | stem | N 1.5 mM seed yield/spad | −0.71 | 0.18 |
| LYD89 | Arabidopsis 2 NUE | stem | N 6 mM Seed Yield | 0.71 | 0.02 |
| LYD89 | Arabidopsis 2 NUE | leaf | N 6 mM Seed Yield | 0.72 | 0.02 |
| LYD89 | Arabidopsis 2 NUE | stem | N 1.5 mM RGR of Rosette Area 3 day | 0.72 | 0.03 |
| LYD9 | Arabidopsis 1 | leaf | Harvest Index | −0.95 | 3.37E−04 |
| LYD9 | Arabidopsis 1 | flower | Harvest Index | −0.91 | 1.68E−03 |
| LYD9 | Arabidopsis 1 | root | Harvest Index | −0.90 | 2.07E−03 |
| LYD90 | Arabidopsis 2 | leaf | N 6 mM spad/DW (gN/g plant) | −0.91 | 0.03 |
| LYD90 | Arabidopsis 2 | leaf | N 6 mM spad/DW (gN/g plant) | −0.88 | 0.05 |
| LYD90 | Arabidopsis 2 | leaf | N 1.5 mM Spad/FW | −0.85 | 0.07 |
| LYD91 | Tomato vectors bath Normal | root | SPAD Normal | −0.74 | 0.03 |
| LYD91 | Tomato vectors field Normal | leaf | Weight Flower clusters (Normal) | 0.87 | 1.11E−03 |
| LYD91 | Tomato vectors field Normal | leaf | Weight Flower clusters (Normal) | 0.92 | 1.48E−04 |
| LYD92 | Arabidopsis 2 | stem | N 6 mMDW/SPAD (biomas/Nunit) | −0.91 | 0.03 |
| LYD92 | Arabidopsis 2 | leaf | N 6 mMDW/SPAD (biomas/Nunit) | −0.88 | 0.05 |
| LYD92 | Arabidopsis 1 | flower | Vegetative growth rate | −0.80 | 0.02 |
| LYD94 | Arabidopsis 2 | stem | N 6 mM Seed yield/N unit | −0.78 | 0.12 |
| LYD94 | Arabidopsis 2 | leaf | N 6 mM Seed yield/N unit | −0.73 | 0.16 |
| LYD94 | Arabidopsis 2 | leaf | N 6 mM Seed yield/N unit | −0.72 | 0.17 |
| LYD95 | Arabidopsis 2 | leaf | N 1.5 mM DW/SPAD | −0.86 | 0.06 |
| LYD95 | Arabidopsis 2 | leaf | N 1.5 mM DW/SPAD | −0.86 | 0.06 |
| LYD95 | Arabidopsis 2 | stem | N 1.5 mM DW/SPAD | −0.86 | 0.06 |
| LYD96 | Arabidopsis 2 | stem | N 1.5 mM seed yield/spad | −0.87 | 0.05 |
| LYD96 | Arabidopsis 2 | stem | N 6 mM Seed yield/N unit | −0.86 | 0.06 |
| LYD96 | Arabidopsis 2 | leaf | N 1.5 mM DW/SPAD | −0.84 | 0.07 |
| LYD97 | Arabidopsis 2 NUE | leaf | N 1.5 mM Dry Weight | −0.83 | 2.85E−03 |
| LYD97 | Arabidopsis 2 | stem | N 1.5 mM DW/SPAD | −0.82 | 0.09 |
| LYD97 | Arabidopsis 2 NUE | leaf | N 1.5 mM Dry Weight | −0.81 | 4.94E−03 |
| LYD99 | Arabidopsis 2 | leaf | N 1.5 mM Spad/FW | −0.92 | 0.03 |
| LYD99 | Arabidopsis 2 | leaf | N 6 mM spad/DW (gN/g plant) | −0.77 | 0.13 |
| LYD99 | Arabidopsis 2 | leaf | N 6 mM Spad/FW | −0.75 | 0.15 |
| LYD119_H36 | Vectors Sorghum Field Normal | flag leaf | Average Seed Area cm2-normal | 0.872264 | 0.00216 |
| LYD119 H36 | Vectors Sorghum Field Normal | flag leaf | Average Seed Area cm2-normal | 0.834752 | 0.005118 |
| LYD119_H36 | Vectors Sorghum Field Normal | flag leaf | Average Seed Length cm-normal | 0.794902 | 0.010459 |
| LYD119_H36 | Vectors Sorghum Field Normal | flower | Average Seed Area cm2-normal | 0.783305 | 0.012525 |
| LYD119_H36 | Vectors Sorghum Field Normal | flower | Average Seed Area__cm2-normal | 0.781653 | 0.01284 |
| LYD119_H36 | Vectors Sorghum Field Normal | Flag leaf | Average Seed Length cm-normal | 0.760239 | 0.017416 |
| LYD119_H36 | Vectors Sorghum Field Normal | flower | Average Seed Length cm-normal | 0.751083 | 0.019664 |

TABLE 26-continued

Correlation analyses

| Gene Name | Vector Set | Expression Set | Correlation Vector | R | P |
|---|---|---|---|---|---|
| LYD119_H36 | Vectors *Sorghum* Field Normal | flower | Average Seed Length cm-normal | 0.750346 | 0.019853 |
| LYD119_H36 | Vectors *Sorghum* Field NUE | Flag leaf | FW/Plant gr based on plot-NUE | 0.704512 | 0.022922 |
| LYD148_H9 | Vectors *Sorghum* Field Normal | flower | Average Seed Area cm2-normal | 0.802856 | 0.009183 |
| LYD148_H9 | Vectors *Sorghum* Field Normal | flower | Average Seed Length cm-normal | 0.7751 | 0.014142 |
| LYD148_H9 | Vectors *Sorghum* Field Normal | flower | Average Seed Area cm2-normal | 0.752476 | 0.01931 |
| LYD148_H9 | Vectors *Sorghum* Field Normal | flower | Average Seed Length cm-normal | 0.718216 | 0.0293 |
| LYD196_H4 | Vectors *Sorghum* Field NUE | flower meristem | FW/Plant gr based on plot-NUE | 0.717177 | 0.019566 |
| LYD196_H4 | Vectors *Sorghum* Field Normal | flower meristem | Total Seed Weight/Head gr based on 5 heads-normal | 0.715781 | 0.030116 |
| LYD196_H4 | Vectors *Sorghum* Field Normal | flower meristem | Total Seed Weight/Head gr based on plot-normal | 0.71153 | 0.031578 |
| LYD128_H9 | Vectors *Sorghum* Field Normal | flower meristem | FW Head/Plant gr based on plot-normal | 0.857557 | 0.003116 |
| LYD128_H9 | Vectors *Sorghum* Field NUE | flower meristem | FW/Plant gr based on plot-NUE | 0.817108 | 0.0039 |
| LYD128_H9 | Vectors *Sorghum* Field NUE | flag leaf | Upper Ratio Average Seed Area-NUE | 0.751105 | 0.012277 |
| LYD128_H9 | Vectors *Sorghum* Field Normal | flower meristem | NUpE [biomass/SPAD](NORMAL) | 0.745956 | 0.013234 |
| LYD128_H9 | Vectors *Sorghum* Field Normal | flower meristem | NUE2 (total biomass/SPAD) (Normal) | 0.74293 | 0.013821 |
| LYD128_H9 | Vectors *Sorghum* Field NUE | flower meristem | Lower Ratio Average Seed Area-NUE | 0.724484 | 0.017794 |
| LYD128_H9 | Vectors *Sorghum* Field NUE | flower meristem | NUE2 (total biomass/SPAD) (Low N) | 0.719047 | 0.019102 |
| LYD238_H8 | Vectors *Sorghum* Field NUE | flower meristem | Leaf SPAD 64 Days Post Sowing-NUE | 0.903146 | 0.000342 |
| LYD238_H8 | Vectors *Sorghum* Field Normal | flower meristem | Total Seed Weight/Head gr based on plot-normal | 0.720223 | 0.028638 |
| LYD238_H8 | Vectors *Sorghum* Field Normal | flower meristem | NUpE [biomass/SPAD](NORMAL) | 0.710718 | 0.021232 |
| LYD238_H8 | Vectors *Sorghum* Field Normal | flower meristem | NUE [yield/SPAD](NORMAL) | 0.701844 | 0.023676 |
| LYD238_H9 | Vectors *Sorghum* Field NUE | flag leaf | Upper Ratio Average Seed Area-NUE | 0.818415 | 0.003797 |
| LYD238_H9 | Vectors *Sorghum* Field Normal | flower meristem | FW Head/Plant gr based on plot-normal | 0.817259 | 0.007148 |
| LYD238_H9 | Vectors *Sorghum* Field Normal | flower meristem | NUE2 (total biomass/SPAD) (Normal) | 0.800525 | 0.005403 |
| LYD238_H9 | Vectors *Sorghum* Field Normal | flower meristem | NUpE [biomass/SPAD](NORMAL) | 0.771903 | 0.008899 |
| LYD238_H9 | Vectors *Sorghum* Field Normal | flower meristem | Total Seed Weight/Head gr based on plot-normal | 0.749855 | 0.01998 |
| LYD238_H9 | Vectors *Sorghum* Field NUE | flower meristem | Average Seed Perimeter cm-NUE | 0.743576 | 0.013694 |
| LYD238_H9 | Vectors *Sorghum* Field NUE | flower meristem | Average Seed Area cm2-NUE | 0.70978 | 0.021482 |
| LYD194_H113 | Vectors *Sorghum* Field NUE | flower meristem | Average Seed Area cm2-NUE | 0.949658 | 2.64E−05 |
| LYD194_H113 | Vectors *Sorghum* Field NUE | flag leaf | Average Seed Area cm2-NUE | 0.903812 | 0.000333 |
| LYD194_H113 | Vectors *Sorghum* Field NUE | flower meristem | Average Seed Perimeter cm-NUE | 0.901429 | 0.000366 |
| LYD194_H113 | Vectors *Sorghum* Field NUE | flower | Average Seed Area cm2-NUE | 0.898971 | 0.000403 |
| LYD194_H113 | Vectors *Sorghum* Field NUE | flower | Average Seed Perimeter cm-NUE | 0.883792 | 0.000692 |
| LYD194_H113 | Vectors *Sorghum* Field NUE | flower | Average Seed Length cm-NUE | 0.882948 | 0.000711 |
| LYD194_H113 | Vectors *Sorghum* Field NUE | flag leaf | Average Seed Perimeter cm-NUE | 0.860641 | 0.00139 |
| LYD194_H113 | Vectors *Sorghum* Field NUE | flag leaf | Average Seed Length cm-NUE | 0.851382 | 0.001777 |
| LYD194_H113 | Vectors *Sorghum* Field NUE | flower meristem | Average Seed Length cm-NUE | 0.849241 | 0.001876 |

TABLE 26-continued

Correlation analyses

| Gene Name | Vector Set | Expression Set | Correlation Vector | R | P |
|---|---|---|---|---|---|
| LYD194_H113 | Vectors *Sorghum* Field Normal | flower meristem | Average Seed Length cm-normal | 0.819745 | 0.006831 |
| LYD194_H113 | Vectors *Sorghum* Field NUE | flower meristem | Average Seed Width cm-NUE | 0.808261 | 0.004658 |
| LYD194_H113 | Vectors *Sorghum* Field Normal | flower meristem | Average Seed Area cm2-normal | 0.798585 | 0.009854 |
| LYD194_H113 | Vectors *Sorghum* Field Normal | flag leaf | Average Seed Area cm2-normal | 0.768451 | 0.015551 |
| LYD194_H113 | Vectors *Sorghum* Field NUE | flower meristem | Average Seed Perimeter cm-NUE | 0.766791 | 0.009659 |
| LYD194_H113 | Vectors *Sorghum* Field Normal | flag leaf | Average Seed Length cm-normal | 0.759204 | 0.017661 |
| LYD194_H113 | Vectors *Sorghum* Field NUE | flower meristem | Average Seed Area cm2-NUE | 0.724569 | 0.017774 |
| LYD194_H113 | Vectors *Sorghum* Field NUE | flower meristem | Average Seed Length cm-NUE | 0.72005 | 0.018856 |
| LYD194_H113 | Vectors *Sorghum* Field NUE | flag leaf | Average Seed Width cm-NUE | 0.715553 | 0.019976 |
| LYD201_H233 | Vectors *Sorghum* Field NUE | flag leaf | Upper Ratio Average Seed Area-NUE | 0.731792 | 0.016136 |
| LYD201_H235 | Vectors *Sorghum* Field NUE | flower meristem | Average Seed Width cm-NUE | 0.792292 | 0.006284 |
| LYD201_H235 | Vectors *Sorghum* Field NUE | flower meristem | Average Seed Area cm2-NUE | 0.760077 | 0.010726 |
| LYD201_H235 | Vectors *Sorghum* Field NUE | flower meristem | Average Seed Perimeter cm-NUE | 0.735788 | 0.015276 |
| LYD216_H17 | Vectors *Sorghum* Field Normal | flower | Total Seed Weight/Head gr based on 5 heads-normal | 0.840128 | 0.004584 |
| LYD216_H17 | Vectors *Sorghum* Field Normal | flower meristem | NUE [yield/SPAD](NORMAL) | 0.704678 | 0.022876 |
| LYD235_H20 | Vectors *Sorghum* Field NUE | flower | FW Head/Plant gr based on plot-NUE | 0.842782 | 0.002201 |
| LYD235_H20 | Vectors *Sorghum* Field NUE | flower meristem | Average Seed Width cm-NUE | 0.834142 | 0.002696 |
| LYD235_H20 | Vectors *Sorghum* Field Normal | flower meristem | Average Seed Length cm-normal | 0.792999 | 0.010781 |
| LYD235_H20 | Vectors *Sorghum* Field Normal | flower meristem | Average Seed Length cm-normal | 0.792681 | 0.010835 |
| LYD235_H20 | Vectors *Sorghum* Field Normal | flower meristem | Average Seed Area cm2-normal | 0.788256 | 0.011612 |
| LYD235_H20 | Vectors *Sorghum* Field NUE | flag leaf | Total Seed Weight/Head gr based on plot-NUE | 0.780748 | 0.007686 |
| LYD235_H20 | Vectors *Sorghum* Field Normal | flower meristem | Average Seed Area cm2-normal | 0.773497 | 0.014474 |
| LYD235_H20 | Vectors *Sorghum* Field NUE | flag leaf | Total Seed Weight/Head gr based on plot-NUE | 0.759781 | 0.010775 |
| LYD235_H20 | Vectors *Sorghum* Field NUE | flower meristem | Average Seed Width cm-NUE | 0.750737 | 0.012343 |
| LYD235_H20 | Vectors *Sorghum* Field Normal | flag leaf | FW Head/Plant gr based on plot-normal | 0.749956 | 0.019953 |
| LYD235_H20 | Vectors *Sorghum* Field NUE | flag leaf | FW Head/Plant gr based on plot-NUE | 0.733317 | 0.015804 |
| LYD235_H20 | Vectors *Sorghum* Field NUE | flower | Total Seed Weight/Head gr based on 5 heads-NUE | 0.72168 | 0.01846 |
| LYD253_H83 | Vectors *Sorghum* Field NUE | flower meristem | NUpE [biomass/SPAD](Low N) | 0.825415 | 0.003273 |
| LYD253_H83 | Vectors *Sorghum* Field NUE | flower meristem | FW Head/Plant gr based on plot-NUE | 0.822122 | 0.003513 |
| LYD253_H83 | Vectors *Sorghum* Field NUE | flower meristem | NUE2 (total biomass/SPAD) (Low N) | 0.76854 | 0.009394 |
| LYD253_H83 | Vectors *Sorghum* Field NUE | flower meristem | FW/Plant gr based on plot-NUE | 0.727157 | 0.017174 |
| LYD253_H83 | Vectors *Sorghum* Field NUE | flower meristem | FW/Plant gr based on plot-NUE | 0.713731 | 0.020444 |
| LYD253_H83 | Vectors *Sorghum* Field Normal | flower meristem | NUE2 (total biomass/SPAD) (Normal) | 0.71238 | 0.020794 |
| LYD86_H90 | Vectors *Sorghum* Field NUE | flag leaf | FW Heads/(FW Heads + FW Plants) all plot-NUE | 0.87859 | 0.000819 |
| LYD86_H90 | Vectors *Sorghum* Field NUE | flag leaf | FW Head/Plant gr based on plot-NUE | 0.86986 | 0.001069 |
| LYD86_H90 | Vectors *Sorghum* Field NUE | flower meristem | FW Heads/(FW Heads + FW Plants) all plot-NUE | 0.861399 | 0.001361 |

TABLE 26-continued

Correlation analyses

| Gene Name | Vector Set | Expression Set | Correlation Vector | R | P |
|---|---|---|---|---|---|
| LYD86_H90 | Vectors Sorghum Field Normal | flower meristem | Total Seed Weight/Head gr based on plot-normal | 0.852872 | 0.003473 |
| LYD86_H90 | Vectors Sorghum Field NUE | flower meristem | Head Average Perimeter cm-NUE | 0.844364 | 0.002118 |
| LYD86_H90 | Vectors Sorghum Field NUE | flag leaf | NUE2 (total biomass/SPAD) (Low N) | 0.827284 | 0.003143 |
| LYD86_H90 | Vectors Sorghum Field NUE | flower meristem | Head Average Perimeter cm-NUE | 0.820069 | 0.003668 |
| LYD86_H90 | Vectors Sorghum Field NUE | flower meristem | Head Average Length cm-NUE | 0.819341 | 0.003724 |
| LYD86_H90 | Vectors Sorghum Field NUE | flag leaf | NUpE [biomass/SPAD](Low N) | 0.815662 | 0.004018 |
| LYD86_H90 | Vectors Sorghum Field NUE | flower | FW Heads/(FW Heads + FW Plants) all plot-NUE | 0.805569 | 0.004908 |
| LYD86_H90 | Vectors Sorghum Field NUE | flower | NUE2 (total biomass/SPAD) (Low N) | 0.800577 | 0.005397 |
| LYD86_H90 | Vectors Sorghum Field Normal | flower meristem | NUE [yield/SPAD](NORMAL) | 0.794554 | 0.006032 |
| LYD86_H90 | Vectors Sorghum Field NUE | flower meristem | Head Average Area cm2-NUE | 0.785066 | 0.007138 |
| LYD86_H90 | Vectors Sorghum Field NUE | flower | FW Head/Plant gr based on plot-NUE | 0.784583 | 0.007198 |
| LYD86_H90 | Vectors Sorghum Field NUE | flower meristem | Head Average Length cm-NUE | 0.781501 | 0.007588 |
| LYD86_H90 | Vectors Sorghum Field NUE | flower meristem | Total Seed Weight/Head gr based on plot-NUE | 0.768858 | 0.009347 |
| LYD86_H90 | Vectors Sorghum Field NUE | flower | NUE2 (total biomass/SPAD) (Low N) | 0.767357 | 0.009573 |
| LYD86_H90 | Vectors Sorghum Field NUE | flower | FW Head/Plant gr based on plot-NUE | 0.76498 | 0.009939 |
| LYD86_H90 | Vectors Sorghum Field NUE | flower | NUpE [biomass/SPAD](Low N) | 0.759768 | 0.010777 |
| LYD86_H90 | Vectors Sorghum Field NUE | flower | FW Heads/(FW Heads + FW Plants) all plot-NUE | 0.759184 | 0.010874 |
| LYD86_H90 | Vectors Sorghum Field NUE | flower meristem | Head Average Area cm2-NUE | 0.756213 | 0.011376 |
| LYD86_H90 | Vectors Sorghum Field NUE | flower meristem | FW Head/Plant gr based on 5 plants-NUE | 0.747381 | 0.012964 |
| LYD86_H90 | Vectors Sorghum Field Normal | flower meristem | Head Average Length cm-normal | 0.746972 | 0.020734 |
| LYD86_H90 | Vectors Sorghum Field Normal | flower meristem | NUE2 (total biomass/SPAD) (Normal) | 0.745693 | 0.013284 |
| LYD86_H90 | Vectors Sorghum Field NUE | flower meristem | NUE [yield/SPAD](Low N) | 0.730988 | 0.016313 |
| LYD86_H90 | Vectors Sorghum Field NUE | flower meristem | FW Head/Plant gr based on plot-NUE | 0.720473 | 0.018752 |
| LYD86_H90 | Vectors Sorghum Field NUE | flag leaf | FW Head/Plant gr based on plot-NUE | 0.71657 | 0.019719 |
| LYD86_H90 | Vectors Sorghum Field Normal | flower meristem | FW Head/Plant gr based on plot-normal | 0.710562 | 0.031916 |
| LYD86_H90 | Vectors Sorghum Field NUE | flag leaf | FW/Plant gr based on plot-NUE | 0.706497 | 0.022372 |
| LYD86_H91 | Vectors Sorghum Field NUE | flower meristem | NUE2 (total biomass/SPAD) (Low N) | 0.935567 | 6.97E−05 |
| LYD86_H91 | Vectors Sorghum Field NUE | flower meristem | NUpE [biomass/SPAD](Low N) | 0.92457 | 0.000129 |
| LYD86_H91 | Vectors Sorghum Field NUE | flower meristem | FW Head/Plant gr based on plot-NUE | 0.920916 | 0.000155 |
| LYD86_H91 | Vectors Sorghum Field NUE | flower meristem | FW/Plant gr based on plot-NUE | 0.90971 | 0.00026 |
| LYD86_H91 | Vectors Sorghum Field NUE | flower meristem | FW Heads/(FW Heads + FW Plants) all plot-NUE | 0.75019 | 0.012443 |
| LYD86_H91 | Vectors Sorghum Field NUE | flower | NUpE [biomass/SPAD](Low N) | 0.732664 | 0.015946 |
| LYD148 | Vectors Sorghum Field Normal | flag leaf | FW Head/Plant gr based on plot-normal | 0.7631 | 0.01675 |
| LYD148 | Vectors Sorghum Field Normal | flag leaf | FW Head/Plant gr based on 5 plants-normal | 0.713855 | 0.030772 |
| LYD148 | Vectors Sorghum Field NUE | flag leaf | Leaf SPAD 64 Days Post Sowing-NUE | 0.705262 | 0.022712 |
| LYD148 | Vectors Sorghum Field Normal | flag leaf | FW Head/Plant gr based on plot-normal | 0.7631 | 0.01675 |
| LYD148 | Vectors Sorghum Field Normal | flag leaf | FW Head/Plant gr based on 5 plants-normal | 0.713855 | 0.030772 |

TABLE 26-continued

Correlation analyses

| Gene Name | Vector Set | Expression Set | Correlation Vector | R | P |
|---|---|---|---|---|---|
| LYD148 | Vectors *Sorghum* Field NUE | flag leaf | Leaf SPAD 64 Days Post Sowing-NUE | 0.705262 | 0.022712 |
| LYD211 | Vectors *Sorghum* Field NUE | flower meristem | Average Seed Perimeter cm-NUE | 0.806516 | 0.004819 |
| LYD211 | Vectors *Sorghum* Field NUE | flower meristem | Average Seed Perimeter cm-NUE | 0.798386 | 0.005623 |
| LYD211 | Vectors *Sorghum* Field Normal | flower | Total Seed Weight/Head gr based on 5 heads-normal | 0.782852 | 0.012611 |
| LYD211 | Vectors *Sorghum* Field Normal | flower | FW Head/Plant gr based on 5 plants-normal | 0.777638 | 0.013628 |
| LYD211 | Vectors *Sorghum* Field Normal | flag leaf | FW Head/Plant gr based on plot-normal | 0.770563 | 0.015094 |
| LYD211 | Vectors *Sorghum* Field NUE | flower meristem | Average Seed Area cm2-NUE | 0.753009 | 0.011935 |
| LYD211 | Vectors *Sorghum* Field Normal | flower | FW Head/Plant gr based on 5 plants-normal | 0.742574 | 0.02192 |
| LYD211 | Vectors *Sorghum* Field NUE | flower meristem | Average Seed Length cm-NUE | 0.739574 | 0.014492 |
| LYD211 | Vectors *Sorghum* Field NUE | flower meristem | Average Seed Area cm2-NUE | 0.739155 | 0.014577 |
| LYD211 | Vectors *Sorghum* Field NUE | flower meristem | Average Seed Length cm-NUE | 0.737733 | 0.01487 |
| LYD211 | Vectors *Sorghum* Field NUE | flower meristem | Average Seed Perimeter cm-NUE | 0.806516 | 0.004819 |
| LYD211 | Vectors *Sorghum* Field NUE | flower meristem | Average Seed Perimeter cm-NUE | 0.798386 | 0.005623 |
| LYD211 | Vectors *Sorghum* Field Normal | flower | Total Seed Weight/Head gr based on 5 heads-normal | 0.782852 | 0.012611 |
| LYD211 | Vectors *Sorghum* Field Normal | flower | FW Head/Plant gr based on 5 plants-normal | 0.777638 | 0.013628 |
| LYD211 | Vectors *Sorghum* Field Normal | flag leaf | FW Head/Plant gr based on plot-normal | 0.770563 | 0.015094 |
| LYD211 | Vectors *Sorghum* Field NUE | flower meristem | Average Seed Area cm2-NUE | 0.753009 | 0.011935 |
| LYD211 | Vectors *Sorghum* Field Normal | flower | FW Head/Plant gr based on 5 plants-normal | 0.742574 | 0.02192 |
| LYD211 | Vectors *Sorghum* Field NUE | flower meristem | Average Seed Length cm-NUE | 0.739574 | 0.014492 |
| LYD211 | Vectors *Sorghum* Field NUE | flower meristem | Average Seed Area cm2-NUE | 0.739155 | 0.014577 |
| LYD211 | Vectors *Sorghum* Field NUE | flower meristem | Average Seed Length cm-NUE | 0.737733 | 0.01487 |
| LYD227 | Vectors *Sorghum* Field NUE | flag leaf | Total Seed Weight/Head gr based on 5 heads-NUE | 0.870491 | 0.00105 |
| LYD227 | Vectors *Sorghum* Field NUE | flower | Final Plant Height cm-NUE | 0.792586 | 0.006251 |
| LYD227 | Vectors *Sorghum* Field NUE | flag leaf | Total Seed Weight/Head gr based on 5 heads-NUE | 0.768971 | 0.00933 |
| LYD227 | Vectors *Sorghum* Field NUE | flag leaf | FW Head/Plant gr based on plot-NUE | 0.765842 | 0.009805 |
| LYD227 | Vectors *Sorghum* Field Normal | flower | FW Head/Plant gr based on plot-normal | 0.755249 | 0.018619 |
| LYD227 | Vectors *Sorghum* Field NUE | flower | Leaf SPAD 64 Days Post Sowing-NUE | 0.739555 | 0.014496 |
| LYD227 | Vectors *Sorghum* Field NUE | flag leaf | Total Seed Weight/Head gr based on 5 heads-NUE | 0.870491 | 0.00105 |
| LYD227 | Vectors *Sorghum* Field NUE | flower | Final Plant Height cm-NUE | 0.792586 | 0.006251 |
| LYD227 | Vectors *Sorghum* Field NUE | flag leaf | Total Seed Weight/Head gr based on 5 heads-NUE | 0.768971 | 0.00933 |
| LYD227 | Vectors *Sorghum* Field NUE | flag leaf | FW Head/Plant gr based on plot-NUE | 0.765842 | 0.009805 |
| LYD227 | Vectors *Sorghum* Field Normal | flower | FW Head/Plant gr based on plot-normal | 0.755249 | 0.018619 |
| LYD227 | Vectors *Sorghum* Field NUE | flower | Leaf SPAD 64 Days Post Sowing-NUE | 0.739555 | 0.014496 |
| LYD228 | Vectors *Sorghum* Field Normal | flower | FW Head/Plant gr based on 5 plants-normal | 0.873907 | 0.002068 |

TABLE 26-continued

Correlation analyses

| Gene Name | Vector Set | Expression Set | Correlation Vector | R | P |
|---|---|---|---|---|---|
| LYD228 | Vectors *Sorghum* Field Drought | flower meristem | Head Average Length cm-Drought | 0.81557 | 0.004025 |
| LYD228 | Vectors *Sorghum* Field Drought | flower meristem | Head Average Length cm-Drought | 0.81557 | 0.004025 |
| LYD228 | Vectors *Sorghum* Field Normal | flower | Total Seed Weight/Head gr based on plot-normal | 0.776429 | 0.013871 |
| LYD228 | Vectors *Sorghum* Field Normal | flower | Total Seed Weight/Head gr based on 5 heads-normal | 0.744137 | 0.021492 |
| LYD228 | Vectors *Sorghum* Field Normal | flower | Head Average Length cm-normal | 0.739278 | 0.022836 |
| LYD228 | Vectors *Sorghum* Field Drought | flower | Head Average Width cm-Drought | 0.732502 | 0.015981 |
| LYD228 | Vectors *Sorghum* Field Drought | flower | Head Average Width cm-Drought | 0.732502 | 0.015981 |
| LYD228 | Vectors *Sorghum* Field Drought | flower meristem | Head Average Area cm2-Drought | 0.730394 | 0.016445 |
| LYD228 | Vectors *Sorghum* Field Drought | flower meristem | Head Average Area cm2-Drought | 0.730394 | 0.016445 |
| LYD228 | Vectors *Sorghum* Field Drought | flower | Head Average Area cm2-Drought | 0.716072 | 0.019845 |
| LYD228 | Vectors *Sorghum* Field Drought | flower | Head Average Area cm2-Drought | 0.716072 | 0.019845 |
| LYD228 | Vectors *Sorghum* Field NUE | flower meristem | Average Seed Area cm2-NUE | 0.715695 | 0.01994 |
| LYD228 | Vectors *Sorghum* Field NUE | flower meristem | Average Seed Perimeter cm-NUE | 0.70899 | 0.021694 |
| LYD228 | Vectors *Sorghum* Field Normal | flower | FW Head/Plant gr based on 5 plants-normal | 0.873907 | 0.002068 |
| LYD228 | Vectors *Sorghum* Field Drought | flower meristem | Head Average Length cm-Drought | 0.81557 | 0.004025 |
| LYD228 | Vectors *Sorghum* Field Drought | flower meristem | Head Average Length cm-Drought | 0.81557 | 0.004025 |
| LYD228 | Vectors *Sorghum* Field Normal | flower | Total Seed Weight/Head gr based on plot-normal | 0.776429 | 0.013871 |
| LYD228 | Vectors *Sorghum* Field Normal | flower | Total Seed Weight/Head gr based on 5 heads-normal | 0.744137 | 0.021492 |
| LYD228 | Vectors *Sorghum* Field Normal | flower | Head Average Length cm-normal | 0.739278 | 0.022836 |
| LYD228 | Vectors *Sorghum* Field Drought | flower | Head Average Width cm-Drought | 0.732502 | 0.015981 |
| LYD228 | Vectors *Sorghum* Field Drought | flower | Head Average Width cm-Drought | 0.732502 | 0.015981 |
| LYD228 | Vectors *Sorghum* Field Drought | flower meristem | Head Average Area cm2-Drought | 0.730394 | 0.016445 |
| LYD228 | Vectors *Sorghum* Field Drought | flower meristem | Head Average Area cm2-Drought | 0.730394 | 0.016445 |
| LYD228 | Vectors *Sorghum* Field Drought | flower | Head Average Area cm2-Drought | 0.716072 | 0.019845 |
| LYD228 | Vectors *Sorghum* Field Drought | flower | Head Average Area cm2-Drought | 0.716072 | 0.019845 |
| LYD228 | Vectors *Sorghum* Field NUE | flower meristem | Average Seed Area cm2-NUE | 0.715695 | 0.01994 |
| LYD228 | Vectors *Sorghum* Field NUE | flower meristem | Average Seed Perimeter cm-NUE | 0.70899 | 0.021694 |
| LYD229 | Vectors *Sorghum* Field Normal | flag leaf | NUE [yield/SPAD](NORMAL) | 0.708295 | 0.03272 |
| LYD229 | Vectors *Sorghum* Field NUE | flag leaf | Final Plant Height cm-NUE | 0.704432 | 0.022944 |
| LYD229 | Vectors *Sorghum* Field Normal | flag leaf | NUE [yield/SPAD](NORMAL) | 0.708295 | 0.03272 |
| LYD229 | Vectors *Sorghum* Field NUE | flag leaf | Final Plant Height cm-NUE | 0.704432 | 0.022944 |
| LYD230 | Vectors *Sorghum* Field Normal | flag leaf | NUE [yield/SPAD](NORMAL) | 0.759057 | 0.017696 |
| LYD230 | Vectors *Sorghum* Field Normal | flag leaf | NUE [yield/SPAD](NORMAL) | 0.732126 | 0.024914 |
| LYD230 | Vectors *Sorghum* Field Normal | flag leaf | Total Seed Weight/Head gr based on plot-normal | 0.720454 | 0.028562 |
| LYD230 | Vectors *Sorghum* Field Normal | flag leaf | Total Seed Weight/Head gr based on plot-normal | 0.71634 | 0.029928 |
| LYD230 | Vectors *Sorghum* Field Normal | flag leaf | NUE [yield/SPAD](NORMAL) | 0.759057 | 0.017696 |

TABLE 26-continued

Correlation analyses

| Gene Name | Vector Set | Expression Set | Correlation Vector | R | P |
|---|---|---|---|---|---|
| LYD230 | Vectors Sorghum Field Normal | flag leaf | NUE [yield/SPAD](NORMAL) | 0.732126 | 0.024914 |
| LYD230 | Vectors Sorghum Field Normal | flag leaf | Total Seed Weight/Head gr based on plot-normal | 0.720454 | 0.028562 |
| LYD230 | Vectors Sorghum Field Normal | flag leaf | Total Seed Weight/Head gr based on plot-normal | 0.71634 | 0.029928 |
| LYD231 | Vectors Sorghum Field Normal | flag leaf | NUE [yield/SPAD](NORMAL) | 0.824919 | 0.006202 |
| LYD231 | Vectors Sorghum Field Normal | flag leaf | NUE2 (total biomass/SPAD) (Normal) | 0.819131 | 0.006908 |
| LYD231 | Vectors Sorghum Field Normal | flag leaf | NUE2 (total biomass/SPAD) (Normal) | 0.797739 | 0.009991 |
| LYD231 | Vectors Sorghum Field Normal | flag leaf | NUE [yield/SPAD](NORMAL) | 0.769656 | 0.015289 |
| LYD231 | Vectors Sorghum Field Normal | flag leaf | NUpE [biomass/SPAD](NORMAL) | 0.765649 | 0.016171 |
| LYD231 | Vectors Sorghum Field Drought | flower meristem | RGR of Leaf Num-Drought | 0.753255 | 0.03095 |
| LYD231 | Vectors Sorghum Field Drought | flower meristem | RGR of Leaf Num-Drought | 0.751245 | 0.03166 |
| LYD231 | Vectors Sorghum Field Normal | flower | NUpE [biomass/SPAD](NORMAL) | 0.734249 | 0.024284 |
| LYD231 | Vectors Sorghum Field Normal | flag leaf | Total Seed Weight/Head gr based on plot-normal | 0.734102 | 0.024328 |
| LYD231 | Vectors Sorghum Field Normal | flag leaf | NUpE [biomass/SPAD](NORMAL) | 0.729865 | 0.025594 |
| LYD231 | Vectors Sorghum Field Normal | flower | NUE2 (total biomass/SPAD) (Normal) | 0.70267 | 0.034768 |
| LYD231 | Vectors Sorghum Field Normal | flag leaf | NUE [yield/SPAD](NORMAL) | 0.824919 | 0.006202 |
| LYD231 | Vectors Sorghum Field Normal | flag leaf | NUE2 (total biomass/SPAD) (Normal) | 0.819131 | 0.006908 |
| LYD231 | Vectors Sorghum Field Normal | flag leaf | NUE2 (total biomass/SPAD) (Normal) | 0.797739 | 0.009991 |
| LYD231 | Vectors Sorghum Field Normal | flag leaf | NUE [yield/SPAD](NORMAL) | 0.769656 | 0.015289 |
| LYD231 | Vectors Sorghum Field Normal | flag leaf | NUpE [biomass/SPAD](NORMAL) | 0.765649 | 0.016171 |
| LYD231 | Vectors Sorghum Field Drought | flower meristem | RGR of Leaf Num-Drought | 0.753255 | 0.03095 |
| LYD231 | Vectors Sorghum Field Drought | flower meristem | RGR of Leaf Num-Drought | 0.751245 | 0.03166 |
| LYD231 | Vectors Sorghum Field Normal | flower | NUpE [biomass/SPAD](NORMAL) | 0.734249 | 0.024284 |
| LYD231 | Vectors Sorghum Field Normal | flag leaf | Total Seed Weight/Head gr based on plot-normal | 0.734102 | 0.024328 |
| LYD231 | Vectors Sorghum Field Normal | flag leaf | NUpE [biomass/SPAD](NORMAL) | 0.729865 | 0.025594 |
| LYD231 | Vectors Sorghum Field Normal | flower | NUE2 (total biomass/SPAD) (Normal) | 0.70267 | 0.034768 |
| LYD119_H22 | Vectors Maize Normal | Grain Distal R4-R5 | Normal-Seed yield per dunam [kg] | 0.8712 | 0.0048 |
| LYD119_H22 | Vectors Maize Normal | Grain Distal R4-R5 | Normal-seed yield per 1 plant rest of the plot [0-RH in Kg] | 0.8712 | 0.0048 |
| LYD119_H22 | Vectors Maize Normal | Grain Distal R4-R5 | Normal-NUE yield kg/N applied in soil kg | 0.8712 | 0.0048 |
| LYD119_H22 | Vectors Maize Normal | Grain Distal R4-R5 | Normal-Ear weight per plot (42 plants per plot) [0-RH] | 0.8457 | 0.0082 |
| LYD119_H22 | Vectors Maize Normal | Grain Distal R4-R5 | Normal-Ear with mm | 0.8237 | 0.0120 |
| LYD119_H22 | Vectors Maize Normal | Grain Distal R4-R5 | Normal-NUE at early grain filling [R1-R2] yield Kg/N in plant SPAD | 0.8124 | 0.0143 |

TABLE 26-continued

Correlation analyses

| Gene Name | Vector Set | Expression Set | Correlation Vector | R | P |
|---|---|---|---|---|---|
| LYD119_H22 | Vectors Maize Normal | Grain Distal R4-R5 | Normal-Yield/stalk width | 0.7881 | 0.0202 |
| LYD119_H22 | Vectors Maize Normal | Grain Distal R4-R5 | Normal-Ear weight per plot (42 plants per plot) [0-RH] | 0.7863 | 0.0207 |
| LYD119_H22 | Vectors Maize Normal | Grain Distal R4-R5 | Normal-Yield/LAI | 0.7758 | 0.0236 |
| LYD119_H22 | Vectors Maize Normal | Grain Distal R4-R5 | Normal-SPAD 10.8.09 | 0.7659 | 0.0267 |
| LYD119_H22 | Vectors Maize Normal | Grain Distal R4-R5 | Normal-NUE at grain filling [R3-R4] yield Kg/N in plant SPAD | 0.7624 | 0.0278 |
| LYD119_H22 | Vectors Maize Normal | Grain Distal R4-R5 | Normal-SPAD 10.8.09 | 0.7556 | 0.0301 |
| LYD119_H22 | Vectors Maize Normal | Grain Distal R4-R5 | Normal-Plant Height 03.08.09 | 0.7449 | 0.0340 |
| LYD119_H22 | Vectors Maize Normal | Grain Distal R4-R5 | Normal-Seed yield per dunam [kg] | 0.7423 | 0.0349 |
| LYD119_H22 | Vectors Maize Normal | Grain Distal R4-R5 | Normal-NUE yield kg/N applied in soil kg | 0.7423 | 0.0349 |
| LYD119_H22 | Vectors Maize Normal | Grain Distal R4-R5 | Normal-seed yield per 1 plant rest of the plot [0-RH in Kg] | 0.7423 | 0.0349 |
| LYD119_H22 | Vectors Maize Normal | Grain Distal R4-R5 | Normal-No of rows per ear | 0.7197 | 0.0441 |
| LYD119_H22 | Vectors Maize Normal | Internode V6-V8 | Normal-Plant Height 03.08.09 | 0.7138 | 0.0308 |
| LYD119_H22 | Vectors Maize Normal | Internode V6-V8 | Normal-Final Leaf Number | 0.7123 | 0.0313 |
| LYD119_H22 | Vectors Maize Normal | Grain Distal R4-R5 | Normal-Seed yield per dunam [kg] | 0.8712 | 0.0048 |
| LYD119_H22 | Vectors Maize Normal | Grain Distal R4-R5 | Normal-seed yield per 1 plant rest of the plot [0-RH in Kg] | 0.8712 | 0.0048 |
| LYD119_H22 | Vectors Maize Normal | Grain Distal R4-R5 | Normal-NUE yield kg/N applied in soil kg | 0.8712 | 0.0048 |
| LYD119_H22 | Vectors Maize Normal | Grain Distal R4-R5 | Normal-Ear weight per plot (42 plants per plot) [0-RH] | 0.8457 | 0.0082 |
| LYD119_H22 | Vectors Maize Normal | Grain Distal R4-R5 | Normal-Ear with mm | 0.8237 | 0.0120 |
| LYD119_H22 | Vectors Maize Normal | Grain Distal R4-R5 | Normal-NUE at early grain filling [R1-R2] yield Kg/N in plant SPAD | 0.8124 | 0.0143 |
| LYD119_H22 | Vectors Maize Normal | Grain Distal R4-R5 | Normal-Yield/stalk width | 0.7881 | 0.0202 |
| LYD119_H22 | Vectors Maize Normal | Grain Distal R4-R5 | Normal-Ear weight per plot (42 plants per plot) [0-RH] | 0.7863 | 0.0207 |
| LYD119_H22 | Vectors Maize Normal | Grain Distal R4-R5 | Normal-Yield/LAI | 0.7758 | 0.0236 |
| LYD119_H22 | Vectors Maize Normal | Grain Distal R4-R5 | Normal-SPAD 10.8.09 | 0.7659 | 0.0267 |
| LYD119_H22 | Vectors Maize Normal | Grain Distal R4-R5 | Normal-NUE at grain filling [R3-R4] yield Kg/N in plant SPAD | 0.7624 | 0.0278 |

TABLE 26-continued

Correlation analyses

| Gene Name | Vector Set | Expression Set | Correlation Vector | R | P |
|---|---|---|---|---|---|
| LYD119_H22 | Vectors Maize Normal | Grain Distal R4-R5 | Normal-SPAD 10.8.09 | 0.7556 | 0.0301 |
| LYD119_H22 | Vectors Maize Normal | Grain Distal R4-R5 | Normal-Plant Height 03.08.09 | 0.7449 | 0.0340 |
| LYD119_H22 | Vectors Maize Normal | Grain Distal R4-R5 | Normal-Seed yield per dunam [kg] | 0.7423 | 0.0349 |
| LYD119_H22 | Vectors Maize Normal | Grain Distal R4-R5 | Normal-NUE yield kg/N applied in soil kg | 0.7423 | 0.0349 |
| LYD119_H22 | Vectors Maize Normal | Grain Distal R4-R5 | Normal-seed yield per 1 plant rest of the plot [0-RH in Kg] | 0.7423 | 0.0349 |
| LYD119_H22 | Vectors Maize Normal | Grain Distal R4-R5 | Normal-No of rows per ear | 0.7197 | 0.0441 |
| LYD119_H22 | Vectors Maize Normal | Internode V6-V8 | Normal-Plant Height 03.08.09 | 0.7138 | 0.0308 |
| LYD119_H22 | Vectors Maize Normal | Internode V6-V8 | Normal-Final Leaf Number | 0.7123 | 0.0313 |
| LYD148_H4 | Vectors Maize Normal | Grain Distal R4-R5 | Normal-Final Leaf Number | 0.8457 | 0.0082 |
| LYD148_H4 | Vectors Maize Normal | Grain Distal R4-R5 | Normal-Final Leaf Number | 0.8451 | 0.0082 |
| LYD148_H4 | Vectors Maize Normal | Internode R3-R4 | Normal-Stalk width 20/08/09 close to TP5 | 0.7327 | 0.0387 |
| LYD148_H4 | Vectors Maize Normal | Internode V6-V8 | Normal-Final Plant Height | 0.7013 | 0.0353 |
| LYD148_H4 | Vectors Maize Normal | Grain Distal R4-R5 | Normal-Final Leaf Number | 0.8457 | 0.0082 |
| LYD148_H4 | Vectors Maize Normal | Grain Distal R4-R5 | Normal-Final Leaf Number | 0.8451 | 0.0082 |
| LYD148_H4 | Vectors Maize Normal | Internode R3-R4 | Normal-Stalk width 20/08/09 close to TP5 | 0.7327 | 0.0387 |
| LYD148_H4 | Vectors Maize Normal | Internode V6-V8 | Normal-Final Plant Height | 0.7013 | 0.0353 |
| LYD148_H5 | Vectors Maize Normal | Grain Distal R4-R5 | Normal-Plant Height 19.7.09 | 0.8416 | 0.0088 |
| LYD148_H5 | Vectors Maize Normal | Grain Distal R4-R5 | Normal-Plant Height 29.07.09 | 0.7924 | 0.0190 |
| LYD148_H5 | Vectors Maize Normal | Grain Distal R4-R5 | Normal-Plant Height 10.08.09 | 0.7544 | 0.0305 |
| LYD148_H5 | Vectors Maize Normal | Internode V6-V8 | Normal-Final Leaf Number | 0.7134 | 0.0309 |
| LYD148_H5 | Vectors Maize Normal | Grain Distal R4-R5 | Normal-Leaf No 3.08.09 | 0.7109 | 0.0481 |
| LYD148_H5 | Vectors Maize Normal | Grain Distal R4-R5 | Normal-Plant Height 19.7.09 | 0.8416 | 0.0088 |
| LYD148_H5 | Vectors Maize Normal | Grain Distal R4-R5 | Normal-Plant Height 29.07.09 | 0.7924 | 0.0190 |
| LYD148_H5 | Vectors Maize Normal | Grain Distal R4-R5 | Normal-Plant Height 10.08.09 | 0.7544 | 0.0305 |
| LYD148_H5 | Vectors Maize Normal | Internode V6-V8 | Normal-Final Leaf Number | 0.7134 | 0.0309 |

TABLE 26-continued

Correlation analyses

| Gene Name | Vector Set | Expression Set | Correlation Vector | R | P |
|---|---|---|---|---|---|
| LYD148_H5 | Vectors Maize Normal | Grain Distal R4-R5 | Normal-Leaf No 3.08.09 | 0.7109 | 0.0481 |
| LYD196_H2 | Vectors Maize Normal | Internode V6-V8 | Normal-Final Leaf Number | 0.8907 | 0.0013 |
| LYD196_H2 | Vectors Maize Normal | Internode R3-R4 | Normal-Ear length of filled area cm | 0.8319 | 0.0104 |
| LYD196_H2 | Vectors Maize Normal | Internode V6-V8 | Normal-Final Leaf Number | 0.8314 | 0.0055 |
| LYD196_H2 | Vectors Maize Normal | Internode V6-V8 | Normal-SPAD 1.9.09 R1-2 | 0.8154 | 0.0074 |
| LYD196_H2 | Vectors Maize Normal | Grain Distal R4-R5 | Normal-SPAD 3.8.09 | 0.7864 | 0.0206 |
| LYD196_H2 | Vectors Maize Normal | Leaf V6-V8 | Normal-Stalk width 20/08/09 close to TP5 | 0.7852 | 0.0071 |
| LYD196_H2 | Vectors Maize Normal | Internode R3-R4 | Normal-Ear Length cm | 0.7700 | 0.0254 |
| LYD196_H2 | Vectors Maize Normal | Leaf V6-V8 | Normal-Stalk width 20/08/09 close to TP5 | 0.7690 | 0.0093 |
| LYD196_H2 | Vectors Maize Normal | Internode V6-V8 | Normal-SPAD 1.9.09 R1-2 | 0.7431 | 0.0218 |
| LYD196_H2 | Vectors Maize Normal | Grain Distal R4-R5 | Normal-Ear with mm | 0.7364 | 0.0372 |
| LYD196_H2 | Vectors Maize Normal | Grain Distal R4-R5 | Normal-Ear with mm | 0.7354 | 0.0376 |
| LYD196_H2 | Vectors Maize Normal | Leaf V6-V8 | Normal-Final Leaf Number | 0.7346 | 0.0155 |
| LYD196_H2 | Vectors Maize Normal | Internode R3-R4 | Normal-Ear length of filled area cm | 0.7234 | 0.0425 |
| LYD196_H2 | Vectors Maize Normal | Internode R3-R4 | Normal-Ear Length cm | 0.7077 | 0.0495 |
| LYD196_H2 | Vectors Maize Normal | Internode V6-V8 | Normal-Final Leaf Number | 0.8907 | 0.0013 |
| LYD196_H2 | Vectors Maize Normal | Internode R3-R4 | Normal-Ear length of filled area cm | 0.8319 | 0.0104 |
| LYD196_H2 | Vectors Maize Normal | Internode V6-V8 | Normal-Final Leaf Number | 0.8314 | 0.0055 |
| LYD196_H2 | Vectors Maize Normal | Internode V6-V8 | Normal-SPAD 1.9.09 R1-2 | 0.8154 | 0.0074 |
| LYD196_H2 | Vectors Maize Normal | Grain Distal R4-R5 | Normal-SPAD 3.8.09 | 0.7864 | 0.0206 |
| LYD196_H2 | Vectors Maize Normal | Leaf V6-V8 | Normal-Stalk width 20/08/09 close to TP5 | 0.7852 | 0.0071 |
| LYD196_H2 | Vectors Maize Normal | Internode R3-R4 | Normal-Ear Length cm | 0.7700 | 0.0254 |
| LYD196_H2 | Vectors Maize Normal | Leaf V6-V8 | Normal-Stalk width 20/08/09 close to TP5 | 0.7690 | 0.0093 |
| LYD196_H2 | Vectors Maize Normal | Internode V6-V8 | Normal-SPAD 1.9.09 R1-2 | 0.7431 | 0.0218 |
| LYD196_H2 | Vectors Maize Normal | Grain Distal R4-R5 | Normal-Ear with mm | 0.7364 | 0.0372 |
| LYD196_H2 | Vectors Maize Normal | Grain Distal R4-R5 | Normal-Ear with mm | 0.7354 | 0.0376 |

TABLE 26-continued

Correlation analyses

| Gene Name | Vector Set | Expression Set | Correlation Vector | R | P |
|---|---|---|---|---|---|
| LYD196_H2 | Vectors Maize Normal | Leaf V6-V8 | Normal-Final Leaf Number | 0.7346 | 0.0155 |
| LYD196_H2 | Vectors Maize Normal | Internode R3-R4 | Normal-Ear length of filled area cm | 0.7234 | 0.0425 |
| LYD196_H2 | Vectors Maize Normal | Internode R3-R4 | Normal-Ear Length cm | 0.7077 | 0.0495 |
| LYD128_H5 | Vectors Maize Normal | Grain Distal R4-R5 | Normal-Stalk width 20/08/09 close to TP5 | 0.9266 | 0.0009 |
| LYD128_H5 | Vectors Maize Normal | Grain Distal R4-R5 | Normal-Stalk width 20/08/09 close to TP5 | 0.9266 | 0.0009 |
| LYD128_H6 | Vectors Maize Normal | Grain Distal R4-R5 | Normal-Stalk width 20/08/09 close to TP5 | 0.9266 | 0.0009 |
| LYD228_H7 | Vectors Maize Normal | Grain Distal R4-R5 | Normal-Ear Length cm | 0.7279 | 0.0407 |
| LYD228_H7 | Vectors Maize Normal | Grain Distal R4-R5 | Normal-SPAD 29.7.09 | 0.7120 | 0.0475 |
| LYD228_H7 | Vectors Maize Normal | Grain Distal R4-R5 | Normal-Ear Length cm | 0.7279 | 0.0407 |
| LYD228_H7 | Vectors Maize Normal | Internode R3-R4 | Normal-SPAD 29.7.09 | 0.7181 | 0.0448 |
| LYD228_H7 | Vectors Maize Normal | Grain Distal R4-R5 | Normal-SPAD 29.7.09 | 0.7120 | 0.0475 |
| LYD228_H7 | Vectors Maize Normal | Internode V6-V8 | Normal-LAI | 0.7084 | 0.0492 |
| LYD238_H4 | Vectors Maize Normal | Internode V6-V8 | Normal-Yield/LAI | 0.8504 | 0.0075 |
| LYD238_H4 | Vectors Maize Normal | Internode V6-V8 | Normal-Ear Length cm | 0.8010 | 0.0095 |
| LYD238_H4 | Vectors Maize Normal | Internode V6-V8 | Normal-Ear length of filled area cm | 0.7414 | 0.0222 |
| LYD238_H4 | Vectors Maize Normal | Internode R3-R4 | Normal-Stalk width 20/08/09 close to TP5 | 0.7132 | 0.0470 |
| LYD238_H4 | Vectors Maize Normal | Internode V6-V8 | Normal-Yield/LAI | 0.8504 | 0.0075 |
| LYD238_H4 | Vectors Maize Normal | Internode V6-V8 | Normal-Ear Length cm | 0.8010 | 0.0095 |
| LYD238_H4 | Vectors Maize Normal | Internode V6-V8 | Normal-Ear length of filled area cm | 0.7414 | 0.0222 |
| LYD238_H4 | Vectors Maize Normal | Internode R3-R4 | Normal-Stalk width 20/08/09 close to TP5 | 0.7132 | 0.0470 |
| LYD201_H146 | Vectors Maize Normal | Internode R3-R4 | Normal-SPAD 6.9.09 R3-R4 | 0.7795 | 0.0226 |
| LYD201_H146 | Vectors Maize Normal | Leaf V6-V8 | Normal-Final Leaf Number | 0.7537 | 0.0118 |
| LYD201_H146 | Vectors Maize Normal | Leaf V6-V8 | Normal-Final Leaf Number | 0.7412 | 0.0142 |
| LYD201_H146 | Vectors Maize Normal | Grain Distal R4-R5 | Normal-Final Plant Height | 0.7330 | 0.0386 |
| LYD201_H146 | Vectors Maize Normal | Internode R3-R4 | Normal-SPAD 6.9.09 R3-R4 | 0.7795 | 0.0226 |
| LYD201_H146 | Vectors Maize Normal | Leaf V6-V8 | Normal-Final Leaf Number | 0.7537 | 0.0118 |

TABLE 26-continued

Correlation analyses

| Gene Name | Vector Set | Expression Set | Correlation Vector | R | P |
|---|---|---|---|---|---|
| LYD201_H146 | Vectors Maize Normal | Leaf V6-V8 | Normal-Final Leaf Number | 0.7412 | 0.0142 |
| LYD201_H146 | Vectors Maize Normal | Grain Distal R4-R5 | Normal-Final Plant Height | 0.7330 | 0.0386 |
| LYD201_H147 | Vectors Maize Normal | Internode V6-V8 | Normal-SPAD 29.7.09 | 0.8859 | 0.0015 |
| LYD201_H147 | Vectors Maize Normal | Internode V6-V8 | Normal-Ear weight per plot (42 plants per plot) [0-RH] | 0.8836 | 0.0016 |
| LYD201_H147 | Vectors Maize Normal | Internode V6-V8 | Normal-Ear with mm | 0.8708 | 0.0022 |
| LYD201_H147 | Vectors Maize Normal | Internode V6-V8 | Normal-Final Main Ear Height | 0.8612 | 0.0029 |
| LYD201_H147 | Vectors Maize Normal | Internode V6-V8 | Normal-NUE at grain filling [R3-R4] yield Kg/N in plant SPAD | 0.8587 | 0.0030 |
| LYD201_H147 | Vectors Maize Normal | Internode V6-V8 | Normal-NUE at early grain filling [R1-R2] yield Kg/N in plant SPAD | 0.8554 | 0.0033 |
| LYD201_H147 | Vectors Maize Normal | Internode V6-V8 | Normal-Seed yield per dunam [kg] | 0.8139 | 0.0076 |
| LYD201_H147 | Vectors Maize Normal | Internode V6-V8 | Normal-NUE yield kg/N applied in soil kg | 0.8139 | 0.0076 |
| LYD201_H147 | Vectors Maize Normal | Internode V6-V8 | Normal-seed yield per 1 plant rest of the plot [0-RH in Kg] | 0.8139 | 0.0076 |
| LYD201_H147 | Vectors Maize Normal | Internode V6-V8 | Normal-Yield/stalk width | 0.8120 | 0.0079 |
| LYD201_H147 | Vectors Maize Normal | Internode V6-V8 | Normal-Final Plant Height | 0.7807 | 0.0130 |
| LYD201_H147 | Vectors Maize Normal | Internode V6-V8 | Normal-Ear with mm | 0.7358 | 0.0238 |
| LYD201_H147 | Vectors Maize Normal | Grain Distal R4-R5 | Normal-Ear with mm | 0.7273 | 0.0409 |
| LYD201_H147 | Vectors Maize Normal | Grain Distal R4-R5 | Normal-Ear with mm | 0.7218 | 0.0432 |
| LYD201_H147 | Vectors Maize Normal | Internode V6-V8 | Normal-Final Main Ear Height | 0.7200 | 0.0287 |
| LYD201_H147 | Vectors Maize Normal | Internode V6-V8 | Normal-Ear with mm | 0.7173 | 0.0296 |
| LYD201_H147 | Vectors Maize Normal | Internode V6-V8 | Normal-No of rows per ear | 0.7165 | 0.0299 |
| LYD201_H147 | Vectors Maize Normal | Internode V6-V8 | Normal-Final Plant Height | 0.7109 | 0.0318 |
| LYD201_H147 | Vectors Maize Normal | Internode V6-V8 | Normal-No of rows per ear | 0.7004 | 0.0356 |
| LYD201_H147 | Vectors Maize Normal | Internode V6-V8 | Normal-SPAD 29.7.09 | 0.8859 | 0.0015 |
| LYD201_H147 | Vectors Maize Normal | Internode V6-V8 | Normal-Ear weight per plot (42 plants per plot) [0-RH] | 0.8836 | 0.0016 |
| LYD201_H147 | Vectors Maize Normal | Internode V6-V8 | Normal-Ear with mm | 0.8708 | 0.0022 |
| LYD201_H147 | Vectors Maize Normal | Internode V6-V8 | Normal-Final Main Ear Height | 0.8612 | 0.0029 |

TABLE 26-continued

Correlation analyses

| Gene Name | Vector Set | Expression Set | Correlation Vector | R | P |
|---|---|---|---|---|---|
| LYD201_H147 | Vectors Maize Normal | Internode V6-V8 | Normal-NUE at grain filling [R3-R4] yield Kg/N in plant SPAD | 0.8587 | 0.0030 |
| LYD201_H147 | Vectors Maize Normal | Internode V6-V8 | Normal-NUE at early grain filling [R1-R2] yield Kg/N in plant SPAD | 0.8554 | 0.0033 |
| LYD201_H147 | Vectors Maize Normal | Internode V6-V8 | Normal-Seed yield per dunam [kg] | 0.8139 | 0.0076 |
| LYD201_H147 | Vectors Maize Normal | Internode V6-V8 | Normal-NUE yield kg/N applied in soil kg | 0.8139 | 0.0076 |
| LYD201_H147 | Vectors Maize Normal | Internode V6-V8 | Normal-seed yield per 1 plant rest of the plot [0-RH in Kg] | 0.8139 | 0.0076 |
| LYD201_H147 | Vectors Maize Normal | Internode V6-V8 | Normal-Yield/stalk width | 0.8120 | 0.0079 |
| LYD201_H147 | Vectors Maize Normal | Internode V6-V8 | Normal-Final Plant Height | 0.7807 | 0.0130 |
| LYD201_H147 | Vectors Maize Normal | Internode V6-V8 | Normal-Ear with mm | 0.7358 | 0.0238 |
| LYD201_H147 | Vectors Maize Normal | Grain Distal R4-R5 | Normal-Ear with mm | 0.7273 | 0.0409 |
| LYD201_H147 | Vectors Maize Normal | Grain Distal R4-R5 | Normal-Ear with mm | 0.7218 | 0.0432 |
| LYD201_H147 | Vectors Maize Normal | Internode V6-V8 | Normal-Final Main Ear Height | 0.7200 | 0.0287 |
| LYD201_H147 | Vectors Maize Normal | Internode V6-V8 | Normal-Ear with mm | 0.7173 | 0.0296 |
| LYD201_H147 | Vectors Maize Normal | Internode V6-V8 | Normal-No of rows per ear | 0.7165 | 0.0299 |
| LYD201_H147 | Vectors Maize Normal | Internode V6-V8 | Normal-Final Plant Height | 0.7109 | 0.0318 |
| LYD201_H147 | Vectors Maize Normal | Internode V6-V8 | Normal-No of rows per ear | 0.7004 | 0.0356 |
| LYD201_H148 | Vectors Maize Normal | Grain Distal R4-R5 | Normal-Ear length of filled area cm | 0.7205 | 0.0438 |
| LYD201_H148 | Vectors Maize Normal | Internode V6-V8 | Normal-SPAD 29.7.09 | 0.7174 | 0.0296 |
| LYD201_H148 | Vectors Maize Normal | Grain Distal R4-R5 | Normal-Ear length of filled area cm | 0.7205 | 0.0438 |
| LYD201_H148 | Vectors Maize Normal | Internode V6-V8 | Normal-SPAD 29.7.09 | 0.7174 | 0.0296 |
| LYD216_H9 | Vectors Maize Normal | Leaf V6-V8 | Normal-Ear length of filled area cm | 0.7545 | 0.0117 |
| LYD216_H9 | Vectors Maize Normal | Grain Distal R4-R5 | Normal-Stalk width 20/08/09 close to TP5 | 0.7367 | 0.0371 |
| LYD216_H9 | Vectors Maize Normal | Leaf V6-V8 | Normal-Ear length of filled area cm | 0.7545 | 0.0117 |
| LYD216_H9 | Vectors Maize Normal | Grain Distal R4-R5 | Normal-Stalk width 20/08/09 close to TP5 | 0.7367 | 0.0371 |
| LYD216_H10 | Vectors Maize Normal | Grain Distal R4-R5 | Normal-SPAD 3.8.09 | 0.8579 | 0.0064 |
| LYD216_H10 | Vectors Maize Normal | Grain Distal R4-R5 | Normal-Ear with mm | 0.8398 | 0.0091 |

TABLE 26-continued

Correlation analyses

| Gene Name | Vector Set | Expression Set | Correlation Vector | R | P |
|---|---|---|---|---|---|
| LYD216_H10 | Vectors Maize Normal | Grain Distal R4-R5 | Normal-Ear with mm | 0.8112 | 0.0145 |
| LYD216_H10 | Vectors Maize Normal | Grain Distal R4-R5 | Normal-SPAD 29.7.09 | 0.7661 | 0.0266 |
| LYD216_H10 | Vectors Maize Normal | Grain Distal R4-R5 | Normal-Ear weight per plot (42 plants per plot) [0-RH] | 0.7540 | 0.0307 |
| LYD216_H10 | Vectors Maize Normal | Internode R3-R4 | Normal-Final Leaf Number | 0.7158 | 0.0458 |
| LYD216_H10 | Vectors Maize Normal | Grain Distal R4-R5 | Normal-SPAD 3.8.09 | 0.8579 | 0.0064 |
| LYD216_H10 | Vectors Maize Normal | Grain Distal R4-R5 | Normal-Ear with mm | 0.8398 | 0.0091 |
| LYD216_H10 | Vectors Maize Normal | Grain Distal R4-R5 | Normal-Ear with mm | 0.8112 | 0.0145 |
| LYD216_H10 | Vectors Maize Normal | Grain Distal R4-R5 | Normal-SPAD 29.7.09 | 0.7661 | 0.0266 |
| LYD216_H10 | Vectors Maize Normal | Grain Distal R4-R5 | Normal-Ear weight per plot (42 plants per plot) [0-RH] | 0.7540 | 0.0307 |
| LYD216_H10 | Vectors Maize Normal | Internode R3-R4 | Normal-Final Leaf Number | 0.7158 | 0.0458 |
| LYD227_H4 | Vectors Maize Normal | Internode V6-V8 | Normal-SPAD 3.8.09 | 0.8421 | 0.0044 |
| LYD227_H4 | Vectors Maize Normal | Grain Distal R4-R5 | Normal-Ear with mm | 0.7830 | 0.0216 |
| LYD227_H4 | Vectors Maize Normal | Internode V6-V8 | Normal-SPAD 3.8.09 | 0.8421 | 0.0044 |
| LYD227_H4 | Vectors Maize Normal | Grain Distal R4-R5 | Normal-Ear with mm | 0.7830 | 0.0216 |

Table 26: Correlation analyses.

Example 10

Identification of Genes and Homologues Thereof which Increase Yield, Biomass, Growth Rate, Vigor, Oil Content, Abiotic Stress Tolerance of Plants and Nitrogen Use Efficiency Based on the above described bioinformatics and experimental tools, the present inventors have identified 217 genes which have a major impact on yield, seed yield, oil to yield, biomass, growth rate, vigor, oil content, fiber yield, fiber quality, abiotic stress tolerance, and/or nitrogen use efficiency when expression thereof is increased in plants. The identified genes (including genes identified by bioinformatics tools and curated sequences thereof), and polypeptide sequences encoded thereby are summarized in Table 27, hereinbelow.

TABLE 27

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polynuc. SEQ ID NO: | Polypep. SEQ ID NO: |
|---|---|---|---|---|
| LYD1 | arabidopsis\|gb165\|AT1G03470 | arabidopsis | 1 | 488 |
| LYD2 | arabidopsis\|gb165\|AT1G22800 | arabidopsis | 2 | 489 |
| LYD3 | arabidopsis\|gb165\|AT1G32160 | arabidopsis | 3 | 490 |
| LYD4 | arabidopsis\|gb165\|AT1G34630 | arabidopsis | 4 | 491 |
| LYD5 | arabidopsis\|gb165\|AT1G67650 | arabidopsis | 5 | 492 |
| LYD6 | arabidopsis\|gb165\|AT2G15860 | arabidopsis | 6 | 493 |
| LYD7 | arabidopsis\|gb165\|AT2G25670 | arabidopsis | 7 | 494 |

TABLE 27-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polynuc. SEQ ID NO: | Polypep. SEQ ID NO: |
|---|---|---|---|---|
| LYD9 | arabidopsis\|gb165\|AT3G01720 | arabidopsis | 8 | 495 |
| LYD10 | arabidopsis\|gb165\|AT3G15890 | arabidopsis | 9 | 496 |
| LYD11 | arabidopsis\|gb165\|AT3G53668 | arabidopsis | 10 | 497 |
| LYD12 | arabidopsis\|gb165\|AT3G60980 | arabidopsis | 11 | 498 |
| LYD13 | arabidopsis\|gb165\|AT3G61670 | arabidopsis | 12 | 499 |
| LYD14 | arabidopsis\|gb165\|AT4G04880 | arabidopsis | 13 | 500 |
| LYD16 | arabidopsis\|gb165\|AT4G20480 | arabidopsis | 14 | 501 |
| LYD18 | arabidopsis\|gb165\|AT4G24610 | arabidopsis | 15 | 502 |
| LYD20 | arabidopsis\|gb165\|AT5G10690 | arabidopsis | 16 | 503 |
| LYD21 | arabidopsis\|gb165\|AT5G36930 | arabidopsis | 17 | 504 |
| LYD22 | arabidopsis\|gb165\|AT5G51040 | arabidopsis | 18 | 505 |
| LYD23 | arabidopsis\|gb165\|AT5G51080 | arabidopsis | 19 | 506 |
| LYD25 | canola\|gb161\|EG019886 | canola | 20 | 507 |
| LYD26 | medicago\|09v1\|AL377960 | medicago | 21 | 508 |
| LYD27 | medicago\|09v1\|BF632009 | medicago | 22 | 509 |
| LYD28 | medicago\|09v1\|BI271781 | medicago | 23 | 510 |
| LYD29 | medicago\|09v1\|CRPMT000438 | medicago | 24 | 511 |
| LYD33 | tomato\|gb164\|AF211815 | tomato | 25 | 512 |
| LYD34 | tomato\|gb164\|AI483666 | tomato | 26 | 513 |
| LYD35 | tomato\|09v1\|AJ306423 | tomato | 27 | 514 |
| LYD36 | tomato\|gb164\|AI485302 | tomato | 28 | 515 |
| LYD37 | tomato\|gb164\|AI487977 | tomato | 29 | 516 |
| LYD38 | tomato\|gb164\|AI773900 | tomato | 30 | 517 |
| LYD40 | tomato\|09v1\|AI782539 | tomato | 31 | 518 |
| LYD41 | tomato\|09v1\|BF052865 | tomato | 32 | 519 |
| LYD42 | tomato\|09v1\|AW036074 | tomato | 33 | 520 |
| LYD43 | tomato\|gb164\|AW037558 | tomato | 34 | 521 |
| LYD44 | tomato\|gb164\|AW217297 | tomato | 35 | 522 |
| LYD45 | tomato\|gb164\|AW618293 | tomato | 36 | 523 |
| LYD47 | tomato\|gb164\|BG123883 | tomato | 37 | 524 |
| LYD48 | tomato\|09v1\|BG123886 | tomato | 38 | 525 |
| LYD49 | tomato\|09v1\|BG123989 | tomato | 39 | 526 |
| LYD50 | tomato\|09v1\|BG127394 | tomato | 40 | 527 |
| LYD51 | tomato\|gb164\|BG127506 | tomato | 41 | 528 |
| LYD52 | tomato\|09v1\|BG128140 | tomato | 42 | 529 |
| LYD53 | tomato\|gb164\|BG128949 | tomato | 43 | 530 |
| LYD55 | tomato\|gb164\|BG131146 | tomato | 44 | 531 |
| LYD57 | tomato\|gb164\|BG134380 | tomato | 45 | 532 |
| LYD58 | tomato\|09v1\|BG134619 | tomato | 46 | 533 |
| LYD59 | tomato\|09v1\|BG135632 | tomato | 47 | 534 |
| LYD61 | tomato\|09v1\|BG138131 | tomato | 48 | 535 |
| LYD62 | tomato\|09v1\|BG734743 | tomato | 49 | 536 |
| LYD63 | tomato\|09v1\|BI206677 | tomato | 50 | 537 |
| LYD65 | tomato\|09v1\|CK273548 | tomato | 51 | 538 |
| LYD66 | tomato\|gb164\|CD002407 | tomato | 52 | 539 |
| LYD67 | tomato\|09v1\|BF113276 | tomato | 53 | 540 |
| LYD69 | arabidopsis\|gb165\|AT5G25120 | arabidopsis | 54 | 541 |
| LYD70 | canola\|gb161\|CB686084 | canola | 55 | 542 |
| LYD71 | canola\|gb161\|CD817042 | canola | 56 | 543 |
| LYD72 | medicago\|09v1\|AW696637 | medicago | 57 | 544 |
| LYD73 | tomato\|gb164\|AA824853 | tomato | 58 | 545 |
| LYD74 | tomato\|09v1\|BG124100 | tomato | 59 | 546 |
| LYD75 | tomato\|gb164\|BG134552 | tomato | 60 | 547 |
| LYD76 | tomato\|gb164\|BP890691 | tomato | 61 | 548 |
| LYD78 | soybean\|gb168\|AL388558 | soybean | 62 | 549 |
| LYD79 | soybean\|gb168\|BE820644 | soybean | 63 | 550 |
| LYD80 | arabidopsis\|gb165\|AT1G21920 | arabidopsis | 64 | 551 |
| LYD81 | medicago\|09v1\|BF632274 | medicago | 65 | 552 |
| LYD82 | tomato\|gb164\|BG630963 | tomato | 66 | 553 |
| LYD84 | arabidopsis\|gb165\|AT5G15254 | arabidopsis | 67 | 554 |
| LYD85 | arabidopsis\|gb165\|AT4G29905 | arabidopsis | 68 | 555 |
| LYD86 | arabidopsis\|gb165\|AT5G41010 | arabidopsis | 69 | 556 |
| LYD87 | tomato\|gb164\|AW930554 | tomato | 70 | 557 |
| LYD88 | arabidopsis\|gb165\|AT1G68710 | arabidopsis | 71 | 558 |
| LYD89 | arabidopsis\|gb165\|AT5G42730 | arabidopsis | 72 | 559 |
| LYD90 | arabidopsis\|gb165\|AT1G18910 | arabidopsis | 73 | 560 |
| LYD91 | tomato\|09v1\|BG643473 | tomato | 74 | 561 |
| LYD92 | arabidopsis\|gb165\|AT1G19240 | arabidopsis | 75 | 562 |
| LYD94 | arabidopsis\|gb165\|AT1G49660 | arabidopsis | 76 | 563 |
| LYD95 | arabidopsis\|gb165\|AT1G65295 | arabidopsis | 77 | 564 |
| LYD96 | arabidopsis\|gb165\|AT1G76970 | arabidopsis | 78 | 565 |
| LYD97 | arabidopsis\|gb165\|AT2G01090 | arabidopsis | 79 | 566 |

TABLE 27-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polynuc. SEQ ID NO: | Polypep. SEQ ID NO: |
|---|---|---|---|---|
| LYD99 | arabidopsis\|gb165\|AT3G26380 | arabidopsis | 80 | 567 |
| LYD101 | arabidopsis\|gb165\|AT4G14930 | arabidopsis | 81 | 568 |
| LYD102 | arabidopsis\|gb165\|AT4G24800 | arabidopsis | 82 | 569 |
| LYD103 | arabidopsis\|gb165\|AT5G05060 | arabidopsis | 83 | 570 |
| LYD104 | arabidopsis\|gb165\|AT5G23070 | arabidopsis | 84 | 571 |
| LYD105 | arabidopsis\|gb165\|AT5G40540 | arabidopsis | 85 | 572 |
| LYD106 | arabidopsis\|gb165\|AT5G44930 | arabidopsis | 86 | 573 |
| LYD107 | arabidopsis\|gb165\|AT5G62630 | arabidopsis | 87 | 574 |
| LYD108 | canola\|gb161\|EV139574 | canola | 88 | 575 |
| LYD109 | b_juncea\|yd3\|EVGN00087322220915 | b_juncea | 89 | 576 |
| LYD110 | b_juncea\|yd3\|E6ANDIZ01CHGS1 | b_juncea | 90 | 577 |
| LYD113 | b_juncea\|yd3\|H07501 | b_juncea | 91 | 578 |
| LYD114 | b_juncea\|gb164\|EVGN00337011101441 | b_juncea | 92 | 579 |
| LYD117 | b_juncea\|yd3\|E6ANDIZ01AGE3G | b_juncea | 93 | 580 |
| LYD118 | b_juncea\|yd3\|E6ANDIZ01A3PN5 | b_juncea | 94 | 581 |
| LYD119 | b_juncea\|gb164\|EVGN01067614512362 | b_juncea | 95 | 582 |
| LYD120 | b_juncea\|yd3\|X1E6ANDIZ01EAN1T | b_juncea | 96 | 583 |
| LYD122 | b_juncea\|yd3\|E6ANDIZ01DUORN | b_juncea | 97 | 584 |
| LYD123 | b_juncea\|gb164\|EVGN08545904982944 | b_juncea | 98 | 585 |
| LYD124 | b_juncea\|gb164\|EVGN10695305591742 | b_juncea | 99 | 586 |
| LYD125 | medicago\|gb157.2\|AW171770 | medicago | 100 | 587 |
| LYD126 | medicago\|gb157.2\|BE240432 | medicago | 101 | 588 |
| LYD127 | soybean\|gb166\|AW119405 | soybean | 102 | 589 |
| LYD128 | soybean\|gb166\|BE210997 | soybean | 103 | 590 |
| LYD129 | soybean\|gb166\|BE660895 | soybean | 104 | 591 |
| LYD132 | soybean\|gb168\|BF634740 | soybean | 105 | 592 |
| LYD133 | soybean\|gb168\|BI418412 | soybean | 106 | 593 |
| LYD134 | soybean\|gb168\|BU546353 | soybean | 107 | 594 |
| LYD136 | soybean\|gb168\|AW685064 | soybean | 108 | 595 |
| LYD139 | soybean\|gb168\|BI969776 | soybean | 109 | 596 |
| LYD140 | soybean\|gb168\|CF069839 | soybean | 110 | 597 |
| LYD142 | tomato\|09v1\|AI779400 | tomato | 111 | 598 |
| LYD144 | tomato\|09v1\|BG135622 | tomato | 112 | 599 |
| LYD146 | tomato\|gb164\|DV103976 | tomato | 113 | 600 |
| LYD148 | sorghum\|gb161.crp\|AF047899 | sorghum | 114 | 601 |
| LYD149 | arabidopsis\|gb165\|AT1G05350 | arabidopsis | 115 | 602 |
| LYD150 | arabidopsis\|gb165\|AT1G61180 | arabidopsis | 116 | 603 |
| LYD152 | arabidopsis\|gb165\|AT5G02370 | arabidopsis | 117 | 604 |
| LYD153 | arabidopsis\|gb165\|AT5G42920 | arabidopsis | 118 | 605 |
| LYD156 | tomato\|gb164\|BG125257 | tomato | 119 | 606 |
| LYD157 | tomato\|09v1\|BG735318 | tomato | 120 | 607 |
| LYD158 | tomato\|gb164\|DB709286 | tomato | 121 | 608 |
| LYD159 | b_juncea\|gb164\|DT317712 | b_juncea | 122 | 609 |
| LYD166 | b_juncea\|gb164\|EVGN00118027751203 | b_juncea | 123 | 610 |
| LYD167 | b_juncea\|gb164\|EVGN00123927221199 | b_juncea | 124 | 611 |
| LYD172 | b_juncea\|yd3\|E6ANDIZ01ATVGF | b_juncea | 125 | 612 |
| LYD173 | b_juncea\|gb164\|EVGN00297423550919 | b_juncea | 126 | 613 |
| LYD174 | b_juncea\|yd3\|E6ANDIZ01AF3YB | b_juncea | 127 | 614 |
| LYD176 | b_juncea\|gb164\|EVGN00462208651225 | b_juncea | 128 | 615 |
| LYD177 | b_juncea\|gb164\|EVGN00465119080454 | b_juncea | 129 | 616 |
| LYD178 | b_juncea\|gb164\|EVGN00502808481823 | b_juncea | 130 | 617 |
| LYD180 | b_juncea\|yd3\|E6ANDIZ01A6SGI1 | b_juncea | 131 | 618 |
| LYD184 | b_juncea\|yd3\|E6ANDIZ01A3ARL | b_juncea | 132 | 619 |
| LYD185 | b_juncea\|gb164\|EVGN01300508721002 | b_juncea | 133 | 620 |
| LYD186 | b_juncea\|yd3\|GENL37642 | b_juncea | 134 | 621 |
| LYD187 | b_juncea\|gb164\|EVGN01497309140908 | b_juncea | 135 | 622 |
| LYD188 | b_juncea\|yd3\|CD813443 | b_juncea | 136 | 623 |
| LYD190 | b_juncea\|yd3\|GENBG543253 | b_juncea | 137 | 624 |
| LYD192 | b_juncea\|yd3\|A4M2E6ANDIZ01B0ZJK | b_juncea | 138 | 625 |
| LYD193 | b_juncea\|yd3\|E6ANDIZ01A79AV1 | b_juncea | 139 | 626 |
| LYD194 | b_juncea\|yd3\|E6ANDIZ01AFJMD | b_juncea | 140 | 627 |
| LYD195 | tomato\|gb164\|AI483451 | tomato | 141 | 628 |
| LYD196 | maize\|gb170\|AI586800 | maize | 142 | 629 |
| LYD197 | arabidopsis\|gb165\|AT5G63800 | arabidopsis | 143 | 630 |
| LYD200 | b_juncea\|yd3\|E7FJ1I304DXRGY | b_juncea | 144 | 631 |
| LYD201 | b_juncea\|gb164\|EVGN00128110990752 | b_juncea | 145 | 632 |
| LYD202 | b_juncea\|gb164\|EVGN00179312122996 | b_juncea | 146 | 633 |
| LYD204 | b_juncea\|yd3\|E6ANDIZ01A9A19 | b_juncea | 147 | 634 |
| LYD206 | b_juncea\|gb164\|EVGN00955015301700 | b_juncea | 148 | 635 |
| LYD208 | b_juncea\|yd3\|E6ANDIZ01BZ44C | b_juncea | 149 | 636 |
| LYD209 | b_juncea\|yd3\|E6ANDIZ02G6J79 | b_juncea | 150 | 637 |
| LYD211 | sorghum\|gb161.crp\|W59814 | sorghum | 151 | 638 |

TABLE 27-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polynuc. SEQ ID NO: | Polypep. SEQ ID NO: |
|---|---|---|---|---|
| LYD212 | arabidopsis\|gb165\|AT1G21560 | arabidopsis | 152 | 639 |
| LYD213 | arabidopsis\|gb165\|AT1G63460 | arabidopsis | 153 | 640 |
| LYD214 | arabidopsis\|gb165\|AT2G24440 | arabidopsis | 154 | 641 |
| LYD215 | arabidopsis\|gb165\|AT2G43350 | arabidopsis | 155 | 642 |
| LYD216 | arabidopsis\|gb165\|AT3G03960 | arabidopsis | 156 | 643 |
| LYD217 | arabidopsis\|gb165\|AT3G06035 | arabidopsis | 157 | 644 |
| LYD219 | arabidopsis\|gb165\|AT3G51250 | arabidopsis | 158 | 645 |
| LYD220 | arabidopsis\|gb165\|AT4G16160 | arabidopsis | 159 | 646 |
| LYD221 | arabidopsis\|gb165\|AT4G35850 | arabidopsis | 160 | 647 |
| LYD222 | arabidopsis\|gb165\|AT4G35985 | arabidopsis | 161 | 648 |
| LYD223 | arabidopsis\|gb165\|AT5G13200 | arabidopsis | 162 | 649 |
| LYD224 | arabidopsis\|gb165\|AT5G58070 | arabidopsis | 163 | 650 |
| LYD225 | barley\|gb157SOLEXA\|AJ476940 | barley | 164 | 651 |
| LYD227 | sorghum\|gb161.crp\|BE600694 | sorghum | 165 | 652 |
| LYD228 | sorghum\|gb161.crp\|AI724169 | sorghum | 166 | 653 |
| LYD229 | sorghum\|gb161.crp\|AW680415 | sorghum | 167 | 654 |
| LYD230 | sorghum\|gb161.crp\|AW747687 | sorghum | 168 | 655 |
| LYD231 | sorghum\|gb161.crp\|CA827765 | sorghum | 169 | 656 |
| LYD232 | tomato\|09v1\|AI774782 | tomato | 170 | 657 |
| LYD233 | tomato\|gb164\|AW032486 | tomato | 171 | 658 |
| LYD234 | tomato\|gb164\|BG123219 | tomato | 172 | 659 |
| LYD235 | tomato\|09v1\|BG132066 | tomato | 173 | 660 |
| LYD236 | tomato\|gb164\|BG629499 | tomato | 174 | 661 |
| LYD238 | barley\|gb157SOLEXA\|AL504570 | barley | 175 | 662 |
| LYD240 | barley\|gb157SOLEXA\|BQ766120 | barley | 176 | 663 |
| LYD244 | arabidopsis\|gb165\|AT1G70810 | arabidopsis | 177 | 664 |
| LYD245 | arabidopsis\|gb165\|AT2G36410 | arabidopsis | 178 | 665 |
| LYD246 | arabidopsis\|gb165\|AT5G17900 | arabidopsis | 179 | 666 |
| LYD248 | b_juncea\|gb164\|EVGN00459611963354 | b_juncea | 180 | 667 |
| LYD250 | b_juncea\|yd3\|C1E7FJ1I304DWSVV | b_juncea | 181 | 668 |
| LYD252 | b_juncea\|yd3\|E6ANDIZ01CP0S8 | b_juncea | 182 | 669 |
| LYD253 | b_juncea\|yd3\|G2BG543337 | b_juncea | 183 | 670 |
| LYD256 | b_juncea\|yd3\|G2ES909931 | b_juncea | 184 | 671 |
| LYD257 | b_juncea\|yd3\|STE6ANDIZ01D9959 | b_juncea | 185 | 672 |
| LYD260 | b_juncea\|yd3\|E6ANDIZ01BMZAP | b_juncea | 186 | 673 |
| LYD261 | b_juncea\|yd3\|E6ANDIZ01A3LGY | b_juncea | 187 | 674 |
| LYD264 | b_juncea\|yd3\|C1E6ANDIZ01B2URL | b_juncea | 188 | 675 |
| LYD266 | b_juncea\|yd3\|GENCX189412 | b_juncea | 189 | 676 |
| LYD267 | b_juncea\|yd3\|E6ANDIZ01BB7PO | b_juncea | 190 | 677 |
| LYD268 | b_juncea\|gb164\|EVGN26566813750231 | b_juncea | 191 | 678 |
| LYD271 | b_juncea\|gb164\|EVGN08627136613786 | b_juncea | 192 | 679 |
| LYD273 | b_juncea\|yd3\|E6ANDIZ01D5PI2 | b_juncea | 193 | 680 |
| LYD275 | b_juncea\|yd3\|G2CD811838 | b_juncea | 194 | 681 |
| LYD276 | b_juncea\|yd3\|E7FJ1I302CBAW9 | b_juncea | 195 | 682 |
| LYD278 | b_juncea\|yd3\|A4M2E6ANDIZ01AZ32J | b_juncea | 196 | 683 |
| LYD279 | b_juncea\|yd3\|GENCD837122 | b_juncea | 197 | 684 |
| LYD282 | b_juncea\|yd3\|G2CD837360 | b_juncea | 198 | 685 |
| LYD283 | b_juncea\|yd3\|G2H74785 | b_juncea | 199 | 686 |
| LYD285 | b_juncea\|yd3\|C1E6ANDIZ01A8PO2 | b_juncea | 200 | 687 |
| LYD286 | b_juncea\|yd3\|TT1E6ANDIZ02HFR5M | b_juncea | 201 | 688 |
| LYD287 | arabidopsis\|gb165\|AT5G10860 | arabidopsis | 202 | 689 |
| LYD288 | b_juncea\|yd3\|E6ANDIZ01AZRCR | b_juncea | 203 | 690 |
| LYD124_H7 | canola\|gb161\|ES968317 | canola | 204 | 691 |
| LYD128_H1 | arabidopsis\|gb165\|AT5G51660 | arabidopsis | 205 | 692 |
| LYD267_H0 | arabidopsis\|gb165\|AT1G64790 | arabidopsis | 206 | 693 |
| LYD271_H0 | arabidopsis\|gb165\|AT2G47240 | arabidopsis | 207 | 694 |
| LYD89_H0 | arabidopsis\|gb165\|AT1G68050 | arabidopsis | 208 | 695 |
| LYM104 | rice\|gb157.2\|AK072782 | rice | 209 | 696 |
| LYM275 | barley\|gb157.3\|BE421069 | barley | 210 | 697 |
| LYD112 | b_juncea\|gb164\|EVGN00224711371076 | b_juncea | 211 | — |
| LYD115 | b_juncea\|yd3\|E6ANDIZ01AL3LA | b_juncea | 212 | — |
| LYD259 | b_juncea\|yd3\|CN827195 | b_juncea | 213 | — |
| LYD262 | b_juncea\|yd3\|A4M2E6ANDIZ01C3K15 | b_juncea | 214 | — |
| LYD265 | b_juncea\|gb164\|EVGN07822109542425 | b_juncea | 215 | — |
| LYD269 | b_juncea\|yd3\|A4M2E6ANDIZ02J3I20 | b_juncea | 216 | — |
| LYD270 | b_juncea\|yd3\|C1E6ANDIZ01AQ8V8 | b_juncea | 217 | — |
| LYD124 | b_juncea\|gb164\|EVGN10695305591742 | b_juncea | 99 | 724 |
| LYD152 | arabidopsis\|gb165\|AT5G02370 | arabidopsis | 117 | 729 |
| LYD128_H1 | arabidopsis\|gb165\|AT5G51660 | arabidopsis | 205 | 749 |
| LYD267_H0 | arabidopsis\|gb165\|AT1G64790 | arabidopsis | 206 | 750 |
| LYD12 | arabidopsis\|gb165\|AT3G60980 | arabidopsis | 218 | 698 |
| LYD18 | arabidopsis\|gb165\|AT4G24610 | arabidopsis | 219 | 502 |

TABLE 27-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polynuc. SEQ ID NO: | Polypep. SEQ ID NO: |
|---|---|---|---|---|
| LYD28 | medicago|09v1|BI271781 | medicago | 220 | 510 |
| LYD29 | medicago|09v1|CRPMT000438 | medicago | 221 | 699 |
| LYD35 | tomato|gb164|AI483874 | tomato | 222 | 700 |
| LYD40 | tomato|gb164|AI782539 | tomato | 223 | 701 |
| LYD41 | tomato|gb164|AJ784615 | tomato | 224 | 702 |
| LYD42 | tomato|gb164|AW036074 | tomato | 225 | 520 |
| LYD45 | tomato|gb164|AW618293 | tomato | 226 | 703 |
| LYD48 | tomato|gb164|BG123886 | tomato | 227 | 704 |
| LYD49 | tomato|gb164|BG123989 | tomato | 228 | 705 |
| LYD50 | tomato|gb164|BG127394 | tomato | 229 | 706 |
| LYD52 | tomato|gb164|BG128140 | tomato | 230 | 707 |
| LYD58 | tomato|gb164|BG134619 | tomato | 231 | 708 |
| LYD59 | tomato|gb164|BG135632 | tomato | 232 | 709 |
| LYD61 | tomato|gb164|BG138131 | tomato | 233 | 710 |
| LYD62 | tomato|gb164|BG734743 | tomato | 234 | 711 |
| LYD63 | tomato|gb164|BI206677 | tomato | 235 | 537 |
| LYD65 | tomato|gb164|BP895649 | tomato | 236 | 712 |
| LYD67 | tomato|gb164|DB701451 | tomato | 237 | 713 |
| LYD74 | tomato|gb164|AI490774 | tomato | 238 | 714 |
| LYD82 | tomato|gb164|BG630963 | tomato | 239 | 715 |
| LYD84 | arabidopsis|gb165|AT5G15254 | arabidopsis | 240 | 716 |
| LYD91 | tomato|gb164|BG643473 | tomato | 241 | 717 |
| LYD106 | arabidopsis|gb165|AT5G44930 | arabidopsis | 242 | 718 |
| LYD108 | canola|gb161|EV139574 | canola | 243 | 719 |
| LYD118 | b_juncea|yd3|E6ANDIZ01A3PN5 | b_juncea | 244 | 720 |
| LYD119 | b_juncea|gb164|EVGN01067614512362 | b_juncea | 245 | 721 |
| LYD120 | b_juncea|yd3|X1E6ANDIZ01EAN1T | b_juncea | 246 | 722 |
| LYD123 | b_juncea|gb164|EVGN08545904982944 | b_juncea | 247 | 723 |
| LYD127 | soybean|gb166|AW119405 | soybean | 248 | 725 |
| LYD133 | soybean|gb168|BI418412 | soybean | 249 | 593 |
| LYD142 | tomato|gb164|AI779400 | tomato | 250 | 726 |
| LYD144 | tomato|gb164|AW429188 | tomato | 251 | 727 |
| LYD150 | arabidopsis|gb165|AT1G61180 | arabidopsis | 252 | 728 |
| LYD153 | arabidopsis|gb165|AT5G42920 | arabidopsis | 253 | 605 |
| LYD157 | tomato|gb164|BG735318 | tomato | 254 | 607 |
| LYD174 | b_juncea|yd3|E6ANDIZ01AF3YB | b_juncea | 255 | 614 |
| LYD185 | b_juncea|gb164|EVGN01300508721002 | b_juncea | 256 | 730 |
| LYD192 | b_juncea|yd3|A4M2E6ANDIZ01B0ZJK | b_juncea | 257 | 731 |
| LYD208 | b_juncea|yd3|E6ANDIZ01BZ44C | b_juncea | 258 | 732 |
| LYD212 | arabidopsis|gb165|AT1G21560 | arabidopsis | 259 | 733 |
| LYD222 | arabidopsis|gb165|AT4G35985 | arabidopsis | 260 | 648 |
| LYD231 | sorghum|gb161.crp|CA827765 | sorghum | 261 | 734 |
| LYD232 | tomato|gb164|AI774782 | tomato | 262 | 735 |
| LYD235 | tomato|gb164|BG132066 | tomato | 263 | 736 |
| LYD248 | b_juncea|gb164|EVGN00459611963354 | b_juncea | 264 | 737 |
| LYD250 | b_juncea|yd3|C1E7FJ1I304DWSVV | b_juncea | 265 | 738 |
| LYD252 | b_juncea|yd3|E6ANDIZ01CP0S8 | b_juncea | 266 | 669 |
| LYD260 | b_juncea|yd3|E6ANDIZ01BMZAP | b_juncea | 267 | 739 |
| LYD261 | b_juncea|yd3|E6ANDIZ01A3LGY | b_juncea | 268 | 740 |
| LYD264 | b_juncea|yd3|C1E6ANDIZ01B2URL | b_juncea | 269 | 741 |
| LYD268 | b_juncea|yd3|C1E6ANDIZ01DMZ45 | b_juncea | 270 | 742 |
| LYD271 | b_juncea|gb164|EVGN08627136613786 | b_juncea | 271 | 743 |
| LYD273 | b_juncea|yd3|E6ANDIZ01D5PI2 | b_juncea | 272 | 744 |
| LYD276 | b_juncea|yd3|E7FJ1I302CBAW9 | b_juncea | 273 | 745 |
| LYD278 | b_juncea|yd3|A4M2E6ANDIZ01AZ32J | b_juncea | 274 | 746 |
| LYD283 | b_juncea|yd3|G2H74785 | b_juncea | 275 | 747 |
| LYD286 | b_juncea|yd3|TT1E6ANDIZ02HFR5M | b_juncea | 276 | 748 |
| LYD124_H7 | canola|gb161|ES968317 | canola | 277 | 691 |
| LYD112 | b_juncea|gb164|EVGN00224711371076 | b_juncea | 278 | — |
| LYD115 | b_juncea|yd3|E6ANDIZ01AL3LA | b_juncea | 279 | — |
| LYD259 | b_juncea|yd3|CN827195 | b_juncea | 280 | — |
| LYD262 | b_juncea|yd3|A4M2E6ANDIZ01C3K15 | b_juncea | 281 | — |
| LYD265 | b_juncea|gb164|EVGN07822109542425 | b_juncea | 282 | — |
| LYD269 | b_juncea|yd3|A4M2E6ANDIZ02J3I20 | b_juncea | 283 | — |
| LYD270 | b_juncea|yd3|C1E6ANDIZ01AQ8V8 | b_juncea | 284 | — |

Table 27:
Provided are the identified genes, their annotation, organism and polynucleotide and polypeptide sequence identifiers.
"polynucl." = polynucleotide;
"polypep." = polypeptide.

Example 11

Identification of Homologous Sequences that Increase Seed Yield, Oil Yield, Growth Rate, Oil Content, Fiber Yield, Fiber Quality, Biomass, Vigor, ABST and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have to diverged in function while true orthologs are more likely to retain identical function over evolutionary time.

To identify putative orthologs of the genes affecting plant yield, oil yield, oil content, seed yield, growth rate, vigor, biomass, abiotic stress tolerance and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and to TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext to Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Table 28, hereinbelow, lists a summary of orthologous and homologous sequences of the polynucleotide sequences and polypeptide sequences presented in Table 27 above, which were identified from the databases using the NCBI BLAST software (e.g., using the Blastp and tBlastn algorithms) and needle (EMBOSS package) as being at least 80% homologous to the selected polynucleotides and polypeptides, and which are expected to increase plant yield, seed yield, oil yield, oil content, growth rate, fiber yield, fiber quality, biomass, vigor, ABST and/or NUE of a plant.

TABLE 28

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 814 | LYD1 | arabidopsis_lyrata|09v1|JGIAL000277_P1 | 4852 | 488 | 88.1 | globlastp |
| 815 | LYD2 | arabidopsis_lyrata|09v1|JGIAL002442_T1 | 4853 | 489 | 95.28 | glotblastn |
| 816 | LYD2 | radish|gb164|EV527506_P1 | 4854 | 489 | 85.1 | globlastp |
| 817 | LYD2 | radish|gb164|EV543672_T1 | 4855 | 489 | 84.15 | glotblastn |
| 818 | LYD3 | arabidopsis_lyrata|09v1|JGIAL003335_P1 | 4856 | 490 | 97 | globlastp |
| 819 | LYD3 | canola|10v1|CD816459_P1 | 4857 | 490 | 87.3 | globlastp |
| 820 | LYD3 | canola|gb161|CD816459_P1 | 4858 | 490 | 87 | globlastp |
| 821 | LYD3 | radish|gb164|EV536106_P1 | 4859 | 490 | 83.8 | globlastp |
| 822 | LYD4 | arabidopsis_lyrata|09v1|JGIAL003600_P1 | 4860 | 491 | 96.3 | globlastp |
| 823 | LYD4 | canola|gb161|DY022340_P1 | 4861 | 491 | 81.1 | globlastp |
| 824 | LYD4 | canola|10v1|DY022340_P1 | 4862 | 491 | 80.9 | globlastp |
| 825 | LYD5 | arabidopsis_lyrata|09v1|JGIAL006945_P1 | 4863 | 492 | 88.9 | globlastp |
| 826 | LYD6 | arabidopsis_lyrata|09v1|JGIAL011942_P1 | 4864 | 493 | 94.6 | globlastp |
| 827 | LYD6 | canola|10v1|EE470649_P1 | 4865 | 493 | 83.6 | globlastp |
| 828 | LYD6 | canola|gb161|CD835605_T1 | 4866 | 493 | 83.46 | glotblastn |
| 829 | LYD6 | canola|10v1|DY005922_P1 | 4867 | 493 | 82.6 | globlastp |
| 830 | LYD7 | arabidopsis_lyrata|09v1|JGIAL013304_P1 | 4868 | 494 | 95.3 | globlastp |
| 831 | LYD7 | radish|gb164|EV526280_P1 | 4869 | 494 | 84.2 | globlastp |
| 832 | LYD7 | canola|10v1|EE464842_P1 | 4870 | 494 | 81.4 | globlastp |
| 833 | LYD7 | b_rapa|gb162|DN960346_P1 | 4871 | 494 | 81.4 | globlastp |
| 834 | LYD9 | arabidopsis_lyrata|09v1|JGIAL008425_P1 | 4872 | 495 | 96.8 | globlastp |
| 835 | LYD9 | canola|10v1|CX188920_P1 | 4873 | 495 | 87.5 | globlastp |
| 836 | LYD9 | canola|gb161|CX188920_P1 | 4874 | 495 | 87.2 | globlastp |
| 837 | LYD10 | arabidopsis_lyrata|09v1|JGIAL010075_P1 | 4875 | 496 | 94.2 | globlastp |
| 838 | LYD11 | arabidopsis_lyrata|09v1|JGIAL018613_P1 | 4876 | 497 | 91.7 | globlastp |
| 839 | LYD12 | arabidopsis_lyrata|09v1|JGIAL019555_P1 | 4877 | 498 | 80.3 | globlastp |
| 840 | LYD13 | arabidopsis_lyrata|09v1|JGIAL019486_T1 | 4878 | 499 | 94.88 | glotblastn |
| 841 | LYD14 | arabidopsis_lyrata|09v1|JGIAL023385_P1 | 4879 | 500 | 94.1 | globlastp |
| 842 | LYD14 | canola|10v1|CD829595_P1 | 4880 | 500 | 87.9 | globlastp |
| 843 | LYD14 | canola|gb161|CD829595_P1 | 4880 | 500 | 87.9 | globlastp |
| 844 | LYD14 | radish|gb164|EY944220_P1 | 4881 | 500 | 83.9 | globlastp |
| 845 | LYD18 | arabidopsis_lyrata|09v1|JGIAL025644_P1 | 4882 | 502 | 98 | globlastp |
| 846 | LYD20 | arabidopsis_lyrata|09v1|JGIAL020751_T1 | 4883 | 503 | 93.97 | glotblastn |
| 847 | LYD22 | arabidopsis_lyrata|09v1|JGIAL029529_P1 | 4884 | 505 | 93.6 | globlastp |
| 848 | LYD22 | canola|10v1|H07584_P1 | 4885 | 505 | 86.2 | globlastp |
| 849 | LYD22 | canola|gb161|H07584_P1 | 4885 | 505 | 86.2 | globlastp |
| 850 | LYD22 | canola|10v1|CD822100_P1 | 4886 | 505 | 85.1 | globlastp |
| 851 | LYD22 | canola|gb161|CD822100_P1 | 4886 | 505 | 85.1 | globlastp |
| 852 | LYD22 | radish|gb164|EV538885_P1 | 4887 | 505 | 85.1 | globlastp |
| 853 | LYD22 | thellungiella|gb167|DN772903_P1 | 4888 | 505 | 85.1 | globlastp |
| 854 | LYD22 | b_juncea|10v2|E6ANDIZ01CL8L1_P1 | 4889 | 505 | 84.6 | globlastp |
| 855 | LYD22 | canola|10v1|EG020309_P1 | 4890 | 505 | 84.6 | globlastp |
| 856 | LYD22 | canola|gb161|EG020309_P1 | 4890 | 505 | 84.6 | globlastp |
| 857 | LYD22 | radish|gb164|EV537868_P1 | 4891 | 505 | 84.6 | globlastp |
| 858 | LYD22 | b_rapa|gb162|EX016229_P1 | 4892 | 505 | 84 | globlastp |
| 859 | LYD22 | radish|gb164|EV525209_P1 | 4893 | 505 | 84 | globlastp |
| 860 | LYD22 | radish|gb164|EV537841_P1 | 4894 | 505 | 84 | globlastp |
| 861 | LYD22 | radish|gb164|EW732032_P1 | 4895 | 505 | 83.5 | globlastp |
| 862 | LYD23 | arabidopsis_lyrata|09v1|JGIAL029534_P1 | 4896 | 506 | 85.5 | globlastp |
| 863 | LYD25 | radish|gb164|EV527157_T1 | 4897 | 507 | 92.39 | glotblastn |
| 864 | LYD25 | b_rapa|gb162|EX019886_P1 | 4898 | 507 | 86.4 | globlastp |
| 865 | LYD25 | radish|gb164|EV528812_P1 | 4899 | 507 | 86.4 | globlastp |
| 866 | LYD25 | b_oleracea|gb161|EH428988_P1 | 4900 | 507 | 86.1 | globlastp |
| 867 | LYD25 | arabidopsis_lyrata|09v1|JGIAL027442_P1 | 4901 | 507 | 83.5 | globlastp |
| 868 | LYD25 | arabidopsis|10v1|AT5G42030_P1 | 4902 | 507 | 83.3 | globlastp |
| 869 | LYD26 | soybean|gb168|BU547748_P1 | 4903 | 508 | 83.8 | globlastp |
| 870 | LYD26 | pigeonpea|10v1|SRR054580S0003992_P1 | 4904 | 508 | 83.5 | globlastp |
| 871 | LYD26 | soybean|gb168|AL377960_P1 | 4905 | 508 | 83.5 | globlastp |
| 872 | LYD26 | peanut|10v1|ES759373_P1 | 4906 | 508 | 80.7 | globlastp |
| 873 | LYD26 | bean|gb167|FD790445_P1 | 4907 | 508 | 80.4 | globlastp |
| 874 | LYD29 | lotus|09v1|BP083688_P1 | 4908 | 511 | 81.6 | globlastp |
| 875 | LYD29 | soybean|gb168|CB891857_P1 | 4909 | 511 | 80.3 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 876 | LYD33 | potato\|gb157.2\|BG351683_P1 | 4910 | 512 | 96.5 | globlastp |
| 877 | LYD33 | solanum_phureja\|09v1\|SPHAF211815_P1 | 4910 | 512 | 96.5 | globlastp |
| 878 | LYD33 | potato\|10v1\|BG351683_P1 | 4910 | 512 | 96.5 | globlastp |
| 879 | LYD33 | potato\|gb157.2\|CK718359_T1 | 4911 | 512 | 91.67 | glotblastn |
| 880 | LYD33 | eggplant\|10v1\|FS026710_P1 | 4912 | 512 | 89.9 | globlastp |
| 881 | LYD33 | pepper\|gb171\|CO776598_P1 | 4913 | 512 | 87.6 | globlastp |
| 882 | LYD33 | tobacco\|gb162\|DV161243_P1 | 4914 | 512 | 83.8 | globlastp |
| 883 | LYD33 | solanum_phureja\|09v1\|SPHAW622515_T1 | 4915 | 512 | 80.21 | glotblastn |
| 884 | LYD34 | solanum_phureja\|09v1\|SPHAI483666_P1 | 4916 | 513 | 98.1 | globlastp |
| 885 | LYD34 | pepper\|gb171\|BM062207_P1 | 4917 | 513 | 92.7 | globlastp |
| 886 | LYD35 | solanum_phureja\|09v1\|SPHAJ306423_P1 | 4918 | 514 | 91.6 | globlastp |
| 887 | LYD35 | potato\|gb157.2\|AJ306423_P1 | 4919 | 514 | 91.1 | globlastp |
| 888 | LYD35 | potato\|10v1\|AJ306423_P1 | 4920 | 514 | 90.9 | globlastp |
| 889 | LYD35 | pepper\|gb171\|CA515906_P1 | 4921 | 514 | 82.5 | globlastp |
| 890 | LYD35 | nicotiana_benthamiana\|gb162\|CK280498_P1 | 4922 | 514 | 80.7 | globlastp |
| 891 | LYD36 | solanum_phureja\|09v1\|SPHAI485302_P1 | 4923 | 515 | 95.8 | globlastp |
| 892 | LYD36 | pepper\|gb171\|BM064313_P1 | 4924 | 515 | 89.4 | globlastp |
| 893 | LYD37 | potato\|10v1\|BE921890_P1 | 4925 | 516 | 89.1 | globlastp |
| 894 | LYD37 | potato\|gb157.2\|BE921890_P1 | 4925 | 516 | 89.1 | globlastp |
| 895 | LYD37 | solanum_phureja\|09v1\|SPHAI487977_T1 | 4926 | 516 | 88.24 | glotblastn |
| 896 | LYD37 | eggplant\|10v1\|FS013887_P1 | 4927 | 516 | 85.3 | globlastp |
| 897 | LYD37 | solanum_phureja\|09v1\|SPHBW686911_T1 | 4928 | 516 | 83.68 | glotblastn |
| 898 | LYD37 | solanum_phureja\|09v1\|SPHCRPSP002839_T1 | 4929 | 516 | 83.26 | glotblastn |
| 899 | LYD37 | pepper\|gb171\|CA522394_P1 | 4930 | 516 | 80.7 | globlastp |
| 900 | LYD37 | solanum_phureja\|09v1\|SPHCRPSP002387_P1 | 4931 | 516 | 80.1 | globlastp |
| 901 | LYD40 | solanum_phureja\|09v1\|SPHAI782539_P1 | 4932 | 518 | 89.5 | globlastp |
| 902 | LYD41 | potato\|10v1\|BF052865_P1 | 4933 | 519 | 84 | globlastp |
| 903 | LYD41 | nicotiana_benthamiana\|gb162\|CK280334_T1 | 4934 | 519 | 80 | glotblastn |
| 904 | LYD42 | potato\|10v1\|BE919699_P1 | 4935 | 520 | 87.4 | globlastp |
| 905 | LYD42 | solanum_phureja\|09v1\|SPHAW036074_P1 | 4936 | 520 | 87.4 | globlastp |
| 906 | LYD42 | potato\|gb157.2\|BE919699_T1 | 4937 | 520 | 86.94 | glotblastn |
| 907 | LYD43 | solanum_phureja\|09v1\|SPHAW037558_P1 | 4938 | 521 | 95.9 | globlastp |
| 908 | LYD43 | eggplant\|10v1\|FS004461_P1 | 4939 | 521 | 90.3 | globlastp |
| 909 | LYD43 | pepper\|gb171\|EB084651_P1 | 4940 | 521 | 88.4 | globlastp |
| 910 | LYD43 | tobacco\|gb162\|EB429609_P1 | 4941 | 521 | 88.3 | globlastp |
| 911 | LYD43 | petunia\|gb171\|FN008650_P1 | 4942 | 521 | 86.9 | globlastp |
| 912 | LYD44 | solanum_phureja\|09v1\|SPHAW217297_P1 | 4943 | 522 | 91.1 | globlastp |
| 913 | LYD44 | eggplant\|10v1\|FS043660_P1 | 4944 | 522 | 90.3 | globlastp |
| 914 | LYD44 | potato\|gb157.2\|BQ514775_P1 | 4945 | 522 | 90.3 | globlastp |
| 915 | LYD44 | pepper\|gb171\|GD056569_P1 | 4946 | 522 | 86.6 | globlastp |
| 916 | LYD44 | tobacco\|gb162\|AF211657_T1 | 4947 | 522 | 83.12 | glotblastn |
| 917 | LYD47 | potato\|gb157.2\|BG095639_P1 | 4948 | 524 | 97.1 | globlastp |
| 918 | LYD47 | potato\|10v1\|BG095639_P1 | 4949 | 524 | 96.4 | globlastp |
| 919 | LYD47 | solanum_phureja\|09v1\|SPHBG123883_P1 | 4950 | 524 | 95.7 | globlastp |
| 920 | LYD47 | potato\|gb157.2\|BG097730_P1 | 4951 | 524 | 95.3 | globlastp |
| 921 | LYD47 | eggplant\|10v1\|FS002881_P1 | 4952 | 524 | 89.5 | globlastp |
| 922 | LYD47 | pepper\|gb171\|BM063195_P1 | 4953 | 524 | 89.5 | globlastp |
| 923 | LYD47 | tobacco\|gb162\|EB426460_P1 | 4954 | 524 | 83 | globlastp |
| 924 | LYD48 | solanum_phureja\|09v1\|SPHBG123886_T1 | 4955 | 525 | 92.64 | glotblastn |
| 925 | LYD48 | eggplant\|10v1\|FS025632_P1 | 4956 | 525 | 88.7 | globlastp |
| 926 | LYD48 | potato\|10v1\|CV503109_T1 | 4957 | 525 | 87.94 | glotblastn |
| 927 | LYD50 | solanum_phureja\|09v1\|SPHBG127394_P1 | 4958 | 527 | 94.1 | globlastp |
| 928 | LYD50 | pepper\|gb171\|BM064159_P1 | 4959 | 527 | 87.7 | globlastp |
| 929 | LYD50 | pepper\|gb171\|CA517048_P1 | 4960 | 527 | 80.7 | globlastp |
| 930 | LYD50 | tomato\|09v1\|BG131854_P1 | 4961 | 527 | 80.7 | globlastp |
| 931 | LYD50 | tomato\|gb164\|BG131854_P1 | 4961 | 527 | 80.7 | globlastp |
| 932 | LYD50 | potato\|10v1\|BI406827_T1 | 4962 | 527 | 80.67 | glotblastn |
| 933 | LYD50 | potato\|gb157.2\|BI406827_T1 | 4962 | 527 | 80.67 | glotblastn |
| 934 | LYD50 | solanum_phureja\|09v1\|SPHBG131854_P1 | 4963 | 527 | 80.3 | globlastp |
| 935 | LYD50 | tobacco\|gb162\|CN498866_P1 | 4964 | 527 | 80.1 | globlastp |
| 936 | LYD51 | potato\|gb157.2\|CK851783_P1 | 4965 | 528 | 98.9 | globlastp |
| 937 | LYD51 | potato\|10v1\|BG887178_P1 | 4965 | 528 | 98.9 | globlastp |
| 938 | LYD51 | potato\|gb157.2\|CV286494_P1 | 4966 | 528 | 98.4 | globlastp |
| 939 | LYD51 | potato\|gb157.2\|BG887178_P1 | 4967 | 528 | 95.7 | globlastp |
| 940 | LYD51 | solanum_phureja\|09v1\|SPHBG127506_P1 | 4968 | 528 | 95.7 | globlastp |
| 941 | LYD51 | pepper\|gb171\|CO776357_P1 | 4969 | 528 | 91.4 | globlastp |
| 941 | LYD224 | pepper\|gb171\|CO776357_P1 | 4969 | 650 | 80.1 | globlastp |
| 942 | LYD51 | eggplant\|10v1\|FS010852_P1 | 4970 | 528 | 88.6 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 943 | LYD51 | tobacco\|gb162\|DV157738_P1 | 4971 | 528 | 88.1 | globlastp |
| 944 | LYD51 | tobacco\|gb162\|EB446434_P1 | 4972 | 528 | 86.5 | globlastp |
| 944 | LYD224 | tobacco\|gb162\|EB446434_P1 | 4972 | 650 | 81.2 | globlastp |
| 945 | LYD51 | tomato\|09v1\|BG135563_P1 | 4973 | 528 | 84.3 | globlastp |
| 946 | LYD51 | tomato\|gb164\|BG135563_P1 | 4973 | 528 | 84.3 | globlastp |
| 947 | LYD51 | papaya\|gb165\|AM903594_P1 | 4974 | 528 | 83.2 | globlastp |
| 948 | LYD51 | triphysaria\|gb164\|DR172528_P1 | 4975 | 528 | 83.2 | globlastp |
| 948 | LYD224 | triphysaria\|gb164\|DR172528_P1 | 4975 | 650 | 82.8 | globlastp |
| 949 | LYD51 | antirrhinum\|gb166\|AJ792731_P1 | 4976 | 528 | 82.8 | globlastp |
| 949 | LYD224 | antirrhinum\|gb166\|AJ792731_P1 | 4976 | 650 | 80.7 | globlastp |
| 950 | LYD51 | cacao\|gb167\|CU507814_P1 | 4977 | 528 | 82.7 | globlastp |
| 951 | LYD51 | potato\|10v1\|BG890660_P1 | 4978 | 528 | 82.7 | globlastp |
| 952 | LYD51 | potato\|gb157.2\|BG890660_P1 | 4978 | 528 | 82.7 | globlastp |
| 953 | LYD51 | triphysaria\|10v1\|DR172528_P1 | 4979 | 528 | 82.7 | globlastp |
| 953 | LYD224 | triphysaria\|10v1\|DR172528_P1 | 4979 | 650 | 82.3 | globlastp |
| 954 | LYD51 | castorbean\|09v1\|XM002523459_P1 | 4980 | 528 | 82.4 | globlastp |
| 955 | LYD51 | ipomoea_nil\|10v1\|BJ557864_P1 | 4981 | 528 | 82.3 | globlastp |
| 956 | LYD51 | ipomoea\|gb157.2\|BJ557864_P1 | 4982 | 528 | 82.3 | globlastp |
| 957 | LYD51 | petunia\|gb171\|FN009866_T1 | 4983 | 528 | 82.26 | glotblastn |
| 958 | LYD51 | cotton\|10v1\|BG440664_P1 | 4984 | 528 | 82.2 | globlastp |
| 959 | LYD51 | pepper\|gb171\|CO910024_P1 | 4985 | 528 | 82.2 | globlastp |
| 960 | LYD51 | blueberry\|10v1\|CV090845_P1 | 4986 | 528 | 81.6 | globlastp |
| 961 | LYD51 | cotton\|gb164\|BG440664_P1 | 4987 | 528 | 81.6 | globlastp |
| 962 | LYD51 | peanut\|10v1\|ES719286_P1 | 4988 | 528 | 81.6 | globlastp |
| 963 | LYD51 | peanut\|gb171\|EH042075_P1 | 4988 | 528 | 81.6 | globlastp |
| 964 | LYD51 | solanum_phureja\|09v1\|SPHBI203337_P1 | 4989 | 528 | 81.6 | globlastp |
| 965 | LYD51 | walnuts\|gb166\|CV195852_P1 | 4990 | 528 | 81.6 | globlastp |
| 966 | LYD51 | poplar\|gb170\|BI068309_P1 | 4991 | 528 | 81.2 | globlastp |
| 967 | LYD51 | chestnut\|gb170\|SRR006295S0012962_P1 | 4992 | 528 | 81.1 | globlastp |
| 968 | LYD51 | lettuce\|10v1\|DW075260_P1 | 4993 | 528 | 81.1 | globlastp |
| 969 | LYD51 | lettuce\|gb157.2\|DW075260_P1 | 4993 | 528 | 81.1 | globlastp |
| 970 | LYD51 | lettuce\|gb157.2\|DW138454_P1 | 4994 | 528 | 81.1 | globlastp |
| 971 | LYD51 | oil_palm\|gb166\|ES370588_T1 | 4995 | 528 | 81.08 | glotblastn |
| 972 | LYD51 | poplar\|10v1\|BI068309_P1 | 4996 | 528 | 80.6 | globlastp |
| 973 | LYD51 | dandelion\|10v1\|DR399893_P1 | 4997 | 528 | 80.5 | globlastp |
| 974 | LYD51 | oak\|10v1\|SRR006307S0007944_P1 | 4998 | 528 | 80.5 | globlastp |
| 975 | LYD51 | cichorium\|gb171\|EH690884_P1 | 4999 | 528 | 80.5 | globlastp |
| 976 | LYD51 | lettuce\|gb157.2\|DW145838_P1 | 5000 | 528 | 80.5 | globlastp |
| 977 | LYD51 | monkeyflower\|09v1\|CV520488_P1 | 5001 | 528 | 80.5 | globlastp |
| 978 | LYD51 | monkeyflower\|10v1\|CV520488_P1 | 5001 | 528 | 80.5 | globlastp |
| 979 | LYD51 | lettuce\|10v1\|DW043917_P1 | 5000 | 528 | 80.5 | globlastp |
| 980 | LYD51 | eschscholzia\|10v1\|CD476754_P1 | 5002 | 528 | 80.2 | globlastp |
| 981 | LYD51 | curcuma\|10v1\|DY383234_P1 | 5003 | 528 | 80.1 | globlastp |
| 982 | LYD51 | nasturtium\|10v1\|GH162572_P1 | 5004 | 528 | 80.1 | globlastp |
| 983 | LYD51 | tamarix\|gb166\|CF199524_P1 | 5005 | 528 | 80.1 | globlastp |
| 984 | LYD51 | cassava\|09v1\|CK652227_T1 | 5006 | 528 | 80 | glotblastn |
| 985 | LYD51 | heritiera\|10v1\|SRR005794S0007518_P1 | 5007 | 528 | 80 | globlastp |
| 986 | LYD51 | oak\|10v1\|CR627779_P1 | 5008 | 528 | 80 | globlastp |
| 987 | LYD51 | oak\|10v1\|FN742298_P1 | 5008 | 528 | 80 | globlastp |
| 988 | LYD51 | kiwi\|gb166\|FG411068_P1 | 5009 | 528 | 80 | globlastp |
| 989 | LYD51 | lettuce\|gb157.2\|DW043917_P1 | 5010 | 528 | 80 | globlastp |
| 990 | LYD51 | monkeyflower\|09v1\|GO964150_P1 | 5011 | 528 | 80 | globlastp |
| 991 | LYD51 | oak\|gb170\|DB996542_T1 | 5012 | 528 | 80 | glotblastn |
| 992 | LYD51 | oak\|gb170\|SRR006309S0020036_P1 | 5013 | 528 | 80 | globlastp |
| 993 | LYD52 | solanum_phureja\|09v1\|SPHBG128140_P1 | 5014 | 529 | 92 | globlastp |
| 994 | LYD52 | tomato\|09v1\|BF052558_P1 | 5015 | 529 | 80.4 | globlastp |
| 995 | LYD53 | solanum_phureja\|09v1\|SPHBG128949_P1 | 5016 | 530 | 89.7 | globlastp |
| 996 | LYD53 | potato\|10v1\|CK718279_T1 | 5017 | 530 | 88.79 | glotblastn |
| 997 | LYD53 | potato\|gb157.2\|CK718279_T1 | 5018 | 530 | 87 | glotblastn |
| 998 | LYD53 | solanum_phureja\|09v1\|SPHAJ785469_P1 | 5019 | 530 | 82.5 | globlastp |
| 999 | LYD55 | potato\|gb157.2\|BG591939_P1 | 5020 | 531 | 90.1 | globlastp |
| 1000 | LYD55 | solanum_phureja\|09v1\|SPHBG131146_P1 | 5021 | 531 | 89.4 | globlastp |
| 1001 | LYD55 | eggplant\|10v1\|FS010619_P1 | 5022 | 531 | 86.5 | globlastp |
| 1002 | LYD55 | potato\|10v1\|BG591939_P1 | 5023 | 531 | 84.6 | globlastp |
| 1003 | LYD55 | pepper\|gb171\|BM062230_P1 | 5024 | 531 | 80 | globlastp |
| 1004 | LYD57 | solanum_phureja\|09v1\|SPHBG134380_P1 | 5025 | 532 | 91.3 | globlastp |
| 1005 | LYD57 | pepper\|gb171\|BM063304_T1 | 5026 | 532 | 88.37 | glotblastn |
| 1006 | LYD58 | solanum_phureja\|09v1\|SPHBG134619_T1 | 5027 | 533 | 83.21 | glotblastn |
| 1007 | LYD58 | solanum_phureja\|09v1\|SPHBG627533_P1 | 5028 | 533 | 81.3 | globlastp |
| 1008 | LYD59 | solanum_phureja\|09v1\|SPHBG135632_P1 | 5029 | 534 | 97.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1009 | LYD59 | potato\|10v1\|BE920142_P1 | 5030 | 534 | 97.5 | globlastp |
| 1010 | LYD59 | potato\|gb157.2\|BE920142_P1 | 5030 | 534 | 97.5 | globlastp |
| 1011 | LYD59 | eggplant\|10v1\|FS003439_P1 | 5031 | 534 | 93.8 | globlastp |
| 1012 | LYD59 | tomato\|09v1\|TOMTRALTBE_P1 | 5032 | 534 | 83.4 | globlastp |
| 1013 | LYD59 | tomato\|gb164\|TOMTRALTBE_P1 | 5032 | 534 | 83.4 | globlastp |
| 1014 | LYD59 | grape\|gb160\|BQ796337_P1 | 5033 | 534 | 81.6 | globlastp |
| 1015 | LYD59 | monkeyflower\|10v1\|GO970770_P1 | 5034 | 534 | 80.7 | globlastp |
| 1016 | LYD59 | prunus\|10v1\|BU039926_P1 | 5035 | 534 | 80.2 | globlastp |
| 1017 | LYD59 | chestnut\|gb170\|AF417293_T1 | 5036 | 534 | 80.18 | glotblastn |
| 1018 | LYD59 | poplar\|10v1\|BU823552_P1 | 5037 | 534 | 80 | globlastp |
| 1019 | LYD61 | solanum_phureja\|09v1\|SPHBG138131_P1 | 5038 | 535 | 98.5 | globlastp |
| 1020 | LYD61 | potato\|10v1\|BG889997_P1 | 5039 | 535 | 98.2 | globlastp |
| 1021 | LYD61 | potato\|gb157.2\|BG889997_P1 | 5040 | 535 | 97.9 | globlastp |
| 1022 | LYD61 | eggplant\|10v1\|FS032594_P1 | 5041 | 535 | 93.9 | globlastp |
| 1023 | LYD62 | solanum_phureja\|09v1\|SPHCV504049_P1 | 5042 | 536 | 90.5 | globlastp |
| 1024 | LYD62 | potato\|gb157.2\|CV504049_P1 | 5043 | 536 | 88.5 | globlastp |
| 1025 | LYD65 | potato\|10v1\|CK273548_P1 | 5044 | 538 | 83.6 | globlastp |
| 1026 | LYD65 | potato\|gb157.2\|CK273548_P1 | 5044 | 538 | 83.6 | globlastp |
| 1027 | LYD65 | solanum_phureja\|09v1\|SPHCK273548_P1 | 5045 | 538 | 83.3 | globlastp |
| 1028 | LYD66 | solanum_phureja\|09v1\|SPHCD002407_P1 | 5046 | 539 | 96.4 | globlastp |
| 1029 | LYD66 | tomato\|09v1\|FG549581_P1 | 5047 | 539 | 95.2 | globlastp |
| 1030 | LYD66 | solanum_phureja\|09v1\|SPHGO374369_P1 | 5048 | 539 | 95.2 | globlastp |
| 1031 | LYD66 | potato\|10v1\|EG013178_P1 | 5049 | 539 | 92.8 | globlastp |
| 1032 | LYD66 | solanum_phureja\|09v1\|SPHAI486008_P1 | 5050 | 539 | 92.8 | globlastp |
| 1033 | LYD66 | solanum_phureja\|09v1\|SPHCK468681_P1 | 5051 | 539 | 91.6 | globlastp |
| 1034 | LYD66 | solanum_phureja\|09v1\|SPHSRR015435S0258823_P1 | 5052 | 539 | 90.4 | globlastp |
| 1035 | LYD66 | pepper\|gb171\|GD112009_P1 | 5053 | 539 | 88 | globlastp |
| 1036 | LYD66 | tomato\|09v1\|AI486008_P1 | 5054 | 539 | 86.7 | globlastp |
| 1037 | LYD66 | pepper\|gb171\|CA524720_P1 | 5055 | 539 | 86.7 | globlastp |
| 1038 | LYD66 | tomato\|gb164\|AI486008_P1 | 5054 | 539 | 86.7 | globlastp |
| 1039 | LYD66 | eggplant\|10v1\|FS049175_P1 | 5056 | 539 | 85.7 | globlastp |
| 1040 | LYD66 | petunia\|gb171\|FN013481_P1 | 5057 | 539 | 82.6 | globlastp |
| 1041 | LYD66 | petunia\|gb171\|CV294587_P1 | 5058 | 539 | 81.4 | globlastp |
| 1042 | LYD66 | tobacco\|gb162\|EB451442_P1 | 5059 | 539 | 80.5 | globlastp |
| 1043 | LYD67 | solanum_phureja\|09v1\|SPHBF113276_P1 | 5060 | 540 | 96.7 | globlastp |
| 1044 | LYD67 | potato\|10v1\|BQ514597_P1 | 5061 | 540 | 87.7 | globlastp |
| 1045 | LYD67 | potato\|gb157.2\|BQ514597_P1 | 5061 | 540 | 87.7 | globlastp |
| 1046 | LYD69 | arabidopsis_lyrata\|09v1\|JGIAL022233_P1 | 5062 | 541 | 91.5 | globlastp |
| 1047 | LYD69 | arabidopsis\|10v1\|AT5G25130_P1 | 5063 | 541 | 90.9 | globlastp |
| 1048 | LYD69 | arabidopsis\|gb165\|AT5G25130_P1 | 5063 | 541 | 90.9 | globlastp |
| 1049 | LYD69 | arabidopsis\|10v1\|AT5G25140_P1 | 5064 | 541 | 81.9 | globlastp |
| 1050 | LYD69 | arabidopsis\|10v1\|AT5G25180_P1 | 5065 | 541 | 81 | globlastp |
| 1051 | LYD70 | b_rapa\|gb162\|CO749669_P1 | 5066 | 542 | 99 | globlastp |
| 1052 | LYD70 | canola\|10v1\|CB686270_P1 | 5067 | 542 | 87.8 | globlastp |
| 1053 | LYD70 | canola\|gb161\|CB686270_P1 | 5067 | 542 | 87.8 | globlastp |
| 1054 | LYD70 | b_oleracea\|gb161\|DY026133_T1 | 5068 | 542 | 87.18 | glotblastn |
| 1055 | LYD70 | radish\|gb164\|AF052690_P1 | 5069 | 542 | 86.1 | globlastp |
| 1056 | LYD70 | thellungiella\|gb167\|BM985518_T1 | 5070 | 542 | 80.26 | glotblastn |
| 1057 | LYD71 | b_oleracea\|gb161\|DY027446_P1 | 543 | 543 | 100 | globlastp |
| 1058 | LYD71 | canola\|gb161\|CD817725_P1 | 5071 | 543 | 97.1 | globlastp |
| 1059 | LYD71 | b_rapa\|gb162\|CV544359_P1 | 5072 | 543 | 96.3 | globlastp |
| 1060 | LYD71 | b_juncea\|10v2\|E6ANDIZ01BK9AI_P1 | 5073 | 543 | 94.2 | globlastp |
| 1061 | LYD72 | canola\|10v1\|CD818215_P1 | 5074 | 544 | 81.7 | globlastp |
| 1062 | LYD72 | canola\|gb161\|CD825357_P1 | 5075 | 544 | 81.7 | globlastp |
| 1063 | LYD72 | canola\|10v1\|CD836921_P1 | 5076 | 544 | 81.5 | globlastp |
| 1064 | LYD72 | cucumber\|09v1\|CK755361_P1 | 5077 | 544 | 81.4 | globlastp |
| 1065 | LYD72 | sunflower\|10v1\|CD848269_P1 | 5078 | 544 | 81.2 | globlastp |
| 1066 | LYD72 | melon\|10v1\|DV634181_P1 | 5079 | 544 | 81 | globlastp |
| 1067 | LYD72 | artemisia\|gb164\|EY053079_T1 | 5080 | 544 | 80.94 | glotblastn |
| 1068 | LYD72 | tomato\|09v1\|AI779245_P1 | 5081 | 544 | 80.9 | globlastp |
| 1069 | LYD72 | monkeyflower\|09v1\|GO998343_P1 | 5082 | 544 | 80.7 | globlastp |
| 1070 | LYD72 | monkeyflower\|10v1\|GO998343_P1 | 5082 | 544 | 80.7 | globlastp |
| 1071 | LYD72 | radish\|gb164\|EW716526_P1 | 5083 | 544 | 80.7 | globlastp |
| 1072 | LYD72 | dandelion\|10v1\|DY820612_T1 | 5084 | 544 | 80.68 | glotblastn |
| 1073 | LYD72 | arabidopsis\|10v1\|AT4G27070_T1 | 5085 | 544 | 80.68 | glotblastn |
| 1074 | LYD72 | arabidopsis_lyrata\|09v1\|JGIAL030016_P1 | 5086 | 544 | 80.3 | globlastp |
| 1075 | LYD72 | nasturtium\|10v1\|SRR032558S0038114_P1 | 5087 | 544 | 80.1 | globlastp |
| 1076 | LYD73 | solanum_phureja\|09v1\|SPHAA824853_T1 | 5088 | 545 | 97.84 | glotblastn |
| 1077 | LYD73 | monkeyflower\|10v1\|GR111848_P1 | 5089 | 545 | 83.2 | globlastp |
| 1078 | LYD73 | triphysaria\|10v1\|EY174824_P1 | 5090 | 545 | 82.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1079 | LYD73 | monkeyflower\|09v1\|GR111848_T1 | 5091 | 545 | 82.66 | glotblastn |
| 1080 | LYD73 | triphysaria\|gb164\|EY174824_T1 | 5092 | 545 | 82.11 | glotblastn |
| 1081 | LYD73 | pigeonpea\|10v1\|SRR054580S0040813_P1 | 5093 | 545 | 81 | globlastp |
| 1082 | LYD73 | apple\|gb171\|CN444478_P1 | 5094 | 545 | 80.8 | globlastp |
| 1083 | LYD73 | prunus\|gb167\|AJ872422_P1 | 5095 | 545 | 80.5 | globlastp |
| 1084 | LYD73 | soybean\|gb168\|AL380796_P1 | 5096 | 545 | 80.4 | globlastp |
| 1085 | LYD73 | prunus\|10v1\|CN445461_T1 | 5097 | 545 | 80.27 | glotblastn |
| 1086 | LYD73 | cowpea\|gb166\|FF394654_T1 | 5098 | 545 | 80.22 | glotblastn |
| 1087 | LYD74 | potato\|gb157.2\|BE919413_P1 | 5099 | 546 | 96.3 | globlastp |
| 1088 | LYD74 | solanum_phureja\|09v1\|SPHAA824836_P1 | 5099 | 546 | 96.3 | globlastp |
| 1089 | LYD74 | potato\|10v1\|BE919413_P1 | 5099 | 546 | 96.3 | globlastp |
| 1090 | LYD74 | potato\|gb157.2\|CK262220_P1 | 5100 | 546 | 94.3 | globlastp |
| 1091 | LYD74 | potato\|gb157.2\|BG890062_P1 | 5101 | 546 | 93.5 | globlastp |
| 1092 | LYD74 | tomato\|09v1\|TOMPSI_P1 | 5102 | 546 | 93.5 | globlastp |
| 1093 | LYD74 | tomato\|gb164\|TOMPSI_P1 | 5102 | 546 | 93.5 | globlastp |
| 1094 | LYD74 | potato\|gb157.2\|BE921836_P1 | 5103 | 546 | 93.1 | globlastp |
| 1095 | LYD74 | solanum_phureja\|09v1\|SPHTOMPSI_P1 | 5103 | 546 | 93.1 | globlastp |
| 1096 | LYD74 | potato\|10v1\|BE921836_P1 | 5103 | 546 | 93.1 | globlastp |
| 1097 | LYD74 | pepper\|gb171\|AA840636_P1 | 5104 | 546 | 91.9 | globlastp |
| 1098 | LYD74 | eggplant\|10v1\|FS024905_P1 | 5105 | 546 | 91.1 | globlastp |
| 1099 | LYD74 | tobacco\|gb162\|CV017194_P1 | 5106 | 546 | 91.1 | globlastp |
| 1100 | LYD74 | nicotiana_benthamiana\|gb162\|CN655516_P1 | 5107 | 546 | 90.7 | globlastp |
| 1101 | LYD74 | tobacco\|gb162\|CO046507_P1 | 5108 | 546 | 90.7 | globlastp |
| 1102 | LYD74 | tobacco\|gb162\|CV016100_P1 | 5109 | 546 | 90.7 | globlastp |
| 1103 | LYD74 | nicotiana_benthamiana\|gb162\|CN655239_P1 | 5110 | 546 | 90.2 | globlastp |
| 1104 | LYD74 | tobacco\|gb162\|BU673932_P1 | 5110 | 546 | 90.2 | globlastp |
| 1105 | LYD74 | nicotiana_benthamiana\|gb162\|CN741940_P1 | 5111 | 546 | 89.8 | globlastp |
| 1106 | LYD74 | petunia\|gb171\|CV295755_P1 | 5112 | 546 | 89.4 | globlastp |
| 1107 | LYD74 | nicotiana_benthamiana\|gb162\|CN742501_P1 | 5113 | 546 | 89 | globlastp |
| 1108 | LYD74 | lettuce\|gb157.2\|DW043670_P1 | 5114 | 546 | 87.9 | globlastp |
| 1109 | LYD74 | lettuce\|gb157.2\|DW145751_P1 | 5114 | 546 | 87.9 | globlastp |
| 1110 | LYD74 | lettuce\|10v1\|CV700018_P1 | 5114 | 546 | 87.9 | globlastp |
| 1111 | LYD74 | antirrhinum\|gb166\|AJ790880_P1 | 5115 | 546 | 87.8 | globlastp |
| 1112 | LYD74 | lettuce\|gb157.2\|CV700018_P1 | 5116 | 546 | 87.4 | globlastp |
| 1113 | LYD74 | lettuce\|10v1\|DW074491_P1 | 5117 | 546 | 87.4 | globlastp |
| 1114 | LYD74 | lettuce\|gb157.2\|DW074491_P1 | 5117 | 546 | 87.4 | globlastp |
| 1115 | LYD74 | prunus\|gb167\|AJ872311_P1 | 5118 | 546 | 86.8 | globlastp |
| 1116 | LYD74 | kiwi\|gb166\|FG400771_P1 | 5119 | 546 | 86.7 | globlastp |
| 1117 | LYD74 | centaurea\|gb166\|EL930984_P1 | 5120 | 546 | 86.6 | globlastp |
| 1118 | LYD74 | dandelion\|10v1\|DQ160108_P1 | 5121 | 546 | 86.6 | globlastp |
| 1119 | LYD74 | dandelion\|gb161\|DQ160108_P1 | 5121 | 546 | 86.6 | globlastp |
| 1120 | LYD74 | lettuce\|gb157.2\|DW047470_P1 | 5122 | 546 | 86.6 | globlastp |
| 1121 | LYD74 | cucumber\|09v1\|CK085482_P1 | 5123 | 546 | 86.2 | globlastp |
| 1122 | LYD74 | apple\|gb171\|AY347803_P1 | 5124 | 546 | 86 | globlastp |
| 1123 | LYD74 | apple\|gb171\|CN878571_P1 | 5125 | 546 | 86 | globlastp |
| 1124 | LYD74 | melon\|10v1\|DV631727_P1 | 5126 | 546 | 85.8 | globlastp |
| 1125 | LYD74 | artemisia\|10v1\|EY032037_P1 | 5127 | 546 | 85.8 | globlastp |
| 1126 | LYD74 | artemisia\|gb164\|EY032037_P1 | 5128 | 546 | 85.8 | globlastp |
| 1127 | LYD74 | artemisia\|gb164\|EY033150_P1 | 5127 | 546 | 85.8 | globlastp |
| 1128 | LYD74 | senecio\|gb170\|DY658127_P1 | 5129 | 546 | 85.8 | globlastp |
| 1129 | LYD74 | strawberry\|gb164\|CO816702_P1 | 5130 | 546 | 85.8 | globlastp |
| 1130 | LYD74 | sunflower\|gb162\|BU672054_P1 | 5131 | 546 | 85.8 | globlastp |
| 1131 | LYD74 | sunflower\|10v1\|BU672054_P1 | 5132 | 546 | 85.4 | globlastp |
| 1132 | LYD74 | catharanthus\|gb166\|EG554591_P1 | 5133 | 546 | 85.4 | globlastp |
| 1133 | LYD74 | sunflower\|10v1\|CD845700_P1 | 5134 | 546 | 85.4 | globlastp |
| 1134 | LYD74 | cotton\|10v1\|CA993646_P1 | 5135 | 546 | 85.1 | globlastp |
| 1135 | LYD74 | cotton\|10v1\|CD485707_P1 | 5136 | 546 | 85 | globlastp |
| 1136 | LYD74 | beet\|gb162\|BQ487964_P1 | 5137 | 546 | 85 | globlastp |
| 1137 | LYD74 | castorbean\|09v1\|EG656437_P1 | 5138 | 546 | 85 | globlastp |
| 1138 | LYD74 | chestnut\|gb170\|SRR006295S0033318_P1 | 5139 | 546 | 85 | globlastp |
| 1139 | LYD74 | cynara\|gb167\|GE589113_P1 | 5140 | 546 | 85 | globlastp |
| 1140 | LYD74 | poplar\|10v1\|BI068408_P1 | 5141 | 546 | 85 | globlastp |
| 1141 | LYD74 | spurge\|gb161\|DV128345_P1 | 5142 | 546 | 85 | globlastp |
| 1142 | LYD74 | sunflower\|gb162\|CD845700_P1 | 5143 | 546 | 85 | globlastp |
| 1143 | LYD74 | triphysaria\|gb164\|EY127386_P1 | 5144 | 546 | 85 | globlastp |
| 1144 | LYD74 | ipomoea_nil\|10v1\|BJ554139_P1 | 5145 | 546 | 84.8 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1145 | LYD74 | ipomoea_batatas\|10v1\|BM878729_P1 | 5146 | 546 | 84.7 | globlastp |
| 1146 | LYD74 | cotton\|gb164\|CA993646_P1 | 5147 | 546 | 84.7 | globlastp |
| 1147 | LYD74 | triphysaria\|10v1\|EY127386_P1 | 5148 | 546 | 84.6 | globlastp |
| 1148 | LYD74 | triphysaria\|10v1\|SRR023500S0001172_P1 | 5149 | 546 | 84.6 | globlastp |
| 1149 | LYD74 | cassava\|09v1\|DV443354_P1 | 5150 | 546 | 84.6 | globlastp |
| 1150 | LYD74 | cassava\|gb164\|DV443354_P1 | 5150 | 546 | 84.6 | globlastp |
| 1151 | LYD74 | citrus\|gb166\|BQ623380_P1 | 5151 | 546 | 84.6 | globlastp |
| 1152 | LYD74 | poplar\|gb170\|BI068408_P1 | 5152 | 546 | 84.6 | globlastp |
| 1153 | LYD74 | cleome_gynandra\|10v1\|SRR015532S0002528_P1 | 5153 | 546 | 84.3 | globlastp |
| 1154 | LYD74 | cleome_spinosa\|10v1\|SRR015531S0000163_P1 | 5154 | 546 | 84.3 | globlastp |
| 1155 | LYD74 | soybean\|gb168\|BE316989_P1 | 5155 | 546 | 84.3 | globlastp |
| 1156 | LYD74 | soybean\|gb168\|BE324912_P1 | 5156 | 546 | 84.3 | globlastp |
| 1157 | LYD74 | b_juncea\|10v2\|E6ANDIZ01A1BN1_P1 | 5157 | 546 | 84.1 | globlastp |
| 1158 | LYD74 | cassava\|09v1\|CK644716_P1 | 5158 | 546 | 84.1 | globlastp |
| 1159 | LYD74 | b_juncea\|10v2\|E6ANDIZ01AVS2X_P1 | 5159 | 546 | 84.1 | globlastp |
| 1160 | LYD74 | b_juncea\|10v2\|E6ANDIZ01AH1XS_P1 | 5160 | 546 | 84.1 | globlastp |
| 1161 | LYD74 | b_juncea\|10v2\|E6ANDIZ01A1C0H_P1 | 5161 | 546 | 84.1 | globlastp |
| 1162 | LYD74 | b_juncea\|gb164\|EVGN00147211371919_P1 | 5161 | 546 | 84.1 | globlastp |
| 1163 | LYD74 | b_rapa\|gb162\|CO750665_P1 | 5162 | 546 | 84.1 | globlastp |
| 1164 | LYD74 | lotus\|09v1\|LLCN824968_P1 | 5163 | 546 | 84.1 | globlastp |
| 1165 | LYD74 | maize\|gb170\|LLDQ245113_P1 | 5161 | 546 | 84.1 | globlastp |
| 1166 | LYD74 | radish\|gb164\|EW722654_P1 | 5164 | 546 | 84.1 | globlastp |
| 1167 | LYD74 | radish\|gb164\|EV524798_P1 | 5165 | 546 | 83.9 | globlastp |
| 1168 | LYD74 | tragopogon\|10v1\|SRR020205S0005883_T1 | 5166 | 546 | 83.81 | glotblastn |
| 1169 | LYD74 | ginseng\|10v1\|DV553807_P1 | 5167 | 546 | 83.8 | globlastp |
| 1170 | LYD74 | cacao\|gb167\|CA798006_P1 | 5168 | 546 | 83.8 | globlastp |
| 1171 | LYD74 | b_juncea\|10v2\|E6ANDIZ01A31EZ_P1 | 5169 | 546 | 83.7 | globlastp |
| 1172 | LYD74 | b_juncea\|10v2\|E6ANDIZ01AJQWT_P1 | 5170 | 546 | 83.7 | globlastp |
| 1173 | LYD74 | canola\|10v1\|BQ704518_P1 | 5171 | 546 | 83.7 | globlastp |
| 1174 | LYD74 | heritiera\|10v1\|SRR005794S0008009_P1 | 5172 | 546 | 83.7 | globlastp |
| 1175 | LYD74 | b_juncea\|gb164\|EVGN00120108451580_P1 | 5173 | 546 | 83.7 | globlastp |
| 1176 | LYD74 | b_juncea\|10v2\|E6ANDIZ01A2E3P_P1 | 5174 | 546 | 83.7 | globlastp |
| 1177 | LYD74 | b_juncea\|gb164\|EVGN00145618710181_P1 | 5174 | 546 | 83.7 | globlastp |
| 1178 | LYD74 | banana\|10v1\|DN238032_P1 | 5175 | 546 | 83.7 | globlastp |
| 1179 | LYD74 | canola\|gb161\|BQ704518_P1 | 5171 | 546 | 83.7 | globlastp |
| 1180 | LYD74 | canola\|10v1\|CX281752_P1 | 5170 | 546 | 83.7 | globlastp |
| 1181 | LYD74 | coffea\|10v1\|DV667224_P1 | 5176 | 546 | 83.7 | globlastp |
| 1182 | LYD74 | coffea\|gb157.2\|DV667224_P1 | 5176 | 546 | 83.7 | globlastp |
| 1183 | LYD74 | grape\|gb160\|BM436396_P1 | 5177 | 546 | 83.7 | globlastp |
| 1184 | LYD74 | pigeonpea\|gb171\|GR472607_P1 | 5178 | 546 | 83.7 | globlastp |
| 1185 | LYD74 | radish\|gb164\|EX754159_P1 | 5179 | 546 | 83.5 | globlastp |
| 1186 | LYD74 | arabidopsis_lyrata\|09v1\|JGIAL018741_P1 | 5180 | 546 | 83.4 | globlastp |
| 1187 | LYD74 | b_juncea\|10v2\|E6ANDIZ01A04A0_P1 | 5181 | 546 | 83.4 | globlastp |
| 1188 | LYD74 | canola\|10v1\|H07415_P1 | 5182 | 546 | 83.4 | globlastp |
| 1189 | LYD74 | artemisia\|10v1\|EY036894_P1 | 5183 | 546 | 83.4 | globlastp |
| 1190 | LYD74 | artemisia\|gb164\|EY036894_P1 | 5184 | 546 | 83.4 | globlastp |
| 1191 | LYD74 | b_juncea\|gb164\|EVGN00049825240489_P1 | 5182 | 546 | 83.4 | globlastp |
| 1192 | LYD74 | b_oleracea\|gb161\|AM385055_P1 | 5185 | 546 | 83.4 | globlastp |
| 1193 | LYD74 | b_rapa\|gb162\|L37611_P1 | 5181 | 546 | 83.4 | globlastp |
| 1194 | LYD74 | canola\|gb161\|CB686447_P1 | 5182 | 546 | 83.4 | globlastp |
| 1195 | LYD74 | canola\|10v1\|CX281522_P1 | 5181 | 546 | 83.4 | globlastp |
| 1196 | LYD74 | thellungiella\|gb167\|DN772761_P1 | 5186 | 546 | 83.4 | globlastp |
| 1197 | LYD74 | pigeonpea\|10v1\|GW358832_T1 | 5187 | 546 | 83.33 | glotblastn |
| 1198 | LYD74 | aquilegia\|10v1\|DR939805_P1 | 5188 | 546 | 83.3 | globlastp |
| 1199 | LYD74 | b_juncea\|10v2\|E6ANDIZ01A1B2W_P1 | 5189 | 546 | 83.3 | globlastp |
| 1200 | LYD74 | b_juncea\|gb164\|EVGN00016619570173_P1 | 5189 | 546 | 83.3 | globlastp |
| 1201 | LYD74 | b_oleracea\|gb161\|CO729370_P1 | 5189 | 546 | 83.3 | globlastp |
| 1202 | LYD74 | canola\|10v1\|CN728998_P1 | 5189 | 546 | 83.3 | globlastp |
| 1203 | LYD74 | canola\|gb161\|CN728998_P1 | 5189 | 546 | 83.3 | globlastp |
| 1204 | LYD74 | cassava\|gb164\|CK644716_P1 | 5190 | 546 | 83.3 | globlastp |
| 1205 | LYD74 | cowpea\|gb166\|FC458212_P1 | 5191 | 546 | 83.3 | globlastp |
| 1206 | LYD74 | iceplant\|gb164\|BE034750_P1 | 5192 | 546 | 83.3 | globlastp |
| 1207 | LYD74 | eucalyptus\|gb166\|ES588553_P1 | 5193 | 546 | 83.1 | globlastp |
| 1208 | LYD74 | oak\|10v1\|CU657211_P1 | 5194 | 546 | 83 | globlastp |
| 1209 | LYD74 | oak\|10v1\|FP027604_P1 | 5194 | 546 | 83 | globlastp |
| 1210 | LYD74 | oak\|10v1\|FP030258_P1 | 5194 | 546 | 83 | globlastp |
| 1211 | LYD74 | arabidopsis\|10v1\|AT3G54890_P1 | 5195 | 546 | 83 | globlastp |
| 1212 | LYD74 | poplar\|10v1\|BI068471_P1 | 5196 | 546 | 83 | globlastp |
| 1213 | LYD74 | poplar\|gb170\|BI068471_P1 | 5196 | 546 | 83 | globlastp |
| 1214 | LYD74 | curcuma\|10v1\|DY387256_P1 | 5197 | 546 | 82.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1215 | LYD74 | nasturtium\|10v1\|SRR032558S0028852_P1 | 5198 | 546 | 82.6 | globlastp |
| 1216 | LYD74 | oak\|gb170\|CU657211_P1 | 5199 | 546 | 82.6 | globlastp |
| 1217 | LYD74 | bean\|gb167\|CB280571_P1 | 5200 | 546 | 82.5 | globlastp |
| 1218 | LYD74 | liriodendron\|gb166\|FD489797_P1 | 5201 | 546 | 82.5 | globlastp |
| 1219 | LYD74 | peanut\|10v1\|EC391290_P1 | 5202 | 546 | 82.5 | globlastp |
| 1220 | LYD74 | peanut\|gb171\|EC391290_P1 | 5202 | 546 | 82.5 | globlastp |
| 1221 | LYD74 | monkeyflower\|09v1\|DV207796_P1 | 5203 | 546 | 82.3 | globlastp |
| 1222 | LYD74 | monkeyflower\|10v1\|DV207796_P1 | 5203 | 546 | 82.3 | globlastp |
| 1223 | LYD74 | canola\|gb161\|CX281522_P1 | 5204 | 546 | 82.2 | globlastp |
| 1224 | LYD74 | peanut\|10v1\|DT044319_P1 | 5205 | 546 | 82.1 | globlastp |
| 1225 | LYD74 | banana\|gb167\|DN238553_P1 | 5206 | 546 | 82.1 | globlastp |
| 1226 | LYD74 | walnuts\|gb166\|EL891496_P1 | 5207 | 546 | 82.1 | globlastp |
| 1227 | LYD74 | walnuts\|gb166\|EL891497_P1 | 5208 | 546 | 81.9 | globlastp |
| 1228 | LYD74 | papaya\|gb165\|EX243398_P1 | 5209 | 546 | 81.5 | globlastp |
| 1229 | LYD74 | eschscholzia\|10v1\|CD481243_P1 | 5210 | 546 | 81.3 | globlastp |
| 1230 | LYD74 | monkeyflower\|09v1\|GO975434_P1 | 5211 | 546 | 81 | globlastp |
| 1231 | LYD74 | rose\|gb157.2\|EC586509_P1 | 5212 | 546 | 81 | globlastp |
| 1232 | LYD74 | medicago\|09v1\|LLBE316989_P1 | 5213 | 546 | 80.6 | globlastp |
| 1233 | LYD74 | canola\|gb161\|CX281752_P1 | 5214 | 546 | 80.5 | globlastp |
| 1234 | LYD74 | acacia\|10v1\|FS585491_P1 | 5215 | 546 | 80.2 | globlastp |
| 1235 | LYD74 | amborella\|gb166\|CD482049_T1 | 5216 | 546 | 80.08 | glotblastn |
| 1236 | LYD75 | solanum_phureja\|09v1\|SPHBG134552_P1 | 5217 | 547 | 98.5 | globlastp |
| 1237 | LYD75 | tomato\|09v1\|BG133027_P1 | 5218 | 547 | 91.1 | globlastp |
| 1238 | LYD75 | pepper\|gb171\|BM063537_P1 | 5219 | 547 | 90.5 | globlastp |
| 1239 | LYD75 | solanum_phureja\|09v1\|SPHBG133027_P1 | 5220 | 547 | 90.3 | globlastp |
| 1240 | LYD75 | potato\|10v1\|BF052754_P1 | 5221 | 547 | 89.8 | globlastp |
| 1241 | LYD75 | potato\|gb157.2\|BF052754_P1 | 5221 | 547 | 89.8 | globlastp |
| 1242 | LYD75 | tomato\|gb164\|AI485840_P1 | 5222 | 547 | 89.8 | globlastp |
| 1243 | LYD75 | solanum_phureja\|09v1\|SPHAI485840_P1 | 5223 | 547 | 89.4 | globlastp |
| 1244 | LYD75 | triphysaria\|10v1\|DR173408_P1 | 5224 | 547 | 86.2 | globlastp |
| 1245 | LYD75 | cotton\|gb164\|AI727065_P1 | 5225 | 547 | 86.1 | globlastp |
| 1246 | LYD75 | cotton\|10v1\|AI727065_P1 | 5225 | 547 | 86.1 | globlastp |
| 1247 | LYD75 | triphysaria\|10v1\|EY145965_P1 | 5226 | 547 | 86 | globlastp |
| 1248 | LYD75 | cacao\|gb167\|CU473969_P1 | 5227 | 547 | 85.7 | globlastp |
| 1249 | LYD75 | monkeyflower\|09v1\|GO960496_P1 | 5228 | 547 | 85.6 | globlastp |
| 1250 | LYD75 | monkeyflower\|10v1\|GO945138_P1 | 5228 | 547 | 85.6 | globlastp |
| 1251 | LYD75 | cassava\|09v1\|DV450411_P1 | 5229 | 547 | 85.5 | globlastp |
| 1252 | LYD75 | catharanthus\|gb166\|EG554152_T1 | 5230 | 547 | 85.31 | glotblastn |
| 1253 | LYD75 | monkeyflower\|09v1\|GO945138_P1 | 5231 | 547 | 85.3 | globlastp |
| 1254 | LYD75 | salvia\|10v1\|CV163176_P1 | 5232 | 547 | 85.1 | globlastp |
| 1255 | LYD75 | tomato\|09v1\|AI485840_P1 | 5233 | 547 | 85.1 | globlastp |
| 1256 | LYD75 | castorbean\|09v1\|EG665428_P1 | 5234 | 547 | 85 | globlastp |
| 1257 | LYD75 | poplar\|gb170\|BI124433_P1 | 5235 | 547 | 85 | globlastp |
| 1258 | LYD75 | poplar\|10v1\|BI124433_P1 | 5236 | 547 | 84.8 | globlastp |
| 1259 | LYD75 | cotton\|gb164\|CO071822_T1 | 5237 | 547 | 84.42 | glotblastn |
| 1260 | LYD75 | poplar\|10v1\|BI070420_P1 | 5238 | 547 | 84.4 | globlastp |
| 1261 | LYD75 | poplar\|gb170\|BI070420_P1 | 5238 | 547 | 84.4 | globlastp |
| 1262 | LYD75 | kiwi\|gb166\|FG459967_P1 | 5239 | 547 | 84.3 | globlastp |
| 1263 | LYD75 | cotton\|10v1\|AI054730_T1 | 5240 | 547 | 83.97 | glotblastn |
| 1264 | LYD75 | kiwi\|gb166\|FG397568_P1 | 5241 | 547 | 83.9 | globlastp |
| 1265 | LYD75 | citrus\|gb166\|CD575199_P1 | 5242 | 547 | 83.8 | globlastp |
| 1266 | LYD75 | strawberry\|gb164\|CO381295_P1 | 5243 | 547 | 83.8 | globlastp |
| 1267 | LYD75 | cotton\|10v1\|AI726226_P1 | 5244 | 547 | 83.5 | globlastp |
| 1268 | LYD75 | melon\|10v1\|AM719548_P1 | 5245 | 547 | 83.5 | globlastp |
| 1269 | LYD75 | cotton\|gb164\|AI054730_P1 | 5246 | 547 | 83.5 | globlastp |
| 1270 | LYD75 | cucumber\|09v1\|AM718341_P1 | 5247 | 547 | 83.4 | globlastp |
| 1271 | LYD75 | chestnut\|gb170\|SRR006295S0000051_P1 | 5248 | 547 | 83.2 | globlastp |
| 1272 | LYD75 | pigeonpea\|10v1\|GR464336_P1 | 5249 | 547 | 83 | globlastp |
| 1273 | LYD75 | oak\|10v1\|DN949810_P1 | 5250 | 547 | 82.8 | globlastp |
| 1274 | LYD75 | grape\|gb160\|BQ792527_P1 | 5251 | 547 | 82.7 | globlastp |
| 1275 | LYD75 | soybean\|gb168\|AA660206_P1 | 5252 | 547 | 82.7 | globlastp |
| 1276 | LYD75 | prunus\|10v1\|CB819938_P1 | 5253 | 547 | 82.4 | globlastp |
| 1277 | LYD75 | apple\|gb171\|CN444703_P1 | 5254 | 547 | 82.1 | globlastp |
| 1278 | LYD75 | bean\|gb167\|FE691109_P1 | 5255 | 547 | 81.6 | globlastp |
| 1279 | LYD75 | prunus\|gb167\|CB819938_P1 | 5256 | 547 | 81.4 | globlastp |
| 1280 | LYD75 | peanut\|10v1\|ES717548_P1 | 5257 | 547 | 81.3 | globlastp |
| 1281 | LYD75 | peanut\|gb171\|ES708081_P1 | 5258 | 547 | 81.3 | globlastp |
| 1282 | LYD75 | artemisia\|10v1\|EY091466_P1 | 5259 | 547 | 80.7 | globlastp |
| 1283 | LYD75 | medicago\|09v1\|AA660206_P1 | 5260 | 547 | 80.7 | globlastp |
| 1284 | LYD75 | b_rapa\|gb162\|CX265583_T1 | 5261 | 547 | 80.6 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1285 | LYD75 | canola\|gb161\|CN727227_T1 | 5262 | 547 | 80.6 | glotblastn |
| 1286 | LYD75 | soybean\|gb168\|AW685689_T1 | 5263 | 547 | 80.54 | glotblastn |
| 1287 | LYD75 | artemisia\|10v1\|EY108330_P1 | 5264 | 547 | 80.5 | globlastp |
| 1288 | LYD75 | canola\|10v1\|CN727227_P1 | 5265 | 547 | 80.4 | globlastp |
| 1289 | LYD75 | switchgrass\|gb167\|DN146648_P1 | 5266 | 547 | 80.4 | globlastp |
| 1290 | LYD75 | nasturtium\|10v1\|SRR032558S0114794_P1 | 5267 | 547 | 80.3 | globlastp |
| 1291 | LYD75 | artemisia\|gb164\|EY091466_P1 | 5268 | 547 | 80.3 | globlastp |
| 1292 | LYD75 | arabidopsis_lyrata\|09v1\|JGIAL023205_P1 | 5269 | 547 | 80.2 | globlastp |
| 1293 | LYD75 | lettuce\|10v1\|DW114885_P1 | 5270 | 547 | 80.1 | globlastp |
| 1294 | LYD75 | lettuce\|gb157.2\|DW114885_P1 | 5270 | 547 | 80.1 | globlastp |
| 1295 | LYD75 | arabidopsis\|10v1\|AT4G11820_P1 | 5271 | 547 | 80 | globlastp |
| 1296 | LYD75 | arabidopsis\|gb165\|AT4G11820_P1 | 5271 | 547 | 80 | globlastp |
| 1297 | LYD75 | b_juncea\|gb164\|AF148847_P1 | 5272 | 547 | 80 | globlastp |
| 1298 | LYD75 | soybean\|gb168\|AW428876_P1 | 5273 | 547 | 80 | globlastp |
| 1299 | LYD76 | potato\|10v1\|BG887381_P1 | 5274 | 548 | 94.3 | globlastp |
| 1300 | LYD76 | potato\|gb157.2\|BG887381_T1 | 5275 | 548 | 93.63 | glotblastn |
| 1301 | LYD76 | solanum_phureja\|09v1\|SPHAI894730_P1 | 5276 | 548 | 93.6 | globlastp |
| 1302 | LYD76 | potato\|gb157.2\|CN464137_P1 | 5277 | 548 | 92.5 | globlastp |
| 1303 | LYD76 | tomato\|gb164\|AW035287_P1 | 5278 | 548 | 92.5 | globlastp |
| 1304 | LYD76 | solanum_phureja\|09v1\|SPHBG886634_P1 | 5279 | 548 | 91.7 | globlastp |
| 1305 | LYD76 | tomato\|gb164\|AI894730_P1 | 5280 | 548 | 91.2 | globlastp |
| 1306 | LYD76 | tomato\|gb164\|BE435253_P1 | 5281 | 548 | 90.6 | globlastp |
| 1307 | LYD76 | potato\|10v1\|BG597973_P1 | 5282 | 548 | 90 | globlastp |
| 1308 | LYD76 | pepper\|gb171\|CA523398_P1 | 5283 | 548 | 90 | globlastp |
| 1309 | LYD76 | pepper\|gb171\|AY284925_P1 | 5284 | 548 | 89.4 | globlastp |
| 1310 | LYD76 | potato\|gb157.2\|BG597973_P1 | 5285 | 548 | 89.4 | globlastp |
| 1311 | LYD76 | solanum_phureja\|09v1\|SPHBG886552_P1 | 5286 | 548 | 87.8 | globlastp |
| 1312 | LYD76 | potato\|10v1\|BG886634_P1 | 5287 | 548 | 87.3 | globlastp |
| 1313 | LYD76 | potato\|gb157.2\|BG886634_P1 | 5287 | 548 | 87.3 | globlastp |
| 1314 | LYD76 | potato\|gb157.2\|BQ513303_P1 | 5288 | 548 | 87.2 | globlastp |
| 1315 | LYD76 | tomato\|gb164\|CD002116_P1 | 5289 | 548 | 87.2 | globlastp |
| 1316 | LYD76 | potato\|10v1\|BG886552_P1 | 5290 | 548 | 87.2 | globlastp |
| 1317 | LYD76 | potato\|gb157.2\|BG886552_T1 | 5291 | 548 | 86.54 | glotblastn |
| 1318 | LYD76 | eggplant\|10v1\|FS003064_P1 | 5292 | 548 | 86.5 | globlastp |
| 1319 | LYD76 | solanum_phureja\|09v1\|SPHBP891733_P1 | 5293 | 548 | 85.9 | globlastp |
| 1320 | LYD76 | solanum_phureja\|09v1\|SPHCV499099_P1 | 5294 | 548 | 85 | globlastp |
| 1321 | LYD76 | potato\|gb157.2\|CV499099_P1 | 5295 | 548 | 84.9 | globlastp |
| 1322 | LYD76 | tobacco\|gb162\|AY329046_P1 | 5296 | 548 | 84.4 | globlastp |
| 1323 | LYD76 | potato\|gb157.2\|BF053339_T1 | 5297 | 548 | 84.38 | glotblastn |
| 1324 | LYD76 | tobacco\|gb162\|AY329052_P1 | 5298 | 548 | 83.8 | globlastp |
| 1325 | LYD76 | tobacco\|gb162\|EB429178_P1 | 5299 | 548 | 83.1 | globlastp |
| 1326 | LYD76 | potato\|gb157.2\|BG098017_P1 | 5300 | 548 | 82.7 | globlastp |
| 1327 | LYD76 | potato\|10v1\|BI406549_P1 | 5300 | 548 | 82.7 | globlastp |
| 1328 | LYD76 | potato\|gb157.2\|EG013355_P1 | 5301 | 548 | 82.1 | globlastp |
| 1329 | LYD76 | solanum_phureja\|09v1\|SPHBI406549_P1 | 5302 | 548 | 82.1 | globlastp |
| 1330 | LYD76 | potato\|gb157.2\|BI406549_P1 | 5303 | 548 | 81.4 | globlastp |
| 1331 | LYD76 | triphysaria\|10v1\|EY002368_P1 | 5304 | 548 | 80.9 | globlastp |
| 1332 | LYD76 | tobacco\|gb162\|AY329063_P1 | 5305 | 548 | 80.8 | globlastp |
| 1333 | LYD76 | monkeyflower\|09v1\|GR006939_P1 | 5306 | 548 | 80.7 | globlastp |
| 1334 | LYD76 | monkeyflower\|10v1\|GR006939_P1 | 5306 | 548 | 80.7 | globlastp |
| 1335 | LYD76 | monkeyflower\|10v1\|CRPMG033362_P1 | 5307 | 548 | 80.3 | globlastp |
| 1336 | LYD76 | monkeyflower\|10v1\|GR109476_P1 | 5308 | 548 | 80.1 | globlastp |
| 1337 | LYD76 | triphysaria\|10v1\|EY020547_P1 | 5309 | 548 | 80.1 | globlastp |
| 1338 | LYD76 | cacao\|gb167\|CU595931_P1 | 5310 | 548 | 80 | globlastp |
| 1339 | LYD76 | melon\|10v1\|DV632570_P1 | 5311 | 548 | 80 | globlastp |
| 1340 | LYD76 | tobacco\|gb162\|AF166277_P1 | 5312 | 548 | 80 | globlastp |
| 1341 | LYD78 | pigeonpea\|10v1\|SRR054580S0035478_P1 | 5313 | 549 | 92.5 | globlastp |
| 1342 | LYD78 | bean\|gb167\|CB543362_P1 | 5314 | 549 | 90.2 | globlastp |
| 1343 | LYD78 | medicago\|09v1\|AL388558_P1 | 5315 | 549 | 84 | globlastp |
| 1344 | LYD78 | lotus\|09v1\|BP051777_P1 | 5316 | 549 | 83.8 | globlastp |
| 1345 | LYD78 | cowpea\|gb166\|FF399864_T1 | 5317 | 549 | 83.01 | glotblastn |
| 1346 | LYD79 | soybean\|gb168\|AA660469_P1 | 5318 | 550 | 98.4 | globlastp |
| 1347 | LYD79 | pigeonpea\|10v1\|SRR054580S0042661_P1 | 5319 | 550 | 96.8 | globlastp |
| 1348 | LYD79 | bean\|gb167\|CA911516_P1 | 5319 | 550 | 96.8 | globlastp |
| 1349 | LYD79 | cowpea\|gb166\|FF539866_P1 | 5320 | 550 | 96.8 | globlastp |
| 1350 | LYD79 | liquorice\|gb171\|FS243942_P1 | 5321 | 550 | 93.7 | globlastp |
| 1351 | LYD79 | medicago\|09v1\|AA660469_P1 | 5322 | 550 | 92.1 | globlastp |
| 1352 | LYD79 | acacia\|10v1\|GR481860_P1 | 5323 | 550 | 90.5 | globlastp |
| 1353 | LYD79 | peanut\|10v1\|ES705666_P1 | 5324 | 550 | 90.5 | globlastp |
| 1354 | LYD79 | peanut\|10v1\|SRR042413S0025060_P1 | 5324 | 550 | 90.5 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1355 | LYD79 | peanut\|gb171\|ES705666_P1 | 5324 | 550 | 90.5 | globlastp |
| 1356 | LYD79 | cassava\|09v1\|DV454356_P1 | 5325 | 550 | 85.7 | globlastp |
| 1357 | LYD79 | cassava\|gb164\|DV454356_P1 | 5325 | 550 | 85.7 | globlastp |
| 1358 | LYD79 | citrus\|gb166\|CB610995_P1 | 5326 | 550 | 85.7 | globlastp |
| 1359 | LYD79 | poplar\|10v1\|BU897706_P1 | 5327 | 550 | 82.5 | globlastp |
| 1360 | LYD79 | poplar\|gb170\|BU897706_P1 | 5327 | 550 | 82.5 | globlastp |
| 1361 | LYD79 | lotus\|09v1\|BW596764_P1 | 5328 | 550 | 81.5 | globlastp |
| 1362 | LYD79 | coffea\|gb157.2\|DV693211_T1 | 5329 | 550 | 81.25 | glotblastn |
| 1363 | LYD79 | coffea\|10v1\|DV693211_P1 | 5330 | 550 | 81.2 | globlastp |
| 1364 | LYD79 | orobanche\|10v1\|SRR023189S0007343_P1 | 5331 | 550 | 81 | globlastp |
| 1365 | LYD79 | grape\|gb160\|BQ792370_P1 | 5332 | 550 | 81 | globlastp |
| 1366 | LYD79 | prunus\|gb167\|AJ823531_P1 | 5333 | 550 | 81 | globlastp |
| 1367 | LYD79 | prunus\|gb167\|FC864840_P1 | 5333 | 550 | 81 | globlastp |
| 1368 | LYD79 | oak\|10v1\|FP038176_T1 | 5334 | 550 | 80.95 | glotblastn |
| 1369 | LYD79 | chestnut\|gb170\|SRR006295S0047496_T1 | 5334 | 550 | 80.95 | glotblastn |
| 1370 | LYD80 | arabidopsis_lyrata\|09v1\|JGIAL002319_T1 | 5335 | 551 | 95.44 | glotblastn |
| 1371 | LYD80 | canola\|10v1\|EE449185_P1 | 5336 | 551 | 85.7 | globlastp |
| 1372 | LYD80 | canola\|gb161\|EL590482_P1 | 5337 | 551 | 82.4 | globlastp |
| 1373 | LYD81 | peanut\|10v1\|ES721579_T1 | 5338 | 552 | 80.87 | glotblastn |
| 1374 | LYD84 | arabidopsis_lyrata\|09v1\|JGIAL021222_P1 | 5339 | 554 | 95.3 | globlastp |
| 1375 | LYD85 | arabidopsis_lyrata\|09v1\|JGIAL025065_P1 | 5340 | 555 | 97 | globlastp |
| 1376 | LYD85 | canola\|10v1\|CD818889_P1 | 5341 | 555 | 94 | globlastp |
| 1377 | LYD85 | canola\|10v1\|CD821386_P1 | 5342 | 555 | 94 | globlastp |
| 1378 | LYD85 | canola\|gb161\|CD821386_P1 | 5342 | 555 | 94 | globlastp |
| 1379 | LYD85 | b_oleracea\|gb161\|DY019746_P1 | 5343 | 555 | 92.5 | globlastp |
| 1380 | LYD85 | canola\|10v1\|EE451644_P1 | 5344 | 555 | 92.5 | globlastp |
| 1381 | LYD85 | canola\|gb161\|CD818889_P1 | 5344 | 555 | 92.5 | globlastp |
| 1382 | LYD85 | canola\|10v1\|EV007961_P1 | 5345 | 555 | 92.5 | globlastp |
| 1383 | LYD85 | canola\|gb161\|EV007961_P1 | 5345 | 555 | 92.5 | globlastp |
| 1384 | LYD85 | radish\|gb164\|FD935048_T1 | 5346 | 555 | 91.04 | glotblastn |
| 1385 | LYD85 | b_rapa\|gb162\|EX069163_P1 | 5347 | 555 | 91 | globlastp |
| 1386 | LYD85 | radish\|gb164\|EV538503_P1 | 5347 | 555 | 91 | globlastp |
| 1387 | LYD85 | cleome_gynandra\|10v1\|SRR015532S0082161_P1 | 5348 | 555 | 80.6 | globlastp |
| 1388 | LYD86 | thellungiella\|gb167\|BY830502_P1 | 5349 | 556 | 98 | globlastp |
| 1389 | LYD86 | thellungiella\|gb167\|DN774053_P1 | 5350 | 556 | 98 | globlastp |
| 1390 | LYD86 | b_juncea\|10v2\|E6ANDIZ01AGKLO_P1 | 5351 | 556 | 96.1 | globlastp |
| 1391 | LYD86 | b_juncea\|10v2\|E6ANDIZ01C9M4I_P1 | 5351 | 556 | 96.1 | globlastp |
| 1392 | LYD86 | b_juncea\|10v2\|E6ANDIZ01EOWBA_P1 | 5351 | 556 | 96.1 | globlastp |
| 1393 | LYD86 | b_juncea\|10v2\|E6ANDIZ02FW8ZO_P1 | 5351 | 556 | 96.1 | globlastp |
| 1394 | LYD86 | canola\|10v1\|CD818375_P1 | 5351 | 556 | 96.1 | globlastp |
| 1395 | LYD86 | canola\|10v1\|CN725716_P1 | 5351 | 556 | 96.1 | globlastp |
| 1396 | LYD86 | b_juncea\|gb164\|EVGN00459709681320_P1 | 5351 | 556 | 96.1 | globlastp |
| 1397 | LYD86 | b_oleracea\|gb161\|AM057609_P1 | 5351 | 556 | 96.1 | globlastp |
| 1398 | LYD86 | b_rapa\|gb162\|DY010357_P1 | 5351 | 556 | 96.1 | globlastp |
| 1399 | LYD86 | canola\|10v1\|CD817105_P1 | 5351 | 556 | 96.1 | globlastp |
| 1400 | LYD86 | canola\|gb161\|CD817105_P1 | 5351 | 556 | 96.1 | globlastp |
| 1401 | LYD86 | canola\|gb161\|CD818375_P1 | 5351 | 556 | 96.1 | globlastp |
| 1402 | LYD86 | canola\|10v1\|CN730342_P1 | 5351 | 556 | 96.1 | globlastp |
| 1403 | LYD86 | canola\|gb161\|CN730342_P1 | 5351 | 556 | 96.1 | globlastp |
| 1404 | LYD86 | radish\|gb164\|EV568513_P1 | 5351 | 556 | 96.1 | globlastp |
| 1405 | LYD86 | radish\|gb164\|EV570136_P1 | 5351 | 556 | 96.1 | globlastp |
| 1406 | LYD86 | b_oleracea\|gb161\|EE534616_T1 | 5352 | 556 | 96.08 | glotblastn |
| 1407 | LYD86 | canola\|gb161\|CN725716_T1 | 5353 | 556 | 96.08 | glotblastn |
| 1408 | LYD86 | arabidopsis_lyrata\|09v1\|BQ834513_P1 | 5354 | 556 | 94.2 | globlastp |
| 1409 | LYD86 | sunflower\|10v1\|AJ318305_P1 | 5355 | 556 | 94.1 | globlastp |
| 1410 | LYD86 | sunflower\|10v1\|SFSLX00153819D2_P1 | 5355 | 556 | 94.1 | globlastp |
| 1411 | LYD86 | radish\|gb164\|FD542635_P1 | 5356 | 556 | 94.1 | globlastp |
| 1412 | LYD86 | artemisia\|10v1\|SRR019547S0037450_P1 | 5357 | 556 | 92.2 | globlastp |
| 1413 | LYD86 | cleome_gynandra\|10v1\|SRR015532S0003909_P1 | 5358 | 556 | 92.2 | globlastp |
| 1414 | LYD86 | cleome_spinosa\|10v1\|SRR015531S0004445_P1 | 5359 | 556 | 92.2 | globlastp |
| 1415 | LYD86 | heritiera\|10v1\|SRR005795S0007963_P1 | 5360 | 556 | 92.2 | globlastp |
| 1416 | LYD86 | nasturtium\|10v1\|SRR032558S0118083_P1 | 5361 | 556 | 92.2 | globlastp |
| 1417 | LYD86 | artemisia\|10v1\|EX980187_P1 | 5357 | 556 | 92.2 | globlastp |
| 1418 | LYD86 | artemisia\|gb164\|EX980187_P1 | 5357 | 556 | 92.2 | globlastp |
| 1419 | LYD86 | cacao\|gb167\|CU501402_P1 | 5360 | 556 | 92.2 | globlastp |
| 1420 | LYD86 | cotton\|gb164\|BE053773_P1 | 5360 | 556 | 92.2 | globlastp |
| 1421 | LYD86 | cotton\|gb164\|CO120014_P1 | 5360 | 556 | 92.2 | globlastp |
| 1422 | LYD86 | gerbera\|09v1\|AJ762308_P1 | 5357 | 556 | 92.2 | globlastp |
| 1423 | LYD86 | gerbera\|09v1\|AJ762481_P1 | 5357 | 556 | 92.2 | globlastp |
| 1424 | LYD86 | lettuce\|10v1\|DW045900_P1 | 5357 | 556 | 92.2 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1425 | LYD86 | lettuce\|gb157.2\|DW045900_P1 | 5357 | 556 | 92.2 | globlastp |
| 1426 | LYD86 | lettuce\|10v1\|DW077419_P1 | 5362 | 556 | 92.2 | globlastp |
| 1427 | LYD86 | lettuce\|gb157.2\|DW077419_P1 | 5362 | 556 | 92.2 | globlastp |
| 1428 | LYD86 | lettuce\|10v1\|DW084501_P1 | 5357 | 556 | 92.2 | globlastp |
| 1429 | LYD86 | lettuce\|gb157.2\|DW084501_P1 | 5357 | 556 | 92.2 | globlastp |
| 1430 | LYD86 | lettuce\|10v1\|DW146736_P1 | 5357 | 556 | 92.2 | globlastp |
| 1431 | LYD86 | safflower\|gb162\|EL511108_P1 | 5357 | 556 | 92.2 | globlastp |
| 1432 | LYD86 | cotton\|10v1\|BE053773_P1 | 5360 | 556 | 92.2 | globlastp |
| 1433 | LYD86 | cleome_gynandra\|10v1\|SRR015532S0086075_T1 | 5363 | 556 | 90.2 | glotblastn |
| 1434 | LYD86 | cleome_spinosa\|10v1\|SRR015531S0019603_P1 | 5364 | 556 | 90.2 | globlastp |
| 1435 | LYD86 | cyamopsis\|10v1\|EG983537_P1 | 5365 | 556 | 90.2 | globlastp |
| 1436 | LYD86 | dandelion\|10v1\|GO663055_P1 | 5366 | 556 | 90.2 | globlastp |
| 1437 | LYD86 | ginseng\|10v1\|GR874677_P1 | 5365 | 556 | 90.2 | globlastp |
| 1438 | LYD86 | orobanche\|10v1\|SRR023189S0000905_P1 | 5365 | 556 | 90.2 | globlastp |
| 1439 | LYD86 | orobanche\|10v1\|SRR023189S0034846_P1 | 5365 | 556 | 90.2 | globlastp |
| 1440 | LYD86 | beet\|gb162\|EG550343_P1 | 5365 | 556 | 90.2 | globlastp |
| 1441 | LYD86 | canola\|gb161\|EV056789_P1 | 5367 | 556 | 90.2 | globlastp |
| 1442 | LYD86 | catharanthus\|gb166\|FD415278_T1 | 5368 | 556 | 90.2 | glotblastn |
| 1443 | LYD86 | centaurea\|gb166\|EH747270_P1 | 5369 | 556 | 90.2 | globlastp |
| 1444 | LYD86 | coffea\|10v1\|DV689480_P1 | 5365 | 556 | 90.2 | globlastp |
| 1445 | LYD86 | coffea\|gb157.2\|DV689480_P1 | 5365 | 556 | 90.2 | globlastp |
| 1446 | LYD86 | cotton\|gb164\|BF275857_P1 | 5370 | 556 | 90.2 | globlastp |
| 1447 | LYD86 | cynara\|gb167\|GE588082_P1 | 5371 | 556 | 90.2 | globlastp |
| 1448 | LYD86 | grape\|gb160\|BM436961_P1 | 5365 | 556 | 90.2 | globlastp |
| 1449 | LYD86 | grape\|gb160\|CB005160_P1 | 5365 | 556 | 90.2 | globlastp |
| 1450 | LYD86 | iceplant\|gb164\|BE130459_T1 | 5372 | 556 | 90.2 | glotblastn |
| 1451 | LYD86 | kiwi\|gb166\|FG438126_P1 | 5365 | 556 | 90.2 | globlastp |
| 1452 | LYD86 | monkeyflower\|09v1\|DV206392_P1 | 5373 | 556 | 90.2 | globlastp |
| 1453 | LYD86 | petunia\|gb171\|CV294446_T1 | 5374 | 556 | 90.2 | glotblastn |
| 1454 | LYD86 | brachypodium\|09v1\|DV477656_P1 | 5375 | 556 | 88.5 | globlastp |
| 1455 | LYD86 | oat\|10v2\|CN816027_P1 | 5376 | 556 | 88.5 | globlastp |
| 1456 | LYD86 | banana\|10v1\|DN238995_P1 | 5377 | 556 | 88.5 | globlastp |
| 1457 | LYD86 | banana\|gb167\|DN238995_P1 | 5377 | 556 | 88.5 | globlastp |
| 1458 | LYD86 | brachypodium\|gb169\|DV477656_P1 | 5375 | 556 | 88.5 | globlastp |
| 1459 | LYD86 | cowpea\|gb166\|FC458602_T1 | 5378 | 556 | 88.24 | glotblastn |
| 1460 | LYD86 | ipomoea\|gb157.2\|EE876485_T1 | 5379 | 556 | 88.24 | glotblastn |
| 1461 | LYD86 | melon\|gb165\|AM713586_T1 | 5380 | 556 | 88.24 | glotblastn |
| 1462 | LYD86 | oil_palm\|gb166\|EL693216_T1 | 5381 | 556 | 88.24 | glotblastn |
| 1463 | LYD86 | petunia\|gb171\|DC240311_T1 | — | 556 | 88.24 | glotblastn |
| 1464 | LYD86 | cassava\|09v1\|DB935598_P1 | 5382 | 556 | 88.2 | globlastp |
| 1465 | LYD86 | cucumber\|09v1\|AM713586_P1 | 5383 | 556 | 88.2 | globlastp |
| 1466 | LYD86 | eschscholzia\|10v1\|SRR014116S0008646_P1 | 5383 | 556 | 88.2 | globlastp |
| 1467 | LYD86 | flax\|09v1\|EH791278_P1 | 5384 | 556 | 88.2 | globlastp |
| 1468 | LYD86 | ipomoea_batatas\|10v1\|EE876485_P1 | 5385 | 556 | 88.2 | globlastp |
| 1469 | LYD86 | melon\|10v1\|AM713586_P1 | 5383 | 556 | 88.2 | globlastp |
| 1470 | LYD86 | nasturtium\|10v1\|GH170854_P1 | 5386 | 556 | 88.2 | globlastp |
| 1471 | LYD86 | pigeonpea\|10v1\|GW352442_P1 | 5382 | 556 | 88.2 | globlastp |
| 1472 | LYD86 | salvia\|10v1\|SRR014553S0003727_P1 | 5387 | 556 | 88.2 | globlastp |
| 1473 | LYD86 | basilicum\|10v1\|DY322542_P1 | 5388 | 556 | 88.2 | globlastp |
| 1474 | LYD86 | bean\|gb167\|CA902205_P1 | 5382 | 556 | 88.2 | globlastp |
| 1475 | LYD86 | beech\|gb170\|SRR006293S0004143_P1 | 5389 | 556 | 88.2 | globlastp |
| 1476 | LYD86 | bruguiera\|gb166\|BP938976_P1 | 5382 | 556 | 88.2 | globlastp |
| 1477 | LYD86 | castorbean\|09v1\|XM002527470_P1 | 5383 | 556 | 88.2 | globlastp |
| 1478 | LYD86 | cichorium\|gb171\|EH707102_P1 | 5390 | 556 | 88.2 | globlastp |
| 1479 | LYD86 | citrus\|gb166\|BE205724_P1 | 5382 | 556 | 88.2 | globlastp |
| 1480 | LYD86 | liquorice\|gb171\|FS240673_P1 | 5382 | 556 | 88.2 | globlastp |
| 1481 | LYD86 | liquorice\|gb171\|FS244039_P1 | 5382 | 556 | 88.2 | globlastp |
| 1482 | LYD86 | liriodendron\|gb166\|FD490282_P1 | 5391 | 556 | 88.2 | globlastp |
| 1483 | LYD86 | lotus\|09v1\|LLBU494472_P1 | 5382 | 556 | 88.2 | globlastp |
| 1484 | LYD86 | medicago\|09v1\|LLCX531914_P1 | 5392 | 556 | 88.2 | globlastp |
| 1485 | LYD86 | poplar\|10v1\|BU809765_P1 | 5382 | 556 | 88.2 | globlastp |
| 1486 | LYD86 | poplar\|gb170\|BU809765_P1 | 5382 | 556 | 88.2 | globlastp |
| 1487 | LYD86 | soybean\|gb168\|BU494472_P1 | 5382 | 556 | 88.2 | globlastp |
| 1488 | LYD86 | soybean\|gb168\|CA851270_P1 | 5382 | 556 | 88.2 | globlastp |
| 1489 | LYD86 | walnuts\|gb166\|CB303734_P1 | 5382 | 556 | 88.2 | globlastp |
| 1490 | LYD86 | medicago\|09v1\|BE316988_P1 | 5392 | 556 | 88.2 | globlastp |
| 1491 | LYD86 | cryptomeria\|gb166\|BW994702_P1 | 5393 | 556 | 86.8 | globlastp |
| 1492 | LYD86 | wheat\|gb164\|BE414948_T1 | 5394 | 556 | 86.54 | glotblastn |
| 1493 | LYD86 | wheat\|gb164\|CA625348_T1 | 5395 | 556 | 86.54 | glotblastn |
| 1494 | LYD86 | wheat\|gb164\|CD894479_T1 | 5396 | 556 | 86.54 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1495 | LYD86 | barley\|10v1\|BG299304_P1 | 5397 | 556 | 86.5 | globlastp |
| 1496 | LYD86 | barley\|10v1\|BG414327_P1 | 5397 | 556 | 86.5 | globlastp |
| 1497 | LYD86 | eggplant\|10v1\|FS019985_P1 | 5398 | 556 | 86.5 | globlastp |
| 1498 | LYD86 | millet\|10v1\|EVO454PM061746_P1 | 5399 | 556 | 86.5 | globlastp |
| 1499 | LYD86 | maize\|10v1\|AI372144_P1 | 5399 | 556 | 86.5 | globlastp |
| 1500 | LYD86 | maize\|gb170\|AI372144_P1 | 5399 | 556 | 86.5 | globlastp |
| 1501 | LYD86 | nuphar\|gb166\|CO997227_P1 | 5400 | 556 | 86.5 | globlastp |
| 1502 | LYD86 | pepper\|gb171\|GD067147_P1 | 5398 | 556 | 86.5 | globlastp |
| 1503 | LYD86 | potato\|gb157.2\|BG590800_P1 | 5398 | 556 | 86.5 | globlastp |
| 1504 | LYD86 | potato\|gb157.2\|CN515437_P1 | 5398 | 556 | 86.5 | globlastp |
| 1505 | LYD86 | rice\|gb170\|OS01G34614_P1 | 5399 | 556 | 86.5 | globlastp |
| 1506 | LYD86 | solanum_phureja\|09v1\|SPHBG627534_P1 | 5398 | 556 | 86.5 | globlastp |
| 1507 | LYD86 | sorghum\|09v1\|SB02G010660_P1 | 5399 | 556 | 86.5 | globlastp |
| 1508 | LYD86 | sorghum\|09v1\|SB07G005435_P1 | 5399 | 556 | 86.5 | globlastp |
| 1509 | LYD86 | sugarcane\|10v1\|CA072079_P1 | 5399 | 556 | 86.5 | globlastp |
| 1510 | LYD86 | sugarcane\|gb157.3\|CA072079_P1 | 5399 | 556 | 86.5 | globlastp |
| 1511 | LYD86 | sugarcane\|10v1\|CA090932_P1 | 5399 | 556 | 86.5 | globlastp |
| 1512 | LYD86 | sugarcane\|gb157.3\|CA090932_P1 | 5399 | 556 | 86.5 | globlastp |
| 1513 | LYD86 | switchgrass\|gb167\|DN147235_P1 | 5399 | 556 | 86.5 | globlastp |
| 1514 | LYD86 | switchgrass\|gb167\|FL725818_P1 | 5399 | 556 | 86.5 | globlastp |
| 1515 | LYD86 | switchgrass\|gb167\|FL734492_P1 | 5399 | 556 | 86.5 | globlastp |
| 1516 | LYD86 | tobacco\|gb162\|CV019381_P1 | 5398 | 556 | 86.5 | globlastp |
| 1517 | LYD86 | tomato\|09v1\|BG627534_P1 | 5398 | 556 | 86.5 | globlastp |
| 1518 | LYD86 | tomato\|gb164\|BG627534_P1 | 5398 | 556 | 86.5 | globlastp |
| 1519 | LYD86 | wheat\|gb164\|BE401020_P1 | 5397 | 556 | 86.5 | globlastp |
| 1520 | LYD86 | wheat\|gb164\|BE402150_P1 | 5397 | 556 | 86.5 | globlastp |
| 1521 | LYD86 | wheat\|gb164\|CA634446_P1 | 5397 | 556 | 86.5 | globlastp |
| 1522 | LYD86 | potato\|10v1\|BG590800_P1 | 5398 | 556 | 86.5 | globlastp |
| 1523 | LYD86 | ipomoea_nil\|10v1\|CJ745906_P1 | 5401 | 556 | 86.3 | globlastp |
| 1523 | LYD86 | ipomoea\|gb157.2\|CJ745906_T1 | 5408 | 556 | 86.27 | glotblastn |
| 1524 | LYD86 | oak\|10v1\|FP042379_P1 | 5402 | 556 | 86.3 | globlastp |
| 1525 | LYD86 | oak\|10v1\|FP042823_P1 | 5402 | 556 | 86.3 | globlastp |
| 1526 | LYD86 | oak\|10v1\|FP044622_P1 | 5402 | 556 | 86.3 | globlastp |
| 1527 | LYD86 | triphysaria\|10v1\|SRR023500S0014025_P1 | 5403 | 556 | 86.3 | globlastp |
| 1528 | LYD86 | triphysaria\|10v1\|SRR023500S0018952_P1 | 5403 | 556 | 86.3 | globlastp |
| 1529 | LYD86 | basilicum\|gb157.3\|DY322542_P1 | 5404 | 556 | 86.3 | globlastp |
| 1530 | LYD86 | bruguiera\|gb166\|BP949765_P1 | 5405 | 556 | 86.3 | globlastp |
| 1531 | LYD86 | chestnut\|gb170\|SRR006295S0023708_P1 | 5402 | 556 | 86.3 | globlastp |
| 1532 | LYD86 | chestnut\|gb170\|SRR006295S0041620_P1 | 5402 | 556 | 86.3 | globlastp |
| 1533 | LYD86 | oak\|gb170\|DN949877_P1 | 5402 | 556 | 86.3 | globlastp |
| 1534 | LYD86 | peanut\|gb171\|EE123506_P1 | 5406 | 556 | 86.3 | globlastp |
| 1535 | LYD86 | pea\|09v1\|CD860415_P1 | 5407 | 556 | 86.3 | globlastp |
| 1536 | LYD86 | spurge\|gb161\|DV154503_T1 | 5409 | 556 | 86.27 | glotblastn |
| 1537 | LYD86 | cryptomeria\|gb166\|BW996232_T1 | 5410 | 556 | 84.91 | glotblastn |
| 1538 | LYD86 | spruce\|gb162\|CO218164_T1 | 5411 | 556 | 84.91 | glotblastn |
| 1539 | LYD86 | zamia\|gb166\|DY033916_T1 | 5412 | 556 | 84.91 | glotblastn |
| 1540 | LYD86 | pine\|10v1\|AW056457_P1 | 5413 | 556 | 84.9 | globlastp |
| 1541 | LYD86 | pine\|gb157.2\|AW056457_P1 | 5413 | 556 | 84.9 | globlastp |
| 1542 | LYD86 | cynodon\|10v1\|ES300626_P1 | 5414 | 556 | 84.6 | globlastp |
| 1543 | LYD86 | amborella\|gb166\|FD435944_P1 | 5415 | 556 | 84.6 | globlastp |
| 1544 | LYD86 | peanut\|10v1\|ES710826_T1 | 5416 | 556 | 84.31 | glotblastn |
| 1545 | LYD86 | peanut\|10v1\|GO341045_T1 | 5417 | 556 | 84.31 | glotblastn |
| 1546 | LYD86 | eucalyptus\|gb166\|CB967699_T1 | 5418 | 556 | 84.31 | glotblastn |
| 1547 | LYD86 | peanut\|10v1\|EE123506_T1 | 5419 | 556 | 84.31 | glotblastn |
| 1548 | LYD86 | pine\|10v1\|AA740051_P1 | 5420 | 556 | 83 | globlastp |
| 1549 | LYD86 | pine\|gb157.2\|AA740051_P1 | 5420 | 556 | 83 | globlastp |
| 1550 | LYD86 | spruce\|gb162\|CO216054_P1 | 5420 | 556 | 83 | globlastp |
| 1551 | LYD86 | sunflower\|gb162\|AJ318305_P1 | 5421 | 556 | 82.8 | globlastp |
| 1552 | LYD86 | millet\|10v1\|EVO454PM026113_P1 | 5422 | 556 | 82.7 | globlastp |
| 1553 | LYD86 | poppy\|gb166\|FE968146_P1 | 5423 | 556 | 82.7 | globlastp |
| 1554 | LYD86 | prunus\|10v1\|CV044517_P1 | 5424 | 556 | 82.4 | globlastp |
| 1555 | LYD86 | poppy\|gb166\|FE966049_P1 | 5425 | 556 | 82.4 | globlastp |
| 1556 | LYD86 | prunus\|10v1\|CB818579_P1 | 5424 | 556 | 82.4 | globlastp |
| 1557 | LYD86 | prunus\|gb167\|CB818579_P1 | 5424 | 556 | 82.4 | globlastp |
| 1558 | LYD86 | prunus\|gb167\|CB820508_P1 | 5424 | 556 | 82.4 | globlastp |
| 1559 | LYD86 | prunus\|gb167\|CV044517_P1 | 5424 | 556 | 82.4 | globlastp |
| 1560 | LYD86 | radish\|gb164\|EY904176_P1 | 5426 | 556 | 82.4 | globlastp |
| 1561 | LYD86 | lovegrass\|gb167\|EH194086_T1 | 5427 | 556 | 82.35 | glotblastn |
| 1562 | LYD86 | monkeyflower\|10v1\|DV206392_T1 | 5428 | 556 | 82.35 | glotblastn |
| 1563 | LYD86 | solanum_phureja\|09v1\|SPHDN980135_T1 | 5429 | 556 | 82.35 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1564 | LYD86 | peanut\|10v1\|SRR042421S0083859_T1 | — | 556 | 82.35 | glotblastn |
| 1565 | LYD86 | marchantia\|gb166\|BJ851604_P1 | 5430 | 556 | 81.8 | globlastp |
| 1566 | LYD86 | physcomitrella\|10v1\|BJ185620_P1 | 5431 | 556 | 80.8 | globlastp |
| 1567 | LYD86 | apple\|gb171\|CN490502_P1 | 5432 | 556 | 80.8 | globlastp |
| 1568 | LYD86 | ginger\|gb164\|DY360661_P1 | 5433 | 556 | 80.8 | globlastp |
| 1569 | LYD86 | switchgrass\|gb167\|DN151170_T1 | — | 556 | 80.77 | glotblastn |
| 1570 | LYD86 | fern\|gb171\|BP917328_T1 | 5434 | 556 | 80.39 | glotblastn |
| 1571 | LYD86 | fern\|gb171\|DK945205_T1 | 5434 | 556 | 80.39 | glotblastn |
| 1572 | LYD86 | lettuce\|10v1\|DW146230_T1 | 5435 | 556 | 80.39 | glotblastn |
| 1573 | LYD86 | lettuce\|gb157.2\|DW146230_T1 | 5435 | 556 | 80.39 | glotblastn |
| 1574 | LYD86 | orobanche\|10v1\|SRR023497S0014234_T1 | — | 556 | 80.39 | glotblastn |
| 1575 | LYD87 | potato\|gb157.2\|BQ504596_T1 | 5436 | 557 | 94.44 | glotblastn |
| 1576 | LYD87 | potato\|10v1\|CV505175_T1 | — | 557 | 93.06 | glotblastn |
| 1577 | LYD87 | eggplant\|10v1\|FS004333_P1 | 5437 | 557 | 88.7 | globlastp |
| 1578 | LYD87 | potato\|10v1\|BQ504596_T1 | — | 557 | 87.5 | glotblastn |
| 1579 | LYD87 | solanum_phureja\|09v1\|SPHAW930554_P1 | 5438 | 557 | 83.1 | globlastp |
| 1580 | LYD87 | solanum_phureja\|09v1\|SPHAW930554_T1 | — | 557 | 80.56 | glotblastn |
| 1581 | LYD88 | arabidopsis_lyrata\|09v1\|JGIAL007072_P1 | 5439 | 558 | 97.9 | globlastp |
| 1582 | LYD88 | arabidopsis_lyrata\|09v1\|JGIAL002750_P1 | 5440 | 558 | 80.7 | globlastp |
| 1583 | LYD88 | arabidopsis\|gb165\|AT1G26130_P1 | 5441 | 558 | 80.7 | globlastp |
| 1584 | LYD89 | arabidopsis\|10v1\|AT1G68050_T1 | 695 | 559 | 81.16 | glotblastn |
| 1585 | LYD90 | arabidopsis_lyrata\|09v1\|JGIAL001987_P1 | 5442 | 560 | 92.5 | globlastp |
| 1586 | LYD91 | potato\|10v1\|CN215887_P1 | 5443 | 561 | 94.1 | globlastp |
| 1587 | LYD91 | potato\|gb157.2\|CN215887_P1 | 5443 | 561 | 94.1 | globlastp |
| 1588 | LYD91 | solanum_phureja\|09v1\|SPHBG643473_P1 | 5443 | 561 | 94.1 | globlastp |
| 1589 | LYD91 | eggplant\|10v1\|FS027048_P1 | 5444 | 561 | 85.8 | globlastp |
| 1590 | LYD92 | arabidopsis_lyrata\|09v1\|JGIAL002019_P1 | 5445 | 562 | 91.3 | globlastp |
| 1591 | LYD92 | radish\|gb164\|EX746761_P1 | 5446 | 562 | 81.7 | globlastp |
| 1592 | LYD94 | arabidopsis_lyrata\|09v1\|JGIAL004398_P1 | 5447 | 563 | 90.9 | globlastp |
| 1593 | LYD95 | arabidopsis_lyrata\|09v1\|JGIAL006360_P1 | 5448 | 564 | 94.8 | globlastp |
| 1594 | LYD95 | thellungiella\|gb167\|BY806085_P1 | 5449 | 564 | 85.3 | globlastp |
| 1595 | LYD95 | canola\|10v1\|EE555701_P1 | 5450 | 564 | 80.2 | globlastp |
| 1596 | LYD95 | b_rapa\|gb162\|DY010324_P1 | 5451 | 564 | 80.2 | globlastp |
| 1597 | LYD95 | radish\|gb164\|EV547048_P1 | 5452 | 564 | 80.2 | globlastp |
| 1598 | LYD96 | arabidopsis_lyrata\|09v1\|JGIAL007972_P1 | 5453 | 565 | 91.1 | globlastp |
| 1599 | LYD97 | b_juncea\|10v2\|E6ANDIZ01AHCUW_T1 | 5454 | 566 | 83.87 | glotblastn |
| 1600 | LYD97 | b_juncea\|10v2\|E6ANDIZ01DGCSI_T1 | 5454 | 566 | 83.87 | glotblastn |
| 1601 | LYD97 | cleome_gynandra\|10v1\|SRR015532S0011847_T1 | 5455 | 566 | 83.87 | glotblastn |
| 1602 | LYD97 | cleome_spinosa\|10v1\|SRR015531S0012286_T1 | 5456 | 566 | 83.87 | glotblastn |
| 1603 | LYD97 | prunus\|10v1\|CN444116_T1 | 5457 | 566 | 83.87 | glotblastn |
| 1604 | LYD97 | b_rapa\|gb162\|EE527302_T1 | 5458 | 566 | 83.87 | glotblastn |
| 1605 | LYD97 | chestnut\|gb170\|SRR006295S0004400_T1 | 5459 | 566 | 83.87 | glotblastn |
| 1606 | LYD97 | citrus\|gb166\|CF509977_T1 | 5460 | 566 | 83.87 | glotblastn |
| 1607 | LYD97 | arabidopsis_lyrata\|09v1\|JGIAL016247_P1 | 5461 | 566 | 83.6 | globlastp |
| 1608 | LYD97 | artemisia\|10v1\|SRR019552S0293476_T1 | 5462 | 566 | 82.26 | glotblastn |
| 1609 | LYD97 | b_juncea\|10v2\|BJ1SLX00052468D2_T1 | 5463 | 566 | 82.26 | glotblastn |
| 1610 | LYD97 | canola\|10v1\|CD812513_T1 | 5463 | 566 | 82.26 | glotblastn |
| 1611 | LYD97 | canola\|10v1\|CD813050_T1 | 5464 | 566 | 82.26 | glotblastn |
| 1612 | LYD97 | oak\|10v1\|DN950354_T1 | 5465 | 566 | 82.26 | glotblastn |
| 1613 | LYD97 | oak\|10v1\|FP044338_T1 | 5465 | 566 | 82.26 | glotblastn |
| 1614 | LYD97 | b_juncea\|gb164\|EVGN00599610960902_T1 | 5466 | 566 | 82.26 | glotblastn |
| 1615 | LYD97 | b_juncea\|gb164\|EVGN00820308641772_T1 | 5467 | 566 | 82.26 | glotblastn |
| 1616 | LYD97 | b_juncea\|10v2\|E6ANDIZ01A4PGS_T1 | 5463 | 566 | 82.26 | glotblastn |
| 1617 | LYD97 | b_juncea\|gb164\|EVGN00871713963261_T1 | 5463 | 566 | 82.26 | glotblastn |
| 1618 | LYD97 | b_oleracea\|gb161\|ES949849_T1 | 5464 | 566 | 82.26 | glotblastn |
| 1619 | LYD97 | b_rapa\|gb162\|EE517284_T1 | 5463 | 566 | 82.26 | glotblastn |
| 1620 | LYD97 | canola\|gb161\|CD812513_T1 | 5463 | 566 | 82.26 | glotblastn |
| 1621 | LYD97 | canola\|gb161\|CD813050_T1 | 5464 | 566 | 82.26 | glotblastn |
| 1622 | LYD97 | canola\|gb161\|CN736915_T1 | 5463 | 566 | 82.26 | glotblastn |
| 1623 | LYD97 | oak\|gb170\|DN950354_T1 | 5465 | 566 | 82.26 | glotblastn |
| 1624 | LYD97 | radish\|gb164\|EW714476_T1 | 5468 | 566 | 82.26 | glotblastn |
| 1625 | LYD97 | spurge\|gb161\|DV139037_T1 | 5469 | 566 | 82.26 | glotblastn |
| 1626 | LYD97 | canola\|10v1\|CN736915_T1 | 5463 | 566 | 82.26 | glotblastn |
| 1627 | LYD97 | b_oleracea\|gb161\|AM057184_T1 | 5470 | 566 | 82.26 | glotblastn |
| 1628 | LYD97 | canola\|10v1\|CD811653_T1 | 5470 | 566 | 82.26 | glotblastn |
| 1629 | LYD97 | canola\|gb161\|CD811653_T1 | 5470 | 566 | 82.26 | glotblastn |
| 1630 | LYD97 | canola\|10v1\|CD838423_T1 | 5470 | 566 | 82.26 | glotblastn |
| 1631 | LYD97 | canola\|gb161\|CD838423_T1 | 5470 | 566 | 82.26 | glotblastn |
| 1632 | LYD97 | acacia\|10v1\|FS588284_T1 | 5471 | 566 | 80.65 | glotblastn |
| 1633 | LYD97 | arabidopsis_lyrata\|09v1\|BQ834172_T1 | 5472 | 566 | 80.65 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1634 | LYD97 | b_juncea\|10v2\|E6ANDIZ01A3GHB_T1 | 5473 | 566 | 80.65 | glotblastn |
| 1635 | LYD97 | b_juncea\|10v2\|E6ANDIZ01AT806_T1 | 5474 | 566 | 80.65 | glotblastn |
| 1636 | LYD97 | b_juncea\|10v2\|E6ANDIZ01CWXC3_T1 | 5475 | 566 | 80.65 | glotblastn |
| 1637 | LYD97 | melon\|10v1\|AM723468_T1 | 5476 | 566 | 80.65 | glotblastn |
| 1638 | LYD97 | nasturtium\|10v1\|SRR032558S0093244_T1 | 5477 | 566 | 80.65 | glotblastn |
| 1639 | LYD97 | avocado\|10v1\|FD505830_T1 | 5478 | 566 | 80.65 | glotblastn |
| 1640 | LYD97 | avocado\|gb164\|FD505830_T1 | 5478 | 566 | 80.65 | glotblastn |
| 1641 | LYD97 | cacao\|gb167\|CU469972_T1 | 5479 | 566 | 80.65 | glotblastn |
| 1642 | LYD97 | nuphar\|gb166\|CD474040_T1 | 5480 | 566 | 80.65 | glotblastn |
| 1643 | LYD97 | poplar\|gb170\|BI123662_T1 | 5481 | 566 | 80.65 | glotblastn |
| 1644 | LYD97 | radish\|gb164\|EV535996_T1 | 5482 | 566 | 80.65 | glotblastn |
| 1645 | LYD97 | radish\|gb164\|EX762610_T1 | 5483 | 566 | 80.65 | glotblastn |
| 1646 | LYD97 | radish\|gb164\|EX889839_T1 | 5472 | 566 | 80.65 | glotblastn |
| 1647 | LYD97 | tea\|10v1\|GE651392_T1 | 5484 | 566 | 80.65 | glotblastn |
| 1648 | LYD97 | tea\|gb171\|GE651392_T1 | 5484 | 566 | 80.65 | glotblastn |
| 1649 | LYD97 | b_juncea\|10v2\|BJ1SLX00446286D1_P1 | 5485 | 566 | 80.6 | globlastp |
| 1650 | LYD99 | arabidopsis_lyrata\|09v1\|JGIAL016742_P1 | 5486 | 567 | 93.7 | globlastp |
| 1651 | LYD99 | canola\|10v1\|CD824755_P1 | 5487 | 567 | 84.3 | globlastp |
| 1652 | LYD99 | canola\|gb161\|CD824755_T1 | 5488 | 567 | 83.98 | glotblastn |
| 1653 | LYD101 | arabidopsis_lyrata\|09v1\|JGIAL026794_T1 | 5489 | 568 | 94.94 | glotblastn |
| 1654 | LYD101 | thellungiella\|gb167\|BY818527_P1 | 5490 | 568 | 84.8 | globlastp |
| 1655 | LYD101 | canola\|gb161\|CD814430_T1 | 5491 | 568 | 84.13 | glotblastn |
| 1656 | LYD101 | radish\|gb164\|EX754941_T1 | 5492 | 568 | 82.97 | glotblastn |
| 1657 | LYD101 | canola\|gb161\|CN733694_P1 | 5493 | 568 | 82.9 | globlastp |
| 1658 | LYD101 | canola\|10v1\|DY006642_P1 | 5494 | 568 | 82.9 | globlastp |
| 1659 | LYD101 | b_rapa\|gb162\|EE520760_P1 | 5495 | 568 | 81.7 | globlastp |
| 1660 | LYD102 | arabidopsis_lyrata\|09v1\|JGIAL025624_T1 | 5496 | 569 | 95.3 | glotblastn |
| 1661 | LYD103 | arabidopsis\|10v1\|AT5G05040_P1 | 5497 | 570 | 94.8 | globlastp |
| 1662 | LYD104 | arabidopsis_lyrata\|09v1\|JGIAL021995_P1 | 5498 | 571 | 85.8 | globlastp |
| 1663 | LYD105 | canola\|10v1\|ES900634_P1 | 5499 | 572 | 89 | globlastp |
| 1664 | LYD105 | canola\|gb161\|ES900634_P1 | 5499 | 572 | 89 | globlastp |
| 1665 | LYD105 | radish\|gb164\|EX770229_T1 | 5500 | 572 | 88.67 | globlastp |
| 1666 | LYD105 | prunus\|10v1\|DY255399_P1 | 5501 | 572 | 80.6 | globlastp |
| 1667 | LYD105 | poplar\|10v1\|BU896271_T1 | 5502 | 572 | 80.51 | glotblastn |
| 1668 | LYD105 | poplar\|gb170\|BU896271_T1 | 5502 | 572 | 80.51 | glotblastn |
| 1669 | LYD105 | castorbean\|09v1\|XM002521435_P1 | 5503 | 572 | 80.2 | globlastp |
| 1670 | LYD105 | poplar\|10v1\|CB240481_T1 | 5504 | 572 | 80.17 | glotblastn |
| 1671 | LYD105 | poplar\|gb170\|CB240481_T1 | 5504 | 572 | 80.17 | glotblastn |
| 1672 | LYD107 | arabidopsis_lyrata\|09v1\|JGIAL030915_P1 | 5505 | 574 | 95.3 | globlastp |
| 1673 | LYD108 | arabidopsis\|10v1\|AT1G69260_P1 | 5506 | 575 | 80.4 | globlastp |
| 1674 | LYD108 | arabidopsis_lyrata\|09v1\|JGIAL007132_T1 | 5507 | 575 | 80.39 | glotblastn |
| 1675 | LYD109 | canola\|10v1\|CX191086_P1 | 5508 | 576 | 98.1 | globlastp |
| 1676 | LYD109 | b_rapa\|gb162\|CV545543_P1 | 5509 | 576 | 98.1 | globlastp |
| 1677 | LYD109 | canola\|gb161\|CD827969_P1 | 5510 | 576 | 94.2 | globlastp |
| 1678 | LYD109 | cotton\|10v1\|CO090506_P1 | 5511 | 576 | 81.7 | globlastp |
| 1679 | LYD109 | sunflower\|gb162\|DY905124_P1 | 5512 | 576 | 81.2 | globlastp |
| 1680 | LYD109 | centaurea\|gb166\|EH713977_T1 | 5513 | 576 | 81.16 | glotblastn |
| 1681 | LYD109 | artemisia\|gb164\|EY095004_P1 | 5514 | 576 | 81 | globlastp |
| 1682 | LYD109 | cassava\|09v1\|DV454624_P1 | 5515 | 576 | 80.8 | globlastp |
| 1683 | LYD109 | cotton\|gb164\|CO090506_P1 | 5516 | 576 | 80.7 | globlastp |
| 1684 | LYD109 | cynara\|gb167\|GE577297_T1 | 5517 | 576 | 80.51 | glotblastn |
| 1685 | LYD109 | artemisia\|10v1\|EY095004_P1 | 5518 | 576 | 80.4 | globlastp |
| 1686 | LYD109 | sunflower\|10v1\|DY905124_T1 | 5519 | 576 | 80.17 | glotblastn |
| 1687 | LYD109 | cichorium\|gb171\|EH674636_P1 | 5520 | 576 | 80 | globlastp |
| 1688 | LYD110 | arabidopsis_lyrata\|09v1\|JGIAL020149_P1 | 5521 | 577 | 93.1 | globlastp |
| 1689 | LYD110 | arabidopsis\|gb165\|AT5G04950_P1 | 5522 | 577 | 93.1 | globlastp |
| 1690 | LYD110 | arabidopsis\|10v1\|AT5G04950_P1 | 5522 | 577 | 93.1 | globlastp |
| 1691 | LYD113 | arabidopsis_lyrata\|09v1\|JGIAL025749_P1 | 5523 | 578 | 80.7 | globlastp |
| 1692 | LYD113 | arabidopsis\|10v1\|AT4G23600_P1 | 5524 | 578 | 80.4 | globlastp |
| 1693 | LYD113 | arabidopsis\|gb165\|AT4G23600_P1 | 5524 | 578 | 80.4 | globlastp |
| 1694 | LYD117 | canola\|gb161\|ES899985_T1 | 5525 | 580 | 98.33 | globlastp |
| 1695 | LYD117 | canola\|10v1\|ES899985_P1 | 5526 | 580 | 98.3 | globlastp |
| 1696 | LYD117 | b_juncea\|gb164\|EVGN00853408702074_P1 | 5527 | 580 | 96.7 | globlastp |
| 1697 | LYD117 | arabidopsis_lyrata\|09v1\|JGIAL010445_P1 | 5528 | 580 | 85 | globlastp |
| 1698 | LYD117 | arabidopsis\|10v1\|AT3G19030_P1 | 5529 | 580 | 85 | globlastp |
| 1699 | LYD117 | arabidopsis\|gb165\|AT3G19030_P1 | 5529 | 580 | 85 | globlastp |
| 1700 | LYD117 | canola\|10v1\|DV643336_P1 | 5530 | 580 | 85 | globlastp |
| 1701 | LYD117 | canola\|gb161\|DV643336_T1 | 5531 | 580 | 85 | glotblastn |
| 1702 | LYD117 | thellungiella\|gb167\|BY830657_P1 | 5532 | 580 | 85 | globlastp |
| 1703 | LYD117 | b_juncea\|gb164\|DT317662_T1 | 5533 | 580 | 83.33 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1704 | LYD117 | b_juncea|10v2|DT317662_P1 | 5534 | 580 | 83.3 | globlastp |
| 1705 | LYD117 | b_rapa|gb162|DN960553_T1 | 5535 | 580 | 81.67 | glotblastn |
| 1706 | LYD117 | b_rapa|gb162|EX140655_P1 | 5536 | 580 | 80 | globlastp |
| 1707 | LYD117 | radish|gb164|EV529011_P1 | 5537 | 580 | 80 | globlastp |
| 1708 | LYD118 | canola|gb161|CD817267_P1 | 5538 | 581 | 95.2 | globlastp |
| 1709 | LYD118 | canola|10v1|CD817267_T1 | 5539 | 581 | 93.98 | glotblastn |
| 1710 | LYD120 | canola|10v1|AI352738_P1 | 5540 | 583 | 96.7 | globlastp |
| 1711 | LYD120 | b_rapa|gb162|CV523156_P1 | 5541 | 583 | 94.6 | globlastp |
| 1712 | LYD120 | canola|gb161|AI352738_P1 | 5542 | 583 | 91.6 | globlastp |
| 1713 | LYD120 | radish|gb164|EW722416_P1 | 5543 | 583 | 85.2 | globlastp |
| 1714 | LYD122 | canola|10v1|CD823303_P1 | 5544 | 584 | 97.8 | globlastp |
| 1715 | LYD122 | b_rapa|gb162|CX268424_P1 | 5545 | 584 | 97.8 | globlastp |
| 1716 | LYD122 | canola|gb161|CD833389_P1 | 5544 | 584 | 97.8 | globlastp |
| 1717 | LYD122 | canola|10v1|CD833389_T1 | 5546 | 584 | 95.52 | glotblastn |
| 1718 | LYD122 | canola|10v1|H07385_P1 | 5547 | 584 | 94.6 | globlastp |
| 1719 | LYD122 | radish|gb164|EV527743_P1 | 5548 | 584 | 85.9 | globlastp |
| 1720 | LYD122 | b_oleracea|gb161|CO729358_T1 | 5549 | 584 | 84.06 | glotblastn |
| 1721 | LYD122 | radish|gb164|EV535258_P1 | 5550 | 584 | 83.3 | globlastp |
| 1722 | LYD122 | radish|gb164|EW724035_P1 | 5550 | 584 | 83.3 | globlastp |
| 1723 | LYD122 | b_rapa|gb162|CX272620_P1 | 5551 | 584 | 82 | globlastp |
| 1724 | LYD122 | canola|10v1|CD828378_P1 | 5552 | 584 | 82 | globlastp |
| 1725 | LYD122 | canola|gb161|CD828378_P1 | 5552 | 584 | 82 | globlastp |
| 1726 | LYD122 | radish|gb164|EX890296_P1 | 5553 | 584 | 81.9 | globlastp |
| 1727 | LYD122 | b_juncea|10v2|E6ANDIZ01B5P5S_P1 | 5554 | 584 | 81.7 | globlastp |
| 1728 | LYD122 | b_juncea|gb164|EVGN01023309282188_P1 | 5555 | 584 | 81.7 | globlastp |
| 1729 | LYD122 | radish|gb164|EX760929_P1 | 5556 | 584 | 81.4 | globlastp |
| 1730 | LYD122 | arabidopsis_lyrata|09v1|JGIAL009885_P1 | 5557 | 584 | 80.2 | globlastp |
| 1731 | LYD122 | radish|gb164|EV567933_P1 | 5558 | 584 | 80.1 | globlastp |
| 1732 | LYD122 | radish|gb164|FD557550_T1 | 5559 | 584 | 80.09 | glotblastn |
| 1733 | LYD123 | canola|10v1|H07806_P1 | 5560 | 585 | 96.3 | globlastp |
| 1734 | LYD123 | canola|gb161|H07806_P1 | 5560 | 585 | 96.3 | globlastp |
| 1735 | LYD123 | b_rapa|gb162|CO750130_P1 | 5561 | 585 | 95.9 | globlastp |
| 1736 | LYD123 | b_rapa|gb162|CX265903_P1 | 5562 | 585 | 82.9 | globlastp |
| 1737 | LYD128 | soybean|gb168|AL369494_T1 | 5563 | 590 | 98.77 | glotblastn |
| 1738 | LYD128 | oak|10v1|FN715603_T1 | 5564 | 590 | 92.92 | glotblastn |
| 1739 | LYD128 | cotton|10v1|CO092231_T1 | 5565 | 590 | 90.74 | glotblastn |
| 1740 | LYD128 | citrus|gb166|CF829285_T1 | 5566 | 590 | 90.15 | glotblastn |
| 1741 | LYD128 | cassava|09v1|DB929656_T1 | 5567 | 590 | 90.12 | glotblastn |
| 1742 | LYD128 | prunus|10v1|CN900288_T1 | 5568 | 590 | 88.92 | glotblastn |
| 1743 | LYD128 | castorbean|09v1|EG658310_T1 | 5569 | 590 | 88.62 | glotblastn |
| 1744 | LYD128 | cucumber|09v1|CSCRP002509_P1 | 5570 | 590 | 87 | globlastp |
| 1745 | LYD128 | poplar|10v1|BU825993_T1 | 5571 | 590 | 86.46 | glotblastn |
| 1746 | LYD128 | poplar|gb170|BU825993_T1 | 5572 | 590 | 86.46 | glotblastn |
| 1747 | LYD128 | nasturtium|10v1|SRR032559S0102172_P1 | 5573 | 590 | 85.1 | globlastp |
| 1748 | LYD128 | aquilegia|10v1|DT733538_T1 | 5574 | 590 | 83.69 | glotblastn |
| 1749 | LYD128 | aquilegia|gb157.3|DT733538_T1 | 5574 | 590 | 83.69 | glotblastn |
| 1750 | LYD128 | spurge|gb161|DV123236_P1 | 5575 | 590 | 83.6 | globlastp |
| 1751 | LYD128 | artemisia|10v1|EY105477_T1 | 5576 | 590 | 82.72 | glotblastn |
| 1752 | LYD128 | pigeonpea|10v1|SRR054580S0061350_P1 | 5577 | 590 | 82.7 | globlastp |
| 1753 | LYD128 | monkeyflower|10v1|DV210221_T1 | 5578 | 590 | 82.46 | glotblastn |
| 1754 | LYD128 | arabidopsis|10v1|AT5G51660_T1 | 692 | 590 | 82.41 | glotblastn |
| 1755 | LYD128 | artemisia|gb164|EY105477_P1 | 5579 | 590 | 82.3 | globlastp |
| 1756 | LYD128 | lettuce|10v1|DW076329_T1 | 5580 | 590 | 82.2 | glotblastn |
| 1757 | LYD128 | arabidopsis_lyrata|09v1|JGIAL029590_T1 | 5581 | 590 | 82.1 | glotblastn |
| 1757 | LYD128_H1 | arabidopsis_lyrata|09v1|JGIAL029590_P1 | 5581 | 692 | 96.1 | globlastp |
| 1758 | LYD128 | solanum_phureja|09v1|SPHAW033433_T1 | 5582 | 590 | 81.54 | glotblastn |
| 1759 | LYD128 | tomato|09v1|AW033433_T1 | 5583 | 590 | 81.54 | glotblastn |
| 1760 | LYD128 | tomato|gb164|AW033433_T1 | 5584 | 590 | 80.92 | glotblastn |
| 1761 | LYD128 | maize|gb170|AW267531_T1 | 5585 | 590 | 80.86 | glotblastn |
| 1762 | LYD128 | maize|gb170|LLAW267531_T1 | 5586 | 590 | 80.86 | glotblastn |
| 1763 | LYD128 | sorghum|09v1|SB06G003570_T1 | 5587 | 590 | 80.56 | glotblastn |
| 1764 | LYD128 | switchgrass|gb167|FE616956_T1 | 5588 | 590 | 80.25 | glotblastn |
| 1765 | LYD129 | soybean|gb168|BI967184_P1 | 5589 | 591 | 95.9 | globlastp |
| 1766 | LYD129 | lotus|09v1|AV425312_P1 | 5590 | 591 | 83 | globlastp |
| 1767 | LYD129 | medicago|09v1|AL369300_P1 | 5591 | 591 | 81.4 | globlastp |
| 1768 | LYD132 | soybean|gb168|AW693844_P1 | 5592 | 592 | 99.3 | globlastp |
| 1769 | LYD132 | soybean|gb168|BF004853_P1 | 5593 | 592 | 91.5 | globlastp |
| 1770 | LYD132 | pigeonpea|10v1|SRR054580S0087423_P1 | 5594 | 592 | 83.9 | globlastp |
| 1771 | LYD132 | cowpea|gb166|FF384575_P1 | 5595 | 592 | 80.7 | globlastp |
| 1772 | LYD132 | medicago|09v1|AW191239_P1 | 5596 | 592 | 80.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1773 | LYD133 | soybean\|gb168\|CD393324_P1 | 5597 | 593 | 91.8 | globlastp |
| 1774 | LYD133 | cowpea\|gb166\|FF385910_P1 | 5598 | 593 | 88.1 | globlastp |
| 1775 | LYD133 | medicago\|09v1\|LLAI737587_T1 | 5599 | 593 | 82.58 | glotblastn |
| 1776 | LYD133 | pea\|09v1\|AJ784963_P1 | 5600 | 593 | 80.7 | globlastp |
| 1777 | LYD134 | soybean\|gb168\|BI969393_P1 | 5601 | 594 | 90.8 | globlastp |
| 1778 | LYD134 | pigeonpea\|10v1\|SRR054580S0012839_P1 | 5602 | 594 | 82.6 | globlastp |
| 1779 | LYD134 | cowpea\|gb166\|FG838398_P1 | 5603 | 594 | 81.6 | globlastp |
| 1780 | LYD136 | soybean\|gb168\|BE239778_P1 | 5604 | 595 | 96.5 | globlastp |
| 1781 | LYD136 | cowpea\|gb166\|EG594237_P1 | 5605 | 595 | 92.3 | globlastp |
| 1782 | LYD136 | peanut\|10v1\|ES704221_P1 | 5606 | 595 | 85.3 | globlastp |
| 1783 | LYD136 | medicago\|09v1\|AW685064_P1 | 5607 | 595 | 85.3 | globlastp |
| 1784 | LYD136 | cotton\|gb164\|AI726457_P1 | 5608 | 595 | 84 | globlastp |
| 1785 | LYD136 | poplar\|gb170\|BI130072_P1 | 5609 | 595 | 82.9 | globlastp |
| 1786 | LYD136 | poplar\|10v1\|BI130072_P1 | 5610 | 595 | 82.8 | globlastp |
| 1787 | LYD136 | chestnut\|gb170\|SRR006295S0010383_T1 | 5611 | 595 | 82.78 | glotblastn |
| 1788 | LYD136 | citrus\|gb166\|BQ623379_P1 | 5612 | 595 | 82.3 | globlastp |
| 1789 | LYD136 | poplar\|10v1\|AI163151_P1 | 5613 | 595 | 82.3 | globlastp |
| 1790 | LYD136 | poplar\|gb170\|AI163151_P1 | 5613 | 595 | 82.3 | globlastp |
| 1791 | LYD136 | castorbean\|09v1\|EG665587_P1 | 5614 | 595 | 82.1 | globlastp |
| 1792 | LYD136 | cucumber\|09v1\|DN909551_P1 | 5615 | 595 | 81.6 | globlastp |
| 1793 | LYD136 | cotton\|10v1\|CO092102_P1 | 5616 | 595 | 81.6 | globlastp |
| 1794 | LYD136 | cotton\|gb164\|CO092102_P1 | 5617 | 595 | 81.6 | globlastp |
| 1795 | LYD136 | cassava\|09v1\|FF380826_P1 | 5618 | 595 | 80.1 | globlastp |
| 1796 | LYD139 | soybean\|gb168\|BE998145_P1 | 5619 | 596 | 94.1 | globlastp |
| 1797 | LYD139 | pigeonpea\|10v1\|SRR054580S0001303_P1 | 5620 | 596 | 88.8 | globlastp |
| 1798 | LYD139 | bean\|gb167\|CA911135_P1 | 5621 | 596 | 85.8 | globlastp |
| 1799 | LYD139 | cowpea\|gb166\|FF543055_P1 | 5622 | 596 | 81.3 | globlastp |
| 1800 | LYD139 | lotus\|09v1\|BP035957_P1 | 5623 | 596 | 80.8 | globlastp |
| 1801 | LYD139 | peanut\|10v1\|SRR042413S0028830_P1 | 5624 | 596 | 80.5 | globlastp |
| 1802 | LYD140 | soybean\|gb168\|CA912345_T1 | 5625 | 597 | 95.28 | glotblastn |
| 1803 | LYD140 | soybean\|gb168\|BF645424_P1 | 5626 | 597 | 89.7 | globlastp |
| 1804 | LYD140 | bean\|gb167\|CA912345_T1 | 5627 | 597 | 87.61 | glotblastn |
| 1805 | LYD140 | cowpea\|gb166\|FF382497_P1 | 5628 | 597 | 87.1 | globlastp |
| 1806 | LYD140 | cowpea\|gb166\|FF393151_P1 | 5629 | 597 | 84.1 | globlastp |
| 1807 | LYD140 | medicago\|09v1\|BF645424_P1 | 5630 | 597 | 83.7 | globlastp |
| 1808 | LYD140 | peanut\|10v1\|GO325551_P1 | 5631 | 597 | 82 | globlastp |
| 1809 | LYD142 | potato\|10v1\|BQ518275_P1 | 5632 | 598 | 92.2 | globlastp |
| 1810 | LYD142 | potato\|gb157.2\|BQ518275_P1 | 5632 | 598 | 92.2 | globlastp |
| 1811 | LYD142 | solanum_phureja\|09v1\|SPHAI779400_P1 | 5633 | 598 | 91.1 | globlastp |
| 1812 | LYD146 | potato\|10v1\|DN589883_P1 | 5634 | 600 | 97 | globlastp |
| 1813 | LYD146 | potato\|gb157.2\|DN589883_P1 | 5634 | 600 | 97 | globlastp |
| 1814 | LYD146 | solanum_phureja\|09v1\|SPHDN589883_P1 | 5634 | 600 | 97 | globlastp |
| 1815 | LYD146 | peanut\|10v1\|SRR042421S0018443_P1 | 5635 | 600 | 83.3 | globlastp |
| 1816 | LYD146 | liquorice\|gb171\|FS241344_P1 | 5636 | 600 | 83.3 | globlastp |
| 1817 | LYD146 | pepper\|gb171\|GD081638_P1 | 5637 | 600 | 82.6 | globlastp |
| 1818 | LYD146 | soybean\|gb168\|BM528198_P1 | 5638 | 600 | 80.6 | globlastp |
| 1819 | LYD146 | coffea\|10v1\|EG328835_P1 | 5639 | 600 | 80.3 | globlastp |
| 1820 | LYD146 | heritiera\|10v1\|SRR005795S0062589_P1 | 5640 | 600 | 80.3 | globlastp |
| 1821 | LYD146 | ipomoea_batatas\|10v1\|EE880432XX1_P1 | 5641 | 600 | 80.3 | globlastp |
| 1822 | LYD146 | chickpea\|09v2\|GR390849_P1 | 5642 | 600 | 80.3 | globlastp |
| 1823 | LYD146 | cotton\|10v1\|DW509770_P1 | 5643 | 600 | 80.3 | globlastp |
| 1824 | LYD146 | cotton\|gb164\|DW509770_P1 | 5644 | 600 | 80.3 | globlastp |
| 1825 | LYD146 | ipomoea\|gb157.2\|EE880432_P1 | 5641 | 600 | 80.3 | globlastp |
| 1826 | LYD148 | sugarcane\|gb157.3\|CA086966_P1 | 5645 | 601 | 97.5 | globlastp |
| 1827 | LYD148 | sugarcane\|10v1\|CA086966_P1 | 5645 | 601 | 97.5 | globlastp |
| 1828 | LYD148 | sugarcane\|gb157.3\|CA086964_P1 | 5646 | 601 | 92.9 | globlastp |
| 1829 | LYD148 | sugarcane\|gb157.3\|CA133201_P1 | 5647 | 601 | 92.9 | globlastp |
| 1830 | LYD148 | maize\|10v1\|AI855415_P1 | 5648 | 601 | 92.1 | globlastp |
| 1831 | LYD148 | maize\|gb170\|AI855415_P1 | 5648 | 601 | 92.1 | globlastp |
| 1832 | LYD148 | switchgrass\|gb167\|DN143352_P1 | 5649 | 601 | 91.2 | globlastp |
| 1833 | LYD148 | sugarcane\|gb157.3\|BQ535047_P1 | 5650 | 601 | 90.8 | globlastp |
| 1834 | LYD148 | sugarcane\|gb157.3\|CA066950_P1 | 5651 | 601 | 90.8 | globlastp |
| 1835 | LYD148 | sugarcane\|10v1\|BQ535149_P1 | 5650 | 601 | 90.8 | globlastp |
| 1836 | LYD148 | switchgrass\|gb167\|FE639818_P1 | 5652 | 601 | 90.8 | globlastp |
| 1837 | LYD148 | millet\|10v1\|EVO454PM002672_P1 | 5653 | 601 | 90.4 | globlastp |
| 1838 | LYD148 | millet\|10v1\|PMSLX0001952D2_P1 | 5653 | 601 | 90.4 | globlastp |
| 1839 | LYD148 | sorghum\|09v1\|SB08G002850_P1 | 5654 | 601 | 90.4 | globlastp |
| 1840 | LYD148 | sugarcane\|gb157.3\|BQ479020_P1 | 5655 | 601 | 90.4 | globlastp |
| 1841 | LYD148 | wheat\|gb164\|CA484173_P1 | 5656 | 601 | 90.4 | globlastp |
| 1842 | LYD148 | maize\|10v1\|T27554_P1 | 5657 | 601 | 89.2 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1843 | LYD148 | maize\|gb170\|T27554_P1 | 5657 | 601 | 89.2 | globlastp |
| 1844 | LYD148 | millet\|10v1\|EVO454PM000212_P1 | 5658 | 601 | 89.1 | globlastp |
| 1845 | LYD148 | leymus\|gb166\|CN465810_P1 | 5659 | 601 | 89.1 | globlastp |
| 1846 | LYD148 | pseudoroegneria\|gb167\|FF340328_P1 | 5660 | 601 | 89.1 | globlastp |
| 1847 | LYD148 | switchgrass\|gb167\|FE599346_P1 | 5661 | 601 | 88.9 | globlastp |
| 1848 | LYD148 | wheat\|gb164\|BE403756_P1 | 5662 | 601 | 88.7 | globlastp |
| 1849 | LYD148 | wheat\|gb164\|BE399235_P1 | 5663 | 601 | 88.3 | globlastp |
| 1850 | LYD148 | wheat\|gb164\|WHTWALI_P1 | 5664 | 601 | 88.3 | globlastp |
| 1851 | LYD148 | cynodon\|10v1\|ES293788_P1 | 5665 | 601 | 87.9 | globlastp |
| 1852 | LYD148 | barley\|10v1\|BE421842_P1 | 5666 | 601 | 87.9 | globlastp |
| 1853 | LYD148 | barley\|gb157SOLEXA\|BE421842_P1 | 5666 | 601 | 87.9 | globlastp |
| 1854 | LYD148 | switchgrass\|gb167\|FE607361_P1 | 5667 | 601 | 87.7 | globlastp |
| 1855 | LYD148 | fescue\|gb161\|DT682653_P1 | 5668 | 601 | 87.4 | globlastp |
| 1856 | LYD148 | oat\|10v2\|GO585949_P1 | 5669 | 601 | 87 | globlastp |
| 1857 | LYD148 | brachypodium\|09v1\|DV469530_P1 | 5670 | 601 | 86.8 | globlastp |
| 1858 | LYD148 | brachypodium\|gb169\|WHTWALI_P1 | 5670 | 601 | 86.8 | globlastp |
| 1859 | LYD148 | rice\|gb170\|OS11G05050_P1 | 5671 | 601 | 86.6 | globlastp |
| 1860 | LYD148 | rice\|gb170\|OS12G05050_P1 | 5672 | 601 | 86.2 | globlastp |
| 1861 | LYD148 | sugarcane\|10v1\|BQ535105_P1 | 5673 | 601 | 82.1 | globlastp |
| 1862 | LYD148 | sugarcane\|gb157.3\|CA069553_T1 | 5674 | 601 | 80.33 | glotblastn |
| 1863 | LYD149 | arabidopsis_lyrata\|09v1\|JGIAL000485_T1 | 5675 | 602 | 97.98 | glotblastn |
| 1864 | LYD150 | arabidopsis\|10v1\|AT1G61310_P1 | 5676 | 603 | 85.4 | globlastp |
| 1865 | LYD152 | arabidopsis_lyrata\|09v1\|JGIAL019864_P1 | 5677 | 604 | 87.1 | globlastp |
| 1866 | LYD153 | arabidopsis_lyrata\|09v1\|JGIAL028781_P1 | 5678 | 605 | 94.7 | globlastp |
| 1867 | LYD153 | canola\|10v1\|CD834597_T1 | 5679 | 605 | 86.09 | glotblastn |
| 1868 | LYD156 | solanum_phureja\|09v1\|SPHBG125257_P1 | 5680 | 606 | 93.4 | globlastp |
| 1869 | LYD156 | tobacco\|gb162\|DW003871_P1 | 5681 | 606 | 86.2 | globlastp |
| 1870 | LYD157 | solanum_phureja\|09v1\|SPHBG735318_P1 | 5682 | 607 | 97.8 | globlastp |
| 1871 | LYD157 | tobacco\|gb162\|EB443875_T1 | 5683 | 607 | 92.45 | glotblastn |
| 1872 | LYD157 | triphysaria\|10v1\|DR173387_P1 | 5684 | 607 | 81 | globlastp |
| 1873 | LYD157 | monkeyflower\|09v1\|DV206293_T1 | 5685 | 607 | 80.41 | glotblastn |
| 1874 | LYD157 | monkeyflower\|10v1\|DV206293_P1 | 5686 | 607 | 80.3 | globlastp |
| 1875 | LYD158 | solanum_phureja\|09v1\|SPHCV302355_P1 | 5687 | 608 | 92.1 | globlastp |
| 1876 | LYD159 | canola\|10v1\|CD840853_P1 | 5688 | 609 | 99.4 | globlastp |
| 1877 | LYD159 | b_rapa\|gb162\|CV433375_P1 | 5689 | 609 | 97.5 | globlastp |
| 1878 | LYD159 | canola\|10v1\|CX188057_P1 | 5690 | 609 | 97.5 | globlastp |
| 1879 | LYD159 | canola\|gb161\|CX188057_P1 | 5690 | 609 | 97.5 | globlastp |
| 1880 | LYD159 | radish\|gb164\|EV526121_P1 | 5691 | 609 | 96.3 | globlastp |
| 1881 | LYD159 | arabidopsis_lyrata\|09v1\|BQ834364_P1 | 5692 | 609 | 95.1 | globlastp |
| 1882 | LYD159 | arabidopsis\|10v1\|AT1G80920_P1 | 5692 | 609 | 95.1 | globlastp |
| 1883 | LYD159 | arabidopsis\|gb165\|AT1G80920_P1 | 5692 | 609 | 95.1 | globlastp |
| 1884 | LYD159 | arabidopsis_lyrata\|09v1\|TMPLEW733261T1_T1 | 5693 | 609 | 95.09 | glotblastn |
| 1885 | LYD159 | radish\|gb164\|EW713954_P1 | 5694 | 609 | 86.4 | globlastp |
| 1886 | LYD159 | radish\|gb164\|EV524864_P1 | 5695 | 609 | 83.3 | globlastp |
| 1887 | LYD166 | canola\|10v1\|BQ704758_P1 | 5696 | 610 | 99.2 | globlastp |
| 1888 | LYD166 | canola\|gb161\|BQ704758_P1 | 5696 | 610 | 99.2 | globlastp |
| 1889 | LYD166 | radish\|gb164\|EV534875_P1 | 5697 | 610 | 99.2 | globlastp |
| 1890 | LYD166 | radish\|gb164\|EV540019_P1 | 5698 | 610 | 99.2 | globlastp |
| 1891 | LYD166 | b_juncea\|10v2\|E6ANDIZ01A0QZN_P1 | 5699 | 610 | 98.7 | globlastp |
| 1892 | LYD166 | b_oleracea\|gb161\|DY015712_P1 | 5700 | 610 | 98.4 | globlastp |
| 1893 | LYD166 | arabidopsis\|10v1\|AT1G09340_P1 | 5701 | 610 | 96.8 | globlastp |
| 1894 | LYD166 | arabidopsis\|gb165\|AT1G09340_P1 | 5701 | 610 | 96.8 | globlastp |
| 1895 | LYD166 | arabidopsis_lyrata\|09v1\|JGIAL000901_P1 | 5702 | 610 | 96 | globlastp |
| 1896 | LYD166 | cleome_gynandra\|10v1\|SRR015532S0001942_P1 | 5703 | 610 | 90.8 | globlastp |
| 1897 | LYD166 | cleome_spinosa\|10v1\|GR935323_P1 | 5704 | 610 | 90 | globlastp |
| 1898 | LYD166 | cleome_spinosa\|10v1\|GR933224_P1 | 5705 | 610 | 89.4 | globlastp |
| 1899 | LYD166 | oak\|10v1\|CU640621_P1 | 5706 | 610 | 86.8 | globlastp |
| 1900 | LYD166 | aquilegia\|10v1\|DR912555_P1 | 5707 | 610 | 86.8 | globlastp |
| 1901 | LYD166 | chestnut\|gb170\|SRR006296S0063232_P1 | 5706 | 610 | 86.8 | globlastp |
| 1902 | LYD166 | b_juncea\|gb164\|EVGN00101514270624_P1 | 5708 | 610 | 86.5 | globlastp |
| 1903 | LYD166 | cassava\|gb164\|CK651731_P1 | 5709 | 610 | 86.3 | globlastp |
| 1904 | LYD166 | citrus\|gb166\|CF417618_P1 | 5710 | 610 | 86.1 | globlastp |
| 1905 | LYD166 | cassava\|09v1\|MESCRP031023_P1 | 5711 | 610 | 85.8 | globlastp |
| 1906 | LYD166 | castorbean\|09v1\|XM002512495_P1 | 5712 | 610 | 85.8 | globlastp |
| 1907 | LYD166 | radish\|gb164\|EV535299_P1 | 5713 | 610 | 85.7 | globlastp |
| 1908 | LYD166 | melon\|10v1\|AM724794_P1 | 5714 | 610 | 85.5 | globlastp |
| 1909 | LYD166 | antirrhinum\|gb166\|AJ790863_T1 | 5715 | 610 | 85.45 | glotblastn |
| 1910 | LYD166 | ipomoea\|gb157.2\|BJ556545_P1 | 5716 | 610 | 85.3 | globlastp |
| 1911 | LYD166 | melon\|gb165\|AM724794_P1 | 5717 | 610 | 85.3 | globlastp |
| 1912 | LYD166 | walnuts\|gb166\|EL890919_T1 | 5718 | 610 | 85.19 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1913 | LYD166 | prunus\|10v1\|BU044092_P1 | 5719 | 610 | 85.1 | globlastp |
| 1914 | LYD166 | cotton\|10v1\|CO070417_P1 | 5720 | 610 | 85 | globlastp |
| 1915 | LYD166 | monkeyflower\|09v1\|DV206723_P1 | 5721 | 610 | 85 | globlastp |
| 1916 | LYD166 | monkeyflower\|10v1\|DV206723_P1 | 5721 | 610 | 85 | globlastp |
| 1917 | LYD166 | papaya\|gb165\|EX256506_P1 | 5722 | 610 | 85 | globlastp |
| 1918 | LYD166 | prunus\|gb167\|BU044092_P1 | 5723 | 610 | 84.9 | globlastp |
| 1919 | LYD166 | tobacco\|gb162\|DV159774_P1 | 5724 | 610 | 84.9 | globlastp |
| 1920 | LYD166 | cotton\|gb164\|CO070417_P1 | 5725 | 610 | 84.7 | globlastp |
| 1921 | LYD166 | cucumber\|09v1\|AM724794_P1 | 5726 | 610 | 84.5 | globlastp |
| 1922 | LYD166 | triphysaria\|10v1\|EY144050_P1 | 5727 | 610 | 84.5 | globlastp |
| 1923 | LYD166 | cowpea\|gb166\|FC457398_P1 | 5728 | 610 | 84.4 | globlastp |
| 1924 | LYD166 | oak\|gb170\|CU640621_P1 | 5729 | 610 | 84.4 | globlastp |
| 1925 | LYD166 | salvia\|10v1\|FE536314_P1 | 5730 | 610 | 84.2 | globlastp |
| 1926 | LYD166 | poplar\|gb170\|BI068409_P1 | 5731 | 610 | 84.2 | globlastp |
| 1927 | LYD166 | poplar\|gb170\|BU880077_P1 | 5732 | 610 | 84.2 | globlastp |
| 1928 | LYD166 | clover\|gb162\|BB903013_P1 | 5733 | 610 | 84.1 | globlastp |
| 1929 | LYD166 | poplar\|10v1\|BU880077_P1 | 5734 | 610 | 83.9 | globlastp |
| 1930 | LYD166 | poplar\|10v1\|BI068409_P1 | 5735 | 610 | 83.7 | globlastp |
| 1931 | LYD166 | strawberry\|gb164\|DY667768_T1 | 5736 | 610 | 83.42 | glotblastn |
| 1932 | LYD166 | tomato\|09v1\|BG123220_P1 | 5737 | 610 | 83.4 | globlastp |
| 1933 | LYD166 | tomato\|gb164\|BG123220_P1 | 5737 | 610 | 83.4 | globlastp |
| 1934 | LYD166 | apple\|gb171\|CN444185_P1 | 5738 | 610 | 83.3 | globlastp |
| 1935 | LYD166 | apple\|gb171\|CN489833_P1 | 5739 | 610 | 83.3 | globlastp |
| 1936 | LYD166 | bean\|gb167\|CB280711_P1 | 5740 | 610 | 83.1 | globlastp |
| 1937 | LYD166 | grape\|gb160\|CA810251_P1 | 5741 | 610 | 83.1 | globlastp |
| 1938 | LYD166 | potato\|10v1\|BE919563_P1 | 5742 | 610 | 83.1 | globlastp |
| 1939 | LYD166 | potato\|gb157.2\|BE919563_P1 | 5742 | 610 | 83.1 | globlastp |
| 1940 | LYD166 | solanum_phureja\|09v1\|SPHBG123220_P1 | 5742 | 610 | 83.1 | globlastp |
| 1941 | LYD166 | soybean\|gb168\|AW697089_P1 | 5743 | 610 | 83.1 | globlastp |
| 1942 | LYD166 | soybean\|gb168\|BF519945_P1 | 5744 | 610 | 83.1 | globlastp |
| 1943 | LYD166 | lotus\|09v1\|AV411209_P1 | 5745 | 610 | 82.8 | globlastp |
| 1944 | LYD166 | eggplant\|10v1\|FS064026_P1 | 5746 | 610 | 82.3 | globlastp |
| 1945 | LYD166 | rhizophora\|10v1\|SRR005792S0001147_P1 | 5747 | 610 | 82.2 | globlastp |
| 1946 | LYD166 | artemisia\|10v1\|EY037995_P1 | 5748 | 610 | 81.5 | globlastp |
| 1947 | LYD166 | artemisia\|gb164\|EY037995_P1 | 5748 | 610 | 81.5 | globlastp |
| 1948 | LYD166 | nicotiana_benthamiana\|gb162\|CN746126_P1 | 5749 | 610 | 81.2 | globlastp |
| 1949 | LYD166 | centaurea\|gb166\|EH725433_T1 | 5750 | 610 | 80.95 | glotblastn |
| 1950 | LYD166 | cichorium\|gb171\|EH694497_T1 | 5751 | 610 | 80.42 | glotblastn |
| 1951 | LYD166 | cynara\|gb167\|GE585828_P1 | 5752 | 610 | 80.2 | globlastp |
| 1952 | LYD166 | peanut\|10v1\|CD037653_P1 | 5753 | 610 | 80.2 | globlastp |
| 1953 | LYD166 | peanut\|gb171\|CD037653_P1 | 5754 | 610 | 80.2 | globlastp |
| 1954 | LYD166 | lettuce\|10v1\|CV699894_T1 | 5755 | 610 | 80.16 | glotblastn |
| 1955 | LYD166 | sunflower\|10v1\|BU671862_P1 | 5756 | 610 | 80.1 | globlastp |
| 1956 | LYD167 | radish\|gb164\|EV525510_P1 | 5757 | 611 | 99 | globlastp |
| 1957 | LYD167 | radish\|gb164\|EV536182_P1 | 5758 | 611 | 99 | globlastp |
| 1958 | LYD167 | b_oleracea\|gb161\|EH425281_P1 | 5759 | 611 | 97.4 | globlastp |
| 1959 | LYD167 | canola\|10v1\|CB686097_P1 | 5759 | 611 | 97.4 | globlastp |
| 1960 | LYD167 | canola\|gb161\|CB686097_P1 | 5759 | 611 | 97.4 | globlastp |
| 1961 | LYD167 | b_juncea\|gb164\|DT317679_P1 | 5760 | 611 | 96.9 | globlastp |
| 1962 | LYD167 | b_rapa\|gb162\|L37994_P1 | 5760 | 611 | 96.9 | globlastp |
| 1963 | LYD167 | canola\|10v1\|CD812237_P1 | 5760 | 611 | 96.9 | globlastp |
| 1964 | LYD167 | canola\|gb161\|CB686288_P1 | 5760 | 611 | 96.9 | globlastp |
| 1965 | LYD167 | canola\|gb161\|CX281643_P1 | 5761 | 611 | 93.9 | globlastp |
| 1966 | LYD167 | canola\|gb161\|EE430594_P1 | 5762 | 611 | 93.9 | globlastp |
| 1967 | LYD167 | canola\|10v1\|EE430594_P1 | 5763 | 611 | 93.4 | globlastp |
| 1968 | LYD167 | b_rapa\|gb162\|AT002236_P1 | 5764 | 611 | 93.4 | globlastp |
| 1969 | LYD167 | canola\|10v1\|CX281643_P1 | 5765 | 611 | 93.4 | globlastp |
| 1970 | LYD167 | b_juncea\|10v2\|BJ1SLX00005575D1_P1 | 5766 | 611 | 92.9 | globlastp |
| 1971 | LYD167 | b_juncea\|10v2\|E6ANDIZ01A3IXY_P1 | 5767 | 611 | 92.9 | globlastp |
| 1972 | LYD167 | b_juncea\|gb164\|EVGN00251514510715_P1 | 5768 | 611 | 92.9 | globlastp |
| 1973 | LYD167 | b_rapa\|gb162\|CV432763_P1 | 5769 | 611 | 92.3 | globlastp |
| 1974 | LYD167 | b_juncea\|10v2\|OXBJ1SLX00018566D1T1_P1 | 5770 | 611 | 91.8 | globlastp |
| 1975 | LYD167 | radish\|gb164\|EX749211_P1 | 5771 | 611 | 91.8 | globlastp |
| 1976 | LYD167 | b_juncea\|10v2\|E6ANDIZ01A8TWA_P1 | 5772 | 611 | 91.3 | globlastp |
| 1977 | LYD167 | b_juncea\|10v2\|OXBJ1SLX00001660D1T1_P1 | 5773 | 611 | 90.3 | globlastp |
| 1978 | LYD167 | arabidopsis\|10v1\|AT3G22840_P1 | 5774 | 611 | 89.4 | globlastp |
| 1979 | LYD167 | thellungiella\|gb167\|DN772992_P1 | 5775 | 611 | 87.3 | globlastp |
| 1980 | LYD167 | arabidopsis_lyrata\|09v1\|JGIAL010903_P1 | 5776 | 611 | 87.2 | globlastp |
| 1981 | LYD173 | b_rapa\|gb162\|L46564_P1 | 5777 | 613 | 99.5 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 1982 | LYD173 | canola\|10v1\|H07553_P1 | 5777 | 613 | 99.5 | globlastp |
| 1983 | LYD173 | canola\|gb161\|H07553_P1 | 5777 | 613 | 99.5 | globlastp |
| 1984 | LYD173 | b_oleracea\|gb161\|AM386159_P1 | 5778 | 613 | 99.1 | globlastp |
| 1985 | LYD173 | canola\|10v1\|CD818135_P1 | 5778 | 613 | 99.1 | globlastp |
| 1986 | LYD173 | canola\|gb161\|CD818135_P1 | 5778 | 613 | 99.1 | globlastp |
| 1987 | LYD173 | b_juncea\|gb164\|EVGN00193213831087_P1 | 5779 | 613 | 98.1 | globlastp |
| 1988 | LYD173 | b_juncea\|10v2\|E6ANDIZ01A2QZJ_P1 | 5780 | 613 | 96.7 | globlastp |
| 1989 | LYD173 | radish\|gb164\|EV526485_P1 | 5781 | 613 | 96.7 | globlastp |
| 1990 | LYD173 | radish\|gb164\|EX757513_P1 | 5782 | 613 | 96.7 | globlastp |
| 1991 | LYD173 | radish\|gb164\|EV537108_P1 | 5783 | 613 | 94.8 | globlastp |
| 1992 | LYD173 | radish\|gb164\|EX905183_P1 | 5784 | 613 | 94.8 | globlastp |
| 1993 | LYD173 | radish\|gb164\|EV546803_P1 | 5785 | 613 | 94.4 | globlastp |
| 1994 | LYD173 | radish\|gb164\|EY902155_T1 | 5786 | 613 | 94.37 | glotblastn |
| 1995 | LYD173 | b_juncea\|10v2\|E6ANDIZ01A0NM0_T1 | 5787 | 613 | 87.85 | glotblastn |
| 1996 | LYD173 | thellungiella\|gb167\|DN773341_P1 | 5788 | 613 | 85 | globlastp |
| 1997 | LYD173 | arabidopsis\|10v1\|AT1G19570_P1 | 5789 | 613 | 84 | globlastp |
| 1998 | LYD173 | arabidopsis\|gb165\|AT1G19570_P1 | 5789 | 613 | 84 | globlastp |
| 1999 | LYD173 | b_juncea\|10v2\|E6ANDIZ01A566R_P1 | 5790 | 613 | 83.6 | globlastp |
| 2000 | LYD173 | radish\|gb164\|EX747007_P1 | 5791 | 613 | 82.2 | globlastp |
| 2001 | LYD173 | radish\|gb164\|EW725652_P1 | 5792 | 613 | 81.7 | globlastp |
| 2002 | LYD173 | radish\|gb164\|EV534906_P1 | 5793 | 613 | 81.2 | globlastp |
| 2003 | LYD173 | arabidopsis_lyrata\|09v1\|JGIAL002059_T1 | 5794 | 613 | 80.75 | glotblastn |
| 2004 | LYD173 | arabidopsis_lyrata\|09v1\|JGIAL007795_P1 | 5795 | 613 | 80.3 | globlastp |
| 2005 | LYD173 | cleome_gynandra\|10v1\|SRR015532S0012442_P1 | 5796 | 613 | 80.3 | globlastp |
| 2006 | LYD174 | canola\|10v1\|CD813876_P1 | 5797 | 614 | 99.8 | globlastp |
| 2007 | LYD174 | canola\|gb161\|CD813876_P1 | 5797 | 614 | 99.8 | globlastp |
| 2008 | LYD174 | b_oleracea\|gb161\|AY065840_P1 | 5798 | 614 | 99.2 | globlastp |
| 2009 | LYD174 | radish\|gb164\|EW714178_P1 | 5799 | 614 | 97.6 | globlastp |
| 2010 | LYD174 | canola\|10v1\|CD815711_P1 | 5800 | 614 | 97 | globlastp |
| 2011 | LYD174 | arabidopsis\|gb165\|AT1G22710_P1 | 5801 | 614 | 94.5 | globlastp |
| 2011 | LYD174 | arabidopsis\|10v1\|AT1G22710_P1 | 5803 | 614 | 93.6 | globlastp |
| 2012 | LYD174 | canola\|gb161\|CD825116_P1 | 5802 | 614 | 94 | globlastp |
| 2013 | LYD174 | arabidopsis_lyrata\|09v1\|JGIAL002431_P1 | 5804 | 614 | 93.2 | globlastp |
| 2014 | LYD174 | canola\|10v1\|DW998857_P1 | 5805 | 614 | 81.1 | globlastp |
| 2015 | LYD176 | canola\|10v1\|BQ704660_P1 | 5806 | 615 | 92.9 | globlastp |
| 2016 | LYD176 | canola\|gb161\|CX187649_P1 | 5806 | 615 | 92.9 | globlastp |
| 2017 | LYD176 | b_rapa\|gb162\|BG543075_P1 | 5807 | 615 | 91.8 | globlastp |
| 2018 | LYD176 | canola\|10v1\|CN727120_P1 | 5808 | 615 | 91.3 | globlastp |
| 2019 | LYD176 | canola\|gb161\|CN727120_P1 | 5808 | 615 | 91.3 | globlastp |
| 2020 | LYD176 | maize\|gb170\|LLDQ245199_P1 | 5808 | 615 | 91.3 | globlastp |
| 2021 | LYD176 | b_oleracea\|gb161\|X94979_P1 | 5809 | 615 | 91 | globlastp |
| 2022 | LYD176 | b_nigra\|09v1\|GT069756_P1 | 5810 | 615 | 87.9 | globlastp |
| 2023 | LYD176 | b_juncea\|gb164\|EVGN01144714190893_P1 | 5811 | 615 | 87.1 | globlastp |
| 2024 | LYD176 | b_oleracea\|gb161\|AM386451_P1 | 5812 | 615 | 87 | globlastp |
| 2025 | LYD176 | b_rapa\|gb162\|CV544363_P1 | 5813 | 615 | 87 | globlastp |
| 2026 | LYD176 | canola\|10v1\|EG021017_P1 | 5813 | 615 | 87 | globlastp |
| 2027 | LYD176 | canola\|gb161\|EG021017_P1 | 5813 | 615 | 87 | globlastp |
| 2028 | LYD176 | b_juncea\|10v2\|E6ANDIZ01AKW0S_P1 | 5814 | 615 | 86.5 | globlastp |
| 2029 | LYD176 | canola\|10v1\|CN729310_P1 | 5815 | 615 | 86 | globlastp |
| 2030 | LYD176 | canola\|gb161\|CN729310_P1 | 5815 | 615 | 86 | globlastp |
| 2031 | LYD176 | radish\|gb164\|EV524460_P1 | 5816 | 615 | 85.9 | globlastp |
| 2032 | LYD176 | thellungiella\|gb167\|DN773090_P1 | 5817 | 615 | 84.8 | globlastp |
| 2033 | LYD176 | b_rapa\|gb162\|L47867_P1 | 5818 | 615 | 84.4 | globlastp |
| 2034 | LYD176 | canola\|10v1\|DY018032_P1 | 5818 | 615 | 84.4 | globlastp |
| 2035 | LYD176 | canola\|gb161\|DY018032_P1 | 5818 | 615 | 84.4 | globlastp |
| 2036 | LYD176 | b_juncea\|10v2\|E6ANDIZ01A94EP_P1 | 5819 | 615 | 84.2 | globlastp |
| 2037 | LYD176 | b_juncea\|gb164\|EVGN00344614610857_P1 | 5819 | 615 | 84.2 | globlastp |
| 2038 | LYD176 | b_juncea\|10v2\|E6ANDIZ01A1KFY1_P1 | 5820 | 615 | 83.6 | globlastp |
| 2039 | LYD176 | radish\|gb164\|EW726459_T1 | 5821 | 615 | 83.41 | glotblastn |
| 2040 | LYD176 | radish\|gb164\|EX771849_P1 | 5822 | 615 | 83.4 | globlastp |
| 2041 | LYD176 | radish\|gb164\|EV535313_P1 | 5823 | 615 | 82.5 | globlastp |
| 2042 | LYD176 | canola\|10v1\|H74597_T1 | 5824 | 615 | 82.41 | glotblastn |
| 2043 | LYD176 | canola\|gb161\|H74597_T1 | 5824 | 615 | 82.41 | glotblastn |
| 2044 | LYD176 | canola\|gb161\|EV176190_T1 | 5825 | 615 | 82.14 | glotblastn |
| 2045 | LYD177 | b_rapa\|gb162\|CV546358_P1 | 5826 | 616 | 99 | globlastp |
| 2046 | LYD177 | canola\|gb161\|EE462120_P1 | 5827 | 616 | 99 | globlastp |
| 2047 | LYD177 | canola\|10v1\|CX190522_P1 | 5828 | 616 | 95.9 | globlastp |
| 2048 | LYD177 | canola\|10v1\|EE462120_P1 | 5828 | 616 | 95.9 | globlastp |
| 2049 | LYD177 | canola\|gb161\|CX190522_P1 | 5828 | 616 | 95.9 | globlastp |
| 2050 | LYD177 | maize\|gb170\|LLDQ244995_P1 | 5828 | 616 | 95.9 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2051 | LYD177 | b_oleracea\|gb161\|AM057577_P1 | 5829 | 616 | 94.8 | globlastp |
| 2052 | LYD177 | b_juncea\|gb164\|EVGN00065426350167_P1 | 5830 | 616 | 93.8 | globlastp |
| 2053 | LYD177 | radish\|gb164\|EV538277_P1 | 5831 | 616 | 93.8 | globlastp |
| 2054 | LYD177 | b_juncea\|10v2\|E6ANDIZ01A9K6V_P1 | 5832 | 616 | 92.8 | globlastp |
| 2055 | LYD177 | b_juncea\|gb164\|EVGN00369325751180_P1 | 5833 | 616 | 90.7 | globlastp |
| 2056 | LYD177 | b_juncea\|10v2\|E6ANDIZ01A42M6_P1 | 5834 | 616 | 84.5 | globlastp |
| 2057 | LYD178 | maize\|gb170\|LLDQ245347_P1 | 5835 | 617 | 99.3 | globlastp |
| 2058 | LYD178 | canola\|10v1\|CN728812_P1 | 5836 | 617 | 92 | globlastp |
| 2059 | LYD178 | b_rapa\|gb162\|EX058232_P1 | 5837 | 617 | 90.9 | globlastp |
| 2060 | LYD178 | canola\|gb161\|CN728812_P1 | 5838 | 617 | 89.3 | globlastp |
| 2061 | LYD178 | canola\|gb161\|CN729053_P1 | 5839 | 617 | 86.8 | globlastp |
| 2062 | LYD178 | b_juncea\|gb164\|EVGN01602408322025_T1 | 5840 | 617 | 84.11 | glotblastn |
| 2063 | LYD178 | b_rapa\|gb162\|BG543037_T1 | 5841 | 617 | 84.11 | glotblastn |
| 2064 | LYD178 | canola\|gb161\|H07680_T1 | 5842 | 617 | 84.11 | glotblastn |
| 2065 | LYD178 | b_juncea\|10v2\|OXBJ1SLX00002305D1T1_P1 | 5843 | 617 | 84.1 | globlastp |
| 2066 | LYD178 | b_oleracea\|gb161\|EH415446_P1 | 5844 | 617 | 84.1 | globlastp |
| 2067 | LYD178 | radish\|gb164\|EV539169_T1 | 5845 | 617 | 84 | glotblastn |
| 2068 | LYD178 | radish\|gb164\|EV528495_P1 | 5846 | 617 | 82.8 | globlastp |
| 2069 | LYD178 | radish\|gb164\|EV536377_P1 | 5847 | 617 | 82.8 | globlastp |
| 2070 | LYD178 | b_oleracea\|gb161\|EH425722_T1 | 5848 | 617 | 80.67 | glotblastn |
| 2071 | LYD178 | canola\|gb161\|CD812131_T1 | 5849 | 617 | 80.13 | glotblastn |
| 2072 | LYD178 | radish\|gb164\|EX764872_T1 | 5850 | 617 | 80.13 | glotblastn |
| 2073 | LYD178 | canola\|10v1\|H07680_P1 | 5851 | 617 | 80.1 | globlastp |
| 2074 | LYD180 | canola\|10v1\|CB686396_P1 | 5852 | 618 | 99.4 | globlastp |
| 2075 | LYD180 | b_rapa\|gb162\|DN961358_P1 | 5853 | 618 | 99.4 | globlastp |
| 2076 | LYD180 | canola\|gb161\|CB686396_P1 | 5852 | 618 | 99.4 | globlastp |
| 2077 | LYD180 | b_juncea\|gb164\|EVGN00529314222143_P1 | 5854 | 618 | 97 | globlastp |
| 2078 | LYD180 | b_oleracea\|gb161\|AM388617_P1 | 5854 | 618 | 97 | globlastp |
| 2079 | LYD180 | canola\|10v1\|CD815087_P1 | 5854 | 618 | 97 | globlastp |
| 2080 | LYD180 | canola\|gb161\|CD815087_P1 | 5854 | 618 | 97 | globlastp |
| 2081 | LYD180 | maize\|gb170\|LLDQ246015_P1 | 5854 | 618 | 97 | globlastp |
| 2082 | LYD180 | canola\|10v1\|DY016051_P1 | 5855 | 618 | 96 | globlastp |
| 2083 | LYD180 | b_juncea\|10v2\|E6ANDIZ01A2BHS_P1 | 5856 | 618 | 94.7 | globlastp |
| 2084 | LYD180 | b_juncea\|10v2\|E6ANDIZ01AINAF_P1 | 5857 | 618 | 94.7 | globlastp |
| 2085 | LYD180 | b_juncea\|10v2\|E6ANDIZ01AY5KE_P1 | 5858 | 618 | 93.5 | globlastp |
| 2086 | LYD180 | radish\|gb164\|EV526021_P1 | 5859 | 618 | 93.5 | globlastp |
| 2087 | LYD180 | radish\|gb164\|EV565725_P1 | 5859 | 618 | 93.5 | globlastp |
| 2088 | LYD180 | radish\|gb164\|EV535131_P1 | 5860 | 618 | 92.9 | globlastp |
| 2089 | LYD180 | radish\|gb164\|FD538226_P1 | 5861 | 618 | 92.9 | globlastp |
| 2090 | LYD180 | b_nigra\|09v1\|GT069546_P1 | 5862 | 618 | 90.5 | globlastp |
| 2091 | LYD180 | thellungiella\|gb167\|BM985957_P1 | 5863 | 618 | 86.9 | globlastp |
| 2092 | LYD180 | b_juncea\|10v2\|E6ANDIZ01A4TK8_P1 | 5864 | 618 | 86.6 | globlastp |
| 2093 | LYD180 | b_rapa\|gb162\|EX017672_P1 | 5865 | 618 | 84.8 | globlastp |
| 2094 | LYD180 | canola\|gb161\|DY030344_P1 | 5865 | 618 | 84.8 | globlastp |
| 2095 | LYD180 | radish\|gb164\|EV572930_P1 | 5866 | 618 | 83.4 | globlastp |
| 2096 | LYD180 | arabidopsis\|10v1\|AT1G09310_P1 | 5867 | 618 | 82.8 | globlastp |
| 2097 | LYD180 | radish\|gb164\|EW734914_P1 | 5868 | 618 | 82.8 | globlastp |
| 2098 | LYD180 | arabidopsis_lyrata\|09v1\|JGIAL000898_P1 | 5869 | 618 | 82.3 | globlastp |
| 2099 | LYD180 | radish\|gb164\|EV535701_T1 | 5870 | 618 | 82.25 | glotblastn |
| 2100 | LYD180 | canola\|10v1\|DY030344_P1 | 5871 | 618 | 82.1 | globlastp |
| 2101 | LYD180 | radish\|gb164\|EW735869_P1 | 5872 | 618 | 82.1 | globlastp |
| 2102 | LYD180 | radish\|gb164\|EV539268_P1 | 5873 | 618 | 81.5 | globlastp |
| 2103 | LYD180 | radish\|gb164\|EV547459_P1 | 5874 | 618 | 81.5 | globlastp |
| 2104 | LYD180 | radish\|gb164\|EV569517_P1 | 5875 | 618 | 81.5 | globlastp |
| 2105 | LYD180 | radish\|gb164\|EV528599_P1 | 5876 | 618 | 80.4 | globlastp |
| 2106 | LYD184 | canola\|10v1\|EV128279_P1 | 5877 | 619 | 98.9 | globlastp |
| 2107 | LYD184 | b_rapa\|gb162\|EX072399_P1 | 5877 | 619 | 98.9 | globlastp |
| 2108 | LYD184 | canola\|gb161\|EV128279_P1 | 5877 | 619 | 98.9 | globlastp |
| 2109 | LYD184 | canola\|10v1\|EE427730_P1 | 5878 | 619 | 97.8 | globlastp |
| 2110 | LYD184 | canola\|gb161\|EE427730_P1 | 5878 | 619 | 97.8 | globlastp |
| 2111 | LYD184 | b_juncea\|10v2\|E6ANDIZ01A5CK0_P1 | 5879 | 619 | 93.3 | globlastp |
| 2112 | LYD184 | b_juncea\|gb164\|EVGN00911914081701_P1 | 5880 | 619 | 93.3 | globlastp |
| 2113 | LYD184 | radish\|gb164\|EX890482_P1 | 5881 | 619 | 90.5 | globlastp |
| 2114 | LYD184 | b_juncea\|10v2\|E6ANDIZ01A2PDG_P1 | 5882 | 619 | 89.4 | globlastp |
| 2115 | LYD184 | b_juncea\|gb164\|EVGN01169814532136_P1 | 5883 | 619 | 88.3 | globlastp |
| 2116 | LYD184 | canola\|10v1\|DY000970_P1 | 5884 | 619 | 86.7 | globlastp |
| 2117 | LYD184 | b_rapa\|gb162\|L38150_P1 | 5885 | 619 | 86.1 | globlastp |
| 2118 | LYD184 | canola\|gb161\|DY000970_P1 | 5886 | 619 | 86.1 | globlastp |
| 2119 | LYD184 | radish\|gb164\|EV538405_P1 | 5887 | 619 | 86 | globlastp |
| 2120 | LYD184 | b_juncea\|10v2\|E6ANDIZ01A05Y0_P1 | 5888 | 619 | 85.6 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2121 | LYD184 | radish\|gb164\|EX749350_T1 | 5889 | 619 | 84.92 | glotblastn |
| 2122 | LYD184 | b_juncea\|10v2\|E6ANDIZ01AMLKU_P1 | 5890 | 619 | 84.9 | globlastp |
| 2123 | LYD185 | b_rapa\|gb162\|L33587_P1 | 5891 | 620 | 96.9 | globlastp |
| 2124 | LYD185 | canola\|10v1\|CX192408_P1 | 5892 | 620 | 96.2 | globlastp |
| 2125 | LYD185 | canola\|gb161\|CX192408_P1 | 5893 | 620 | 94.7 | globlastp |
| 2126 | LYD185 | canola\|gb161\|CX191335_P1 | 5894 | 620 | 87.9 | globlastp |
| 2127 | LYD185 | canola\|10v1\|H74507_P1 | 5895 | 620 | 86.2 | globlastp |
| 2128 | LYD185 | canola\|10v1\|CX191541_P1 | 5896 | 620 | 86 | globlastp |
| 2129 | LYD185 | thellungiella\|gb167\|DN778269_P1 | 5897 | 620 | 81.7 | globlastp |
| 2130 | LYD185 | canola\|gb161\|CD837602_P1 | 5898 | 620 | 81.6 | globlastp |
| 2131 | LYD185 | arabidopsis_lyrata\|09v1\|JGIAL002946_P1 | 5899 | 620 | 80.8 | globlastp |
| 2132 | LYD186 | thellungiella\|gb167\|BY806015_P1 | 5900 | 621 | 94.1 | globlastp |
| 2133 | LYD186 | arabidopsis\|10v1\|AT1G56700_P1 | 5901 | 621 | 93.2 | globlastp |
| 2134 | LYD186 | arabidopsis_lyrata\|09v1\|JGIAL005325_T1 | 5902 | 621 | 90.91 | glotblastn |
| 2135 | LYD186 | cleome_gynandra\|10v1\|SRR015532S0000444_T1 | 5903 | 621 | 80 | globlastp |
| 2136 | LYD187 | b_oleracea\|gb161\|AM388405_P1 | 5904 | 622 | 97.4 | globlastp |
| 2137 | LYD187 | canola\|gb161\|CX190300_P1 | 5904 | 622 | 97.4 | globlastp |
| 2138 | LYD187 | radish\|gb164\|EV536333_P1 | 5905 | 622 | 97.4 | globlastp |
| 2139 | LYD187 | radish\|gb164\|EV550518_P1 | 5906 | 622 | 97.4 | globlastp |
| 2140 | LYD187 | canola\|10v1\|CB686142_P1 | 5904 | 622 | 97.4 | globlastp |
| 2141 | LYD187 | b_oleracea\|gb161\|DY027529_P1 | 5907 | 622 | 97 | globlastp |
| 2142 | LYD187 | b_rapa\|gb162\|BG543670_P1 | 5908 | 622 | 97 | globlastp |
| 2143 | LYD187 | canola\|gb161\|CB686142_P1 | 5908 | 622 | 97 | globlastp |
| 2144 | LYD187 | b_juncea\|10v2\|E6ANDIZ01BJ4IL_P1 | 5909 | 622 | 96.6 | globlastp |
| 2145 | LYD187 | canola\|10v1\|BQ704355_P1 | 5910 | 622 | 96.6 | globlastp |
| 2146 | LYD187 | radish\|gb164\|EV527800_P1 | 5911 | 622 | 96.6 | globlastp |
| 2147 | LYD187 | b_juncea\|gb164\|EVGN00228415001818_P1 | 5912 | 622 | 96.2 | globlastp |
| 2148 | LYD187 | b_rapa\|gb162\|CA991704_P1 | 5912 | 622 | 96.2 | globlastp |
| 2149 | LYD187 | canola\|10v1\|H07333_P1 | 5912 | 622 | 96.2 | globlastp |
| 2150 | LYD187 | canola\|gb161\|AI352825_P1 | 5912 | 622 | 96.2 | globlastp |
| 2151 | LYD187 | canola\|gb161\|BQ704355_P1 | 5913 | 622 | 96.2 | globlastp |
| 2152 | LYD187 | canola\|gb161\|DW998915_P1 | 5912 | 622 | 96.2 | globlastp |
| 2153 | LYD187 | b_oleracea\|gb161\|DY026491_P1 | 5914 | 622 | 95.8 | globlastp |
| 2154 | LYD187 | arabidopsis_lyrata\|09v1\|BQ834357_P1 | 5915 | 622 | 95.3 | globlastp |
| 2155 | LYD187 | b_juncea\|10v2\|E6ANDIZ01A4TV8_P1 | 5916 | 622 | 95.3 | globlastp |
| 2156 | LYD187 | b_juncea\|10v2\|E7FJ1I304DWYFK1_T1 | 5917 | 622 | 94.87 | glotblastn |
| 2157 | LYD187 | arabidopsis\|10v1\|AT5G19140_P1 | 5918 | 622 | 94.4 | globlastp |
| 2158 | LYD187 | thellungiella\|gb167\|BM985860_P1 | 5919 | 622 | 92.3 | globlastp |
| 2159 | LYD187 | radish\|gb164\|EX747604_P1 | 5920 | 622 | 91.5 | globlastp |
| 2160 | LYD187 | b_juncea\|10v2\|E6ANDIZ01A2LN8_P1 | 5921 | 622 | 89 | globlastp |
| 2161 | LYD187 | canola\|gb161\|BQ705035_P1 | 5922 | 622 | 88.5 | globlastp |
| 2162 | LYD187 | cleome_spinosa\|10v1\|GR934264_P1 | 5923 | 622 | 83.5 | globlastp |
| 2163 | LYD187 | cleome_gynandra\|10v1\|SRR015532S0000079_P1 | 5924 | 622 | 83.1 | globlastp |
| 2164 | LYD187 | poppy\|gb166\|FG605794_P1 | 5925 | 622 | 81.8 | globlastp |
| 2165 | LYD187 | prunus\|10v1\|BF717221_P1 | 5926 | 622 | 81.4 | globlastp |
| 2166 | LYD187 | prunus\|gb167\|BF717221_P1 | 5926 | 622 | 81.4 | globlastp |
| 2167 | LYD187 | chestnut\|gb170\|SRR006295S0001356_P1 | 5927 | 622 | 80.9 | globlastp |
| 2168 | LYD187 | liquorice\|gb171\|FS239166_P1 | 5928 | 622 | 80.9 | globlastp |
| 2169 | LYD187 | walnuts\|gb166\|CB303568_P1 | 5929 | 622 | 80.9 | globlastp |
| 2170 | LYD187 | walnuts\|gb166\|CV195685_P1 | 5930 | 622 | 80.9 | globlastp |
| 2171 | LYD187 | nasturtium\|10v1\|GH162655_P1 | 5931 | 622 | 80.5 | globlastp |
| 2172 | LYD187 | apple\|gb171\|CN489391_P1 | 5932 | 622 | 80.5 | globlastp |
| 2173 | LYD187 | citrus\|gb166\|BE208893_P1 | 5933 | 622 | 80.5 | globlastp |
| 2174 | LYD187 | cotton\|gb164\|AI054521_P1 | 5934 | 622 | 80.5 | globlastp |
| 2175 | LYD187 | oak\|10v1\|DB997378_T1 | 5935 | 622 | 80.34 | glotblastn |
| 2176 | LYD187 | oak\|10v1\|FN697150_T1 | 5935 | 622 | 80.34 | glotblastn |
| 2177 | LYD187 | oak\|10v1\|FN698586_T1 | 5935 | 622 | 80.34 | glotblastn |
| 2178 | LYD187 | oak\|10v1\|FN699485_T1 | 5935 | 622 | 80.34 | glotblastn |
| 2179 | LYD187 | oak\|10v1\|FN710897_T1 | 5935 | 622 | 80.34 | glotblastn |
| 2180 | LYD187 | oak\|10v1\|FN715237_T1 | 5935 | 622 | 80.34 | glotblastn |
| 2181 | LYD187 | oak\|10v1\|FN755290_T1 | 5935 | 622 | 80.34 | glotblastn |
| 2182 | LYD187 | oak\|10v1\|FP051976_T1 | 5935 | 622 | 80.34 | glotblastn |
| 2183 | LYD187 | oak\|10v1\|FP056365_T1 | 5935 | 622 | 80.34 | glotblastn |
| 2184 | LYD187 | oak\|10v1\|SRR006307S0013969_T1 | 5935 | 622 | 80.34 | glotblastn |
| 2185 | LYD187 | oak\|10v1\|SRR006307S0041858_T1 | 5936 | 622 | 80.34 | glotblastn |
| 2186 | LYD187 | oak\|10v1\|SRR006310S0001406_T1 | 5935 | 622 | 80.34 | glotblastn |
| 2187 | LYD187 | oak\|10v1\|SRR039734S0072419_T1 | 5937 | 622 | 80.34 | glotblastn |
| 2188 | LYD187 | oak\|10v1\|SRR039739S0033686_T1 | 5935 | 622 | 80.34 | glotblastn |
| 2189 | LYD187 | oak\|10v1\|SRR039740S0005760_T1 | 5938 | 622 | 80.34 | glotblastn |
| 2190 | LYD187 | clover\|gb162\|BB904019_T1 | 5939 | 622 | 80.34 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2191 | LYD187 | kiwi\|gb166\|FG405871_T1 | 5940 | 622 | 80.34 | glotblastn |
| 2192 | LYD187 | radish\|gb164\|EV542281_P1 | 5941 | 622 | 80.3 | globlastp |
| 2193 | LYD187 | nasturtium\|10v1\|GH168619_P1 | 5942 | 622 | 80.1 | globlastp |
| 2194 | LYD187 | oak\|10v1\|FP041304_P1 | 5943 | 622 | 80.1 | globlastp |
| 2195 | LYD187 | apple\|gb171\|CN865201_P1 | 5944 | 622 | 80.1 | globlastp |
| 2196 | LYD187 | cotton\|10v1\|AI054521_P1 | 5945 | 622 | 80.1 | globlastp |
| 2197 | LYD187 | oak\|gb170\|DB997378_P1 | 5946 | 622 | 80.1 | globlastp |
| 2198 | LYD187 | soybean\|gb168\|AI967327_P1 | 5947 | 622 | 80.1 | globlastp |
| 2199 | LYD187 | soybean\|gb168\|AW329810_P1 | 5948 | 622 | 80.1 | globlastp |
| 2200 | LYD187 | soybean\|gb168\|AW348574_P1 | 5949 | 622 | 80.1 | globlastp |
| 2201 | LYD188 | b_juncea\|10v2\|E6ANDIZ01BEAXG_P1 | 5950 | 623 | 87.5 | globlastp |
| 2202 | LYD190 | arabidopsis_lyrata\|09v1\|JGIAL000673_P1 | 5951 | 624 | 87.3 | globlastp |
| 2203 | LYD190 | arabidopsis\|10v1\|AT1G07140_P1 | 5952 | 624 | 86.9 | globlastp |
| 2204 | LYD190 | arabidopsis\|gb165\|AT1G07140_P1 | 5952 | 624 | 86.9 | globlastp |
| 2205 | LYD190 | canola\|gb161\|CN729032_T1 | 5953 | 624 | 83.56 | glotblastn |
| 2206 | LYD190 | canola\|10v1\|FG564672_P1 | 5954 | 624 | 83.1 | globlastp |
| 2207 | LYD190 | cleome_spinosa\|10v1\|GR931255_P1 | 5955 | 624 | 81 | globlastp |
| 2208 | LYD193 | canola\|10v1\|CD819193_P1 | 5956 | 626 | 97.9 | globlastp |
| 2209 | LYD193 | canola\|10v1\|CN828571_P1 | 5956 | 626 | 97.9 | globlastp |
| 2210 | LYD193 | canola\|10v1\|CX189824_P1 | 5956 | 626 | 97.9 | globlastp |
| 2211 | LYD193 | canola\|gb161\|CD819193_P1 | 5956 | 626 | 97.9 | globlastp |
| 2212 | LYD193 | b_oleracea\|gb161\|AM385352_P1 | 5957 | 626 | 97.5 | globlastp |
| 2213 | LYD193 | b_juncea\|10v2\|E6ANDIZ01A1JPM_P1 | 5958 | 626 | 88.3 | globlastp |
| 2214 | LYD193 | b_oleracea\|gb161\|AM388770_P1 | 5959 | 626 | 86.2 | globlastp |
| 2215 | LYD193 | canola\|10v1\|EE475907_P1 | 5960 | 626 | 86.2 | globlastp |
| 2216 | LYD193 | canola\|gb161\|EE475907_P1 | 5961 | 626 | 83.7 | globlastp |
| 2217 | LYD193 | arabidopsis\|10v1\|AT4G20260_P1 | 5962 | 626 | 82.7 | globlastp |
| 2218 | LYD193 | arabidopsis\|gb165\|AT4G20260_P1 | 5962 | 626 | 82.7 | globlastp |
| 2219 | LYD193 | arabidopsis_lyrata\|09v1\|JGIAL026112_P1 | 5963 | 626 | 81.4 | globlastp |
| 2220 | LYD194 | canola\|10v1\|CD812567_P1 | 627 | 627 | 100 | globlastp |
| 2221 | LYD194 | canola\|10v1\|CN732445_P1 | 627 | 627 | 100 | globlastp |
| 2222 | LYD194 | b_oleracea\|gb161\|AM394359_P1 | 627 | 627 | 100 | globlastp |
| 2223 | LYD194 | canola\|gb161\|CD812567_P1 | 627 | 627 | 100 | globlastp |
| 2224 | LYD194 | canola\|gb161\|CN732445_P1 | 627 | 627 | 100 | globlastp |
| 2225 | LYD194 | b_juncea\|10v2\|E6ANDIZ01A562G_P1 | 5964 | 627 | 98.7 | globlastp |
| 2226 | LYD194 | b_juncea\|10v2\|E6ANDIZ01ETA4O_P1 | 5964 | 627 | 98.7 | globlastp |
| 2227 | LYD194 | b_juncea\|10v2\|E6ANDIZ01AQJZN_P1 | 5964 | 627 | 98.7 | globlastp |
| 2228 | LYD194 | b_juncea\|gb164\|EVGN00414408181524_P1 | 5964 | 627 | 98.7 | globlastp |
| 2229 | LYD194 | b_juncea\|10v2\|BJ1SLX00017689D2_P1 | 5964 | 627 | 98.7 | globlastp |
| 2230 | LYD194 | b_oleracea\|gb161\|AM057515_P1 | 5964 | 627 | 98.7 | globlastp |
| 2231 | LYD194 | b_rapa\|gb162\|CO749437_P1 | 5964 | 627 | 98.7 | globlastp |
| 2232 | LYD194 | b_rapa\|gb162\|EE526209_P1 | 5965 | 627 | 98.7 | globlastp |
| 2233 | LYD194 | canola\|10v1\|CD812518_P1 | 5964 | 627 | 98.7 | globlastp |
| 2234 | LYD194 | canola\|gb161\|CD812518_P1 | 5964 | 627 | 98.7 | globlastp |
| 2235 | LYD194 | canola\|10v1\|DY001783_P1 | 5964 | 627 | 98.7 | globlastp |
| 2236 | LYD194 | canola\|gb161\|DY001783_P1 | 5964 | 627 | 98.7 | globlastp |
| 2237 | LYD194 | canola\|10v1\|H74432_P1 | 5964 | 627 | 98.7 | globlastp |
| 2238 | LYD194 | thellungiella\|gb167\|BM985987_P1 | 5964 | 627 | 98.7 | globlastp |
| 2239 | LYD194 | radish\|gb164\|EV524387_P1 | 5966 | 627 | 97.4 | globlastp |
| 2240 | LYD194 | dandelion\|10v1\|DY803351_P1 | 5967 | 627 | 94.9 | globlastp |
| 2241 | LYD194 | dandelion\|gb161\|DY803351_P1 | 5967 | 627 | 94.9 | globlastp |
| 2242 | LYD194 | dandelion\|10v1\|DY825659_P1 | 5968 | 627 | 94.9 | globlastp |
| 2243 | LYD194 | gerbera\|09v1\|AJ751548_P1 | 5969 | 627 | 94.9 | globlastp |
| 2244 | LYD194 | safflower\|gb162\|EL511059_P1 | 5968 | 627 | 94.9 | globlastp |
| 2245 | LYD194 | sunflower\|gb162\|CD849312_P1 | 5968 | 627 | 94.9 | globlastp |
| 2246 | LYD194 | sunflower\|gb162\|DY937622_P1 | 5967 | 627 | 94.9 | globlastp |
| 2247 | LYD194 | sunflower\|10v1\|SFSLX00059942D2_P1 | 5968 | 627 | 94.9 | globlastp |
| 2248 | LYD194 | sunflower\|gb162\|DY953791_P1 | 5968 | 627 | 94.9 | globlastp |
| 2249 | LYD194 | sunflower\|10v1\|OXSFSLX00055287D2T1_P1 | 5968 | 627 | 94.9 | globlastp |
| 2250 | LYD194 | tragopogon\|10v1\|SRR020205S0005820_P1 | 5970 | 627 | 93.6 | globlastp |
| 2251 | LYD194 | arabidopsis\|10v1\|AT2G23090_P1 | 5971 | 627 | 93.6 | globlastp |
| 2252 | LYD194 | lettuce\|gb157.2\|DW043603_P1 | 5972 | 627 | 93.6 | globlastp |
| 2253 | LYD194 | lettuce\|10v1\|DW075022_P1 | 5972 | 627 | 93.6 | globlastp |
| 2254 | LYD194 | lettuce\|gb157.2\|DW075022_P1 | 5972 | 627 | 93.6 | globlastp |
| 2255 | LYD194 | lettuce\|gb157.2\|DW103809_P1 | 5972 | 627 | 93.6 | globlastp |
| 2256 | LYD194 | lettuce\|10v1\|DW147737_P1 | 5972 | 627 | 93.6 | globlastp |
| 2257 | LYD194 | lettuce\|gb157.2\|DW147737_P1 | 5972 | 627 | 93.6 | globlastp |
| 2258 | LYD194 | lettuce\|10v1\|DW043603_P1 | 5972 | 627 | 93.6 | globlastp |
| 2259 | LYD194 | cichorium\|gb171\|DT210820_T1 | 5973 | 627 | 92.31 | glotblastn |
| 2260 | LYD194 | arabidopsis_lyrata\|09v1\|BQ834396_P1 | 5974 | 627 | 92.3 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2261 | LYD194 | gerbera\|09v1\|AJ750006_P1 | 5975 | 627 | 92.3 | globlastp |
| 2262 | LYD194 | artemisia\|gb164\|EY036549_P1 | 5976 | 627 | 91 | globlastp |
| 2263 | LYD194 | sunflower\|gb162\|CD849585_P1 | 5977 | 627 | 91 | globlastp |
| 2264 | LYD194 | sunflower\|10v1\|SFSLX00132901D2_P1 | 5977 | 627 | 91 | globlastp |
| 2265 | LYD194 | sunflower\|gb162\|DY948679_P1 | 5977 | 627 | 91 | globlastp |
| 2266 | LYD194 | sunflower\|gb162\|DY954159_P1 | 5977 | 627 | 91 | globlastp |
| 2267 | LYD194 | sunflower\|10v1\|DY937622_P1 | 5978 | 627 | 89.7 | globlastp |
| 2268 | LYD194 | centaurea\|gb166\|EH747727_P1 | 5979 | 627 | 89.7 | globlastp |
| 2269 | LYD194 | cotton\|gb164\|DT049285_P1 | 5980 | 627 | 89.7 | globlastp |
| 2270 | LYD194 | cotton\|10v1\|BF277062_P1 | 5980 | 627 | 89.7 | globlastp |
| 2271 | LYD194 | ipomoea_nil\|10v1\|BJ553105_P1 | 5981 | 627 | 88.5 | globlastp |
| 2272 | LYD194 | basilicum\|gb157.3\|DY323766_P1 | 5982 | 627 | 88.5 | globlastp |
| 2273 | LYD194 | cotton\|gb164\|BF277062_P1 | 5983 | 627 | 88.5 | globlastp |
| 2274 | LYD194 | iceplant\|gb164\|BE034180_P1 | 5984 | 627 | 88.5 | globlastp |
| 2275 | LYD194 | ipomoea\|gb157.2\|BJ553105_P1 | 5981 | 627 | 88.5 | globlastp |
| 2276 | LYD194 | sunflower\|10v1\|AF495716_T1 | 5985 | 627 | 88.46 | glotblastn |
| 2277 | LYD194 | cleome_spinosa\|10v1\|SRR015531S0016978_P1 | 5986 | 627 | 87.2 | globlastp |
| 2278 | LYD194 | ipomoea_batatas\|10v1\|BU690434_P1 | 5987 | 627 | 87.2 | globlastp |
| 2279 | LYD194 | nasturtium\|10v1\|GH161629_P1 | 5988 | 627 | 87.2 | globlastp |
| 2280 | LYD194 | oak\|10v1\|DN950139_P1 | 5989 | 627 | 87.2 | globlastp |
| 2281 | LYD194 | orobanche\|10v1\|SRR023495S0014225_P1 | 5990 | 627 | 87.2 | globlastp |
| 2282 | LYD194 | chestnut\|gb170\|SRR006295S0000066_P1 | 5989 | 627 | 87.2 | globlastp |
| 2283 | LYD194 | cotton\|10v1\|CO096638_P1 | 5991 | 627 | 87.2 | globlastp |
| 2284 | LYD194 | cotton\|gb164\|CO096638_P1 | 5991 | 627 | 87.2 | globlastp |
| 2285 | LYD194 | cowpea\|gb166\|FC456727_P1 | 5992 | 627 | 87.2 | globlastp |
| 2286 | LYD194 | lotus\|09v1\|AI967422_P1 | 5993 | 627 | 87.2 | globlastp |
| 2287 | LYD194 | monkeyflower\|09v1\|GR009199_P1 | 5994 | 627 | 87.2 | globlastp |
| 2288 | LYD194 | monkeyflower\|10v1\|GO960737_P1 | 5994 | 627 | 87.2 | globlastp |
| 2289 | LYD194 | oak\|gb170\|DN950139_P1 | 5989 | 627 | 87.2 | globlastp |
| 2290 | LYD194 | sunflower\|gb162\|BU019187_P1 | 5995 | 627 | 87.2 | globlastp |
| 2291 | LYD194 | tobacco\|gb162\|CV018430_P1 | 5990 | 627 | 87.2 | globlastp |
| 2292 | LYD194 | tobacco\|gb162\|EB683810_P1 | 5990 | 627 | 87.2 | globlastp |
| 2293 | LYD194 | artemisia\|10v1\|SRR019254S0578500_T1 | 5996 | 627 | 87.18 | glotblastn |
| 2294 | LYD194 | cucumber\|09v1\|AI563048_P1 | 5997 | 627 | 85.9 | globlastp |
| 2295 | LYD194 | melon\|10v1\|AM715786_P1 | 5998 | 627 | 85.9 | globlastp |
| 2296 | LYD194 | nasturtium\|10v1\|GH161507_P1 | 5999 | 627 | 85.9 | globlastp |
| 2297 | LYD194 | basilicum\|gb157.3\|DY322181_P1 | 6000 | 627 | 85.9 | globlastp |
| 2298 | LYD194 | bean\|gb167\|CA911581_T1 | 6001 | 627 | 85.9 | glotblastn |
| 2299 | LYD194 | cassava\|09v1\|DV449827_P1 | 6002 | 627 | 85.9 | globlastp |
| 2300 | LYD194 | cassava\|gb164\|DV449827_P1 | 6002 | 627 | 85.9 | globlastp |
| 2301 | LYD194 | chickpea\|09v2\|AJ012688_P1 | 6003 | 627 | 85.9 | globlastp |
| 2302 | LYD194 | kiwi\|gb166\|FG431941_P1 | 6004 | 627 | 85.9 | globlastp |
| 2303 | LYD194 | liquorice\|gb171\|FS239342_P1 | 6005 | 627 | 85.9 | globlastp |
| 2304 | LYD194 | melon\|gb165\|AM715786_P1 | 5998 | 627 | 85.9 | globlastp |
| 2305 | LYD194 | peanut\|10v1\|EE126745_P1 | 6006 | 627 | 85.9 | globlastp |
| 2306 | LYD194 | peanut\|gb171\|EE126745_P1 | 6006 | 627 | 85.9 | globlastp |
| 2307 | LYD194 | pepper\|gb171\|BM065729_P1 | 6007 | 627 | 85.9 | globlastp |
| 2308 | LYD194 | petunia\|gb171\|CV293086_P1 | 6008 | 627 | 85.9 | globlastp |
| 2309 | LYD194 | petunia\|gb171\|DY395819_P1 | 6009 | 627 | 85.9 | globlastp |
| 2310 | LYD194 | poppy\|gb166\|FE967024_P1 | 6010 | 627 | 85.9 | globlastp |
| 2311 | LYD194 | rose\|10v1\|BQ106036_P1 | 6011 | 627 | 85.9 | globlastp |
| 2312 | LYD194 | rose\|gb157.2\|BQ106036_P1 | 6011 | 627 | 85.9 | globlastp |
| 2313 | LYD194 | soybean\|gb168\|BE239639_P1 | 6012 | 627 | 85.9 | globlastp |
| 2314 | LYD194 | spruce\|gb162\|CO225902_P1 | 6013 | 627 | 85.9 | globlastp |
| 2315 | LYD194 | sunflower\|gb162\|DY958076_P1 | 6014 | 627 | 85.9 | globlastp |
| 2316 | LYD194 | triphysaria\|10v1\|DR170795_T1 | 6015 | 627 | 85.9 | glotblastn |
| 2317 | LYD194 | triphysaria\|gb164\|DR170795_T1 | 6016 | 627 | 85.9 | glotblastn |
| 2318 | LYD194 | zamia\|gb166\|DY033353_P1 | 6017 | 627 | 85.9 | globlastp |
| 2319 | LYD194 | basilicum\|10v1\|DY322181_P1 | 6000 | 627 | 85.9 | globlastp |
| 2320 | LYD194 | salvia\|10v1\|SRR014553S0006174_T1 | 6018 | 627 | 84.62 | glotblastn |
| 2321 | LYD194 | sunflower\|gb162\|CF089569_T1 | 6019 | 627 | 84.62 | glotblastn |
| 2322 | LYD194 | eggplant\|10v1\|FS001058_P1 | 6020 | 627 | 84.6 | globlastp |
| 2323 | LYD194 | eschscholzia\|10v1\|CK754622_P1 | 6021 | 627 | 84.6 | globlastp |
| 2324 | LYD194 | oak\|10v1\|DN949808_P1 | 6022 | 627 | 84.6 | globlastp |
| 2325 | LYD194 | orobanche\|10v1\|SRR023189S0001513_P1 | 6023 | 627 | 84.6 | globlastp |
| 2326 | LYD194 | pigeonpea\|10v1\|SRR054580S0170685_P1 | 6024 | 627 | 84.6 | globlastp |
| 2327 | LYD194 | salvia\|10v1\|CV165022_P1 | 6025 | 627 | 84.6 | globlastp |
| 2328 | LYD194 | salvia\|10v1\|CV170012_P1 | 6026 | 627 | 84.6 | globlastp |
| 2329 | LYD194 | canola\|gb161\|EE501998_P1 | 6027 | 627 | 84.6 | globlastp |
| 2330 | LYD194 | chestnut\|gb170\|SRR006295S0007568_P1 | 6022 | 627 | 84.6 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2331 | LYD194 | citrus\|gb166\|BQ624729_P1 | 6028 | 627 | 84.6 | globlastp |
| 2332 | LYD194 | citrus\|gb166\|CB610588_P1 | 6029 | 627 | 84.6 | globlastp |
| 2333 | LYD194 | cotton\|10v1\|DW507921_P1 | 6030 | 627 | 84.6 | globlastp |
| 2334 | LYD194 | cycas\|gb166\|CB092434_P1 | 6031 | 627 | 84.6 | globlastp |
| 2335 | LYD194 | grape\|gb160\|CA816369_P1 | 6032 | 627 | 84.6 | globlastp |
| 2336 | LYD194 | oak\|gb170\|DN949808_P1 | 6022 | 627 | 84.6 | globlastp |
| 2337 | LYD194 | poplar\|10v1\|AI166137_P1 | 6033 | 627 | 84.6 | globlastp |
| 2338 | LYD194 | poplar\|gb170\|AI166137_P1 | 6033 | 627 | 84.6 | globlastp |
| 2339 | LYD194 | poplar\|10v1\|BI125869_P1 | 6034 | 627 | 84.6 | globlastp |
| 2340 | LYD194 | poplar\|gb170\|BU815949_P1 | 6035 | 627 | 84.6 | globlastp |
| 2341 | LYD194 | poplar\|gb170\|CV243434_P1 | 6036 | 627 | 84.6 | globlastp |
| 2342 | LYD194 | potato\|10v1\|BQ117694_P1 | 6037 | 627 | 84.6 | globlastp |
| 2343 | LYD194 | potato\|gb157.2\|BQ117694_P1 | 6037 | 627 | 84.6 | globlastp |
| 2344 | LYD194 | solanum_phureja\|09v1\|SPHBG133573_P1 | 6037 | 627 | 84.6 | globlastp |
| 2345 | LYD194 | soybean\|gb168\|AW350181_P1 | 6038 | 627 | 84.6 | globlastp |
| 2346 | LYD194 | soybean\|gb168\|CA911585_P1 | 6039 | 627 | 84.6 | globlastp |
| 2347 | LYD194 | strawberry\|gb164\|CO379357_P1 | 6040 | 627 | 84.6 | globlastp |
| 2348 | LYD194 | tamarix\|gb166\|CF199285_P1 | 6041 | 627 | 84.6 | globlastp |
| 2349 | LYD194 | tomato\|09v1\|BG133573_P1 | 6042 | 627 | 84.6 | globlastp |
| 2350 | LYD194 | tomato\|gb164\|BG133573_P1 | 6043 | 627 | 84.6 | globlastp |
| 2351 | LYD194 | walnuts\|gb166\|CV196224_P1 | 6044 | 627 | 84.6 | globlastp |
| 2352 | LYD194 | sunflower\|gb162\|EL461916_P1 | 6045 | 627 | 83.5 | globlastp |
| 2353 | LYD194 | heritiera\|10v1\|SRR005795S0018549_T1 | 6046 | 627 | 83.33 | glotblastn |
| 2354 | LYD194 | cotton\|gb164\|DW507921_T1 | 6047 | 627 | 83.33 | glotblastn |
| 2355 | LYD194 | poplar\|10v1\|BU886510_T1 | 6048 | 627 | 83.33 | glotblastn |
| 2356 | LYD194 | potato\|gb157.2\|BG596893_T1 | 6049 | 627 | 83.33 | glotblastn |
| 2357 | LYD194 | canola\|10v1\|EE501998_P1 | 6050 | 627 | 83.3 | globlastp |
| 2358 | LYD194 | cyamopsis\|10v1\|EG978606_P1 | 6051 | 627 | 83.3 | globlastp |
| 2359 | LYD194 | ipomoea_batatas\|10v1\|DV037875XX1_P1 | 6052 | 627 | 83.3 | globlastp |
| 2360 | LYD194 | prunus\|10v1\|BU573631_P1 | 6053 | 627 | 83.3 | globlastp |
| 2361 | LYD194 | salvia\|10v1\|FE536036_P1 | 6054 | 627 | 83.3 | globlastp |
| 2362 | LYD194 | apple\|gb171\|CN489087_P1 | 6055 | 627 | 83.3 | globlastp |
| 2363 | LYD194 | apple\|gb171\|CN490842_P1 | 6055 | 627 | 83.3 | globlastp |
| 2364 | LYD194 | avocado\|10v1\|FD503400_P1 | 6056 | 627 | 83.3 | globlastp |
| 2365 | LYD194 | avocado\|gb164\|FD503400_P1 | 6056 | 627 | 83.3 | globlastp |
| 2366 | LYD194 | basilicum\|gb157.3\|DY323895_P1 | 6057 | 627 | 83.3 | globlastp |
| 2367 | LYD194 | bean\|gb167\|FD794659_P1 | 6058 | 627 | 83.3 | globlastp |
| 2368 | LYD194 | cassava\|09v1\|FF534508_P1 | 6059 | 627 | 83.3 | globlastp |
| 2369 | LYD194 | cassava\|gb164\|DB931786_P1 | 6059 | 627 | 83.3 | globlastp |
| 2370 | LYD194 | coffea\|10v1\|DV667171_P1 | 6060 | 627 | 83.3 | globlastp |
| 2371 | LYD194 | coffea\|gb157.2\|DV667171_P1 | 6060 | 627 | 83.3 | globlastp |
| 2372 | LYD194 | cotton\|gb164\|BE053050_P1 | 6061 | 627 | 83.3 | globlastp |
| 2373 | LYD194 | cotton\|gb164\|DR457498_P1 | 6061 | 627 | 83.3 | globlastp |
| 2374 | LYD194 | ipomoea\|gb157.2\|DV037875_P1 | 6052 | 627 | 83.3 | globlastp |
| 2375 | LYD194 | kiwi\|gb166\|FG487691_P1 | 6062 | 627 | 83.3 | globlastp |
| 2376 | LYD194 | maize\|gb170\|AW438182_P1 | 6063 | 627 | 83.3 | globlastp |
| 2377 | LYD194 | oil_palm\|gb166\|EL691360_P1 | 6064 | 627 | 83.3 | globlastp |
| 2378 | LYD194 | pine\|10v1\|AA739705_P1 | 6065 | 627 | 83.3 | globlastp |
| 2379 | LYD194 | pine\|10v1\|AL750053_P1 | 6065 | 627 | 83.3 | globlastp |
| 2380 | LYD194 | prunus\|gb167\|BU043372_P1 | 6055 | 627 | 83.3 | globlastp |
| 2381 | LYD194 | prunus\|gb167\|CB819316_P1 | 6055 | 627 | 83.3 | globlastp |
| 2382 | LYD194 | soybean\|gb168\|AI967422_P1 | 6066 | 627 | 83.3 | globlastp |
| 2383 | LYD194 | switchgrass\|gb167\|DN148035_P1 | 6067 | 627 | 83.3 | globlastp |
| 2384 | LYD194 | prunus\|10v1\|BU043372_P1 | 6055 | 627 | 83.3 | globlastp |
| 2385 | LYD194 | maize\|10v1\|AW438182_P1 | 6063 | 627 | 83.3 | globlastp |
| 2386 | LYD194 | antirrhinum\|gb166\|AJ787336_P1 | 6068 | 627 | 82.5 | globlastp |
| 2387 | LYD194 | banana\|10v1\|FF560086_P1 | 6069 | 627 | 82.3 | globlastp |
| 2388 | LYD194 | barley\|10v1\|BE412562_P1 | 6070 | 627 | 82.1 | globlastp |
| 2389 | LYD194 | ginseng\|10v1\|DV553491_P1 | 6071 | 627 | 82.1 | globlastp |
| 2390 | LYD194 | ipomoea_nil\|10v1\|BJ554752_P1 | 6072 | 627 | 82.1 | globlastp |
| 2391 | LYD194 | pigeonpea\|10v1\|GW352154_P1 | 6073 | 627 | 82.1 | globlastp |
| 2392 | LYD194 | banana\|10v1\|FL659021_P1 | 6074 | 627 | 82.1 | globlastp |
| 2393 | LYD194 | banana\|gb167\|FL659021_P1 | 6074 | 627 | 82.1 | globlastp |
| 2394 | LYD194 | bean\|gb167\|CA910834_P1 | 6075 | 627 | 82.1 | globlastp |
| 2395 | LYD194 | cassava\|09v1\|DV441811_P1 | 6076 | 627 | 82.1 | globlastp |
| 2396 | LYD194 | cassava\|gb164\|DV441811_P1 | 6076 | 627 | 82.1 | globlastp |
| 2397 | LYD194 | ipomoea\|gb157.2\|BJ554752_P1 | 6072 | 627 | 82.1 | globlastp |
| 2398 | LYD194 | liquorice\|gb171\|FS241175_P1 | 6077 | 627 | 82.1 | globlastp |
| 2399 | LYD194 | liriodendron\|gb166\|CK757811_P1 | 6078 | 627 | 82.1 | globlastp |
| 2400 | LYD194 | lotus\|09v1\|GO022193_P1 | 6079 | 627 | 82.1 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2401 | LYD194 | maize\|gb170\|LLEC884141_P1 | 6080 | 627 | 82.1 | globlastp |
| 2402 | LYD194 | nuphar\|gb166\|CK745724_P1 | 6081 | 627 | 82.1 | globlastp |
| 2403 | LYD194 | oil_palm\|gb166\|EY398455_P1 | 6082 | 627 | 82.1 | globlastp |
| 2404 | LYD194 | papaya\|gb165\|EX252933_P1 | 6083 | 627 | 82.1 | globlastp |
| 2405 | LYD194 | peanut\|gb171\|CX127962_P1 | 6084 | 627 | 82.1 | globlastp |
| 2406 | LYD194 | pseudoroegneria\|gb167\|FF344954_P1 | 6070 | 627 | 82.1 | globlastp |
| 2407 | LYD194 | rye\|gb164\|BE587111_P1 | 6070 | 627 | 82.1 | globlastp |
| 2408 | LYD194 | sesame\|10v1\|BU669421_P1 | 6085 | 627 | 82.1 | globlastp |
| 2409 | LYD194 | sesame\|gb157.2\|BU669421_P1 | 6085 | 627 | 82.1 | globlastp |
| 2410 | LYD194 | sorghum\|09v1\|SB01G031840_P1 | 6086 | 627 | 82.1 | globlastp |
| 2411 | LYD194 | sugarcane\|gb157.3\|BQ535447_P1 | 6087 | 627 | 82.1 | globlastp |
| 2412 | LYD194 | sugarcane\|gb157.3\|CA198410_P1 | 6087 | 627 | 82.1 | globlastp |
| 2413 | LYD194 | tobacco\|gb162\|CV016265_P1 | 6088 | 627 | 82.1 | globlastp |
| 2414 | LYD194 | sugarcane\|10v1\|BQ535447_P1 | 6087 | 627 | 82.1 | globlastp |
| 2415 | LYD194 | cotton\|10v1\|BE053050_P1 | 6089 | 627 | 82.1 | globlastp |
| 2416 | LYD194 | pigeonpea\|10v1\|SRR054580S0180637_T1 | 6090 | 627 | 82.05 | glotblastn |
| 2417 | LYD194 | cleome_spinosa\|10v1\|GR931202_P1 | 6091 | 627 | 81 | globlastp |
| 2418 | LYD194 | beech\|gb170\|SRR006293S0002103_P1 | 6092 | 627 | 81 | globlastp |
| 2419 | LYD194 | monkeyflower\|09v1\|GO982768_P1 | 6093 | 627 | 81 | globlastp |
| 2420 | LYD194 | monkeyflower\|10v1\|DV206469_P1 | 6093 | 627 | 81 | globlastp |
| 2421 | LYD194 | blueberry\|10v1\|CF811639_P1 | 6094 | 627 | 80.8 | globlastp |
| 2422 | LYD194 | cucumber\|09v1\|AM719428_P1 | 6095 | 627 | 80.8 | globlastp |
| 2423 | LYD194 | cucumber\|09v1\|DV632453_P1 | 6096 | 627 | 80.8 | globlastp |
| 2424 | LYD194 | eggplant\|10v1\|FS001750_P1 | 6097 | 627 | 80.8 | globlastp |
| 2425 | LYD194 | melon\|10v1\|DV632453_P1 | 6096 | 627 | 80.8 | globlastp |
| 2426 | LYD194 | oat\|10v2\|CN814648_P1 | 6098 | 627 | 80.8 | globlastp |
| 2427 | LYD194 | b_juncea\|gb164\|EVGN00777512133168_P1 | 6099 | 627 | 80.8 | globlastp |
| 2428 | LYD194 | beet\|gb162\|BQ585430_P1 | 6100 | 627 | 80.8 | globlastp |
| 2429 | LYD194 | castorbean\|09v1\|XM002510070_P1 | 6101 | 627 | 80.8 | globlastp |
| 2430 | LYD194 | castorbean\|09v1\|XM002533116_P1 | 6102 | 627 | 80.8 | globlastp |
| 2431 | LYD194 | cowpea\|gb166\|DR068342_P1 | 6103 | 627 | 80.8 | globlastp |
| 2432 | LYD194 | cryptomeria\|gb166\|BW994667_P1 | 6104 | 627 | 80.8 | globlastp |
| 2433 | LYD194 | fescue\|gb161\|CK803222_P1 | 6105 | 627 | 80.8 | globlastp |
| 2434 | LYD194 | ginger\|gb164\|DY354931_P1 | 6106 | 627 | 80.8 | globlastp |
| 2435 | LYD194 | lolium\|09v1\|AU246760_P1 | 6105 | 627 | 80.8 | globlastp |
| 2436 | LYD194 | lolium\|10v1\|AU246760_P1 | 6105 | 627 | 80.8 | globlastp |
| 2437 | LYD194 | melon\|gb165\|DV632453_P1 | 6096 | 627 | 80.8 | globlastp |
| 2438 | LYD194 | nuphar\|gb166\|CD475546_P1 | 6107 | 627 | 80.8 | globlastp |
| 2439 | LYD194 | rice\|gb170\|OS07G02340_P1 | 6108 | 627 | 80.8 | globlastp |
| 2440 | LYD194 | soybean\|gb168\|CA910834_P1 | 6109 | 627 | 80.8 | globlastp |
| 2441 | LYD194 | antirrhinum\|gb166\|AJ788641_T1 | 6110 | 627 | 80.77 | glotblastn |
| 2442 | LYD194 | eucalyptus\|gb166\|CT983755_T1 | 6111 | 627 | 80.77 | glotblastn |
| 2443 | LYD194 | medicago\|09v1\|BE239639_P1 | 6112 | 627 | 80 | globlastp |
| 2444 | LYD195 | potato\|10v1\|BG096397_P1 | 6113 | 628 | 99.6 | globlastp |
| 2445 | LYD195 | potato\|gb157.2\|BG096397_P1 | 6113 | 628 | 99.6 | globlastp |
| 2446 | LYD195 | solanum_phureja\|09v1\|SPHAI483451_P1 | 6113 | 628 | 99.6 | globlastp |
| 2447 | LYD195 | tobacco\|gb162\|AF022775_P1 | 6114 | 628 | 91.8 | globlastp |
| 2448 | LYD195 | tobacco\|gb162\|EB424611_P1 | 6115 | 628 | 91.8 | globlastp |
| 2449 | LYD195 | eggplant\|10v1\|FS008855_P1 | 6116 | 628 | 90.2 | globlastp |
| 2450 | LYD195 | tobacco\|gb162\|AJ344574_P1 | 6117 | 628 | 89.9 | globlastp |
| 2451 | LYD195 | pepper\|gb171\|BM062010_P1 | 6118 | 628 | 89.5 | globlastp |
| 2452 | LYD195 | potato\|10v1\|BF459570_P1 | 6119 | 628 | 89.1 | globlastp |
| 2453 | LYD195 | potato\|gb157.2\|BF459570_P1 | 6119 | 628 | 89.1 | globlastp |
| 2454 | LYD195 | tomato\|gb164\|BG133462_P1 | 6120 | 628 | 89.1 | globlastp |
| 2455 | LYD195 | solanum_phureja\|09v1\|SPHBG133462_P1 | 6121 | 628 | 88.7 | globlastp |
| 2456 | LYD195 | tobacco\|gb162\|CV021257_P1 | 6122 | 628 | 88.7 | globlastp |
| 2457 | LYD195 | petunia\|gb171\|CV293247_P1 | 6123 | 628 | 88.4 | globlastp |
| 2458 | LYD195 | artemisia\|10v1\|EY055561_P1 | 6124 | 628 | 88.2 | globlastp |
| 2459 | LYD195 | artemisia\|10v1\|EY078221_P1 | 6125 | 628 | 88.2 | globlastp |
| 2460 | LYD195 | nasturtium\|10v1\|GH170063_P1 | 6126 | 628 | 88.2 | globlastp |
| 2461 | LYD195 | lettuce\|10v1\|DW110506_P1 | 6127 | 628 | 87.8 | globlastp |
| 2462 | LYD195 | lettuce\|gb157.2\|DW112190_P1 | 6128 | 628 | 87.8 | globlastp |
| 2463 | LYD195 | lettuce\|10v1\|DW079750_P1 | 6129 | 628 | 87.8 | globlastp |
| 2464 | LYD195 | apple\|gb171\|CN489101_P1 | 6130 | 628 | 87.5 | globlastp |
| 2465 | LYD195 | centaurea\|gb166\|EH764503_P1 | 6131 | 628 | 87.3 | globlastp |
| 2466 | LYD195 | lettuce\|gb157.2\|DW043694_P1 | 6132 | 628 | 87.3 | globlastp |
| 2467 | LYD195 | lettuce\|gb157.2\|DW079750_P1 | 6133 | 628 | 87.3 | globlastp |
| 2468 | LYD195 | lettuce\|gb157.2\|DW095151_P1 | 6134 | 628 | 87.3 | globlastp |
| 2469 | LYD195 | lettuce\|10v1\|DW043694_P1 | 6132 | 628 | 87.3 | globlastp |
| 2470 | LYD195 | dandelion\|10v1\|DR398855_P1 | 6135 | 628 | 87 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2471 | LYD195 | artemisia\|10v1\|EY114017_P1 | 6136 | 628 | 87 | globlastp |
| 2472 | LYD195 | artemisia\|gb164\|EY114017_P1 | 6136 | 628 | 87 | globlastp |
| 2473 | LYD195 | lettuce\|10v1\|DW054823_P1 | 6137 | 628 | 86.9 | globlastp |
| 2474 | LYD195 | lettuce\|gb157.2\|DW085965_P1 | 6138 | 628 | 86.9 | globlastp |
| 2475 | LYD195 | senecio\|gb170\|DY658676_P1 | 6139 | 628 | 86.9 | globlastp |
| 2476 | LYD195 | poplar\|gb170\|AJ224895_P1 | 6140 | 628 | 86.7 | globlastp |
| 2477 | LYD195 | dandelion\|10v1\|DR398892_P1 | 6141 | 628 | 86.6 | globlastp |
| 2478 | LYD195 | dandelion\|gb161\|DY819202_P1 | 6141 | 628 | 86.6 | globlastp |
| 2479 | LYD195 | centaurea\|gb166\|EH732032_T1 | 6142 | 628 | 86.53 | glotblastn |
| 2480 | LYD195 | lettuce\|gb157.2\|DW078439_T1 | 6143 | 628 | 86.53 | glotblastn |
| 2481 | LYD195 | tragopogon\|10v1\|SRR020205S0001708_P1 | 6144 | 628 | 86.5 | globlastp |
| 2482 | LYD195 | centaurea\|gb166\|EH733702_P1 | 6145 | 628 | 86.5 | globlastp |
| 2483 | LYD195 | centaurea\|gb166\|EH780631_P1 | 6146 | 628 | 86.5 | globlastp |
| 2484 | LYD195 | dandelion\|10v1\|DY816598_P1 | 6147 | 628 | 86.5 | globlastp |
| 2485 | LYD195 | dandelion\|gb161\|DY816598_P1 | 6147 | 628 | 86.5 | globlastp |
| 2486 | LYD195 | dandelion\|10v1\|DY828265_P1 | 6148 | 628 | 86.5 | globlastp |
| 2487 | LYD195 | dandelion\|gb161\|DY828265_P1 | 6148 | 628 | 86.5 | globlastp |
| 2488 | LYD195 | lettuce\|gb157.2\|DW077273_P1 | 6149 | 628 | 86.5 | globlastp |
| 2489 | LYD195 | strawberry\|gb164\|AJ001447_P1 | 6150 | 628 | 86.5 | globlastp |
| 2490 | LYD195 | sunflower\|gb162\|CF088560_P1 | 6151 | 628 | 86.5 | globlastp |
| 2491 | LYD195 | sunflower\|10v1\|DY925822_P1 | 6152 | 628 | 86.5 | globlastp |
| 2492 | LYD195 | sunflower\|gb162\|DY925822_P1 | 6152 | 628 | 86.5 | globlastp |
| 2493 | LYD195 | sunflower\|10v1\|CF088560_P1 | 6151 | 628 | 86.5 | globlastp |
| 2494 | LYD195 | poplar\|10v1\|AJ224895_P1 | 6153 | 628 | 86.3 | globlastp |
| 2495 | LYD195 | poplar\|10v1\|PTU27116_P1 | 6154 | 628 | 86.3 | globlastp |
| 2496 | LYD195 | poplar\|gb170\|PTU27116_P1 | 6154 | 628 | 86.3 | globlastp |
| 2497 | LYD195 | oak\|10v1\|EE743854_P1 | 6155 | 628 | 86.2 | globlastp |
| 2498 | LYD195 | chestnut\|gb170\|SRR006295S0000995_P1 | 6156 | 628 | 86.2 | globlastp |
| 2499 | LYD195 | kiwi\|gb166\|FG418869_P1 | 6157 | 628 | 86.2 | globlastp |
| 2500 | LYD195 | oak\|gb170\|EE743854_P1 | 6156 | 628 | 86.2 | globlastp |
| 2501 | LYD195 | prunus\|10v1\|BU044203_P1 | 6158 | 628 | 86.2 | globlastp |
| 2502 | LYD195 | prunus\|gb167\|BU044203_P1 | 6158 | 628 | 86.2 | globlastp |
| 2503 | LYD195 | tragopogon\|10v1\|SRR020205S0055567_T1 | 6159 | 628 | 86.12 | glotblastn |
| 2504 | LYD195 | lettuce\|gb157.2\|DW075466_T1 | 6160 | 628 | 86.12 | glotblastn |
| 2505 | LYD195 | ipomoea_batatas\|10v1\|BU690759_P1 | 6161 | 628 | 86.1 | globlastp |
| 2506 | LYD195 | ipomoea_nil\|10v1\|CJ738710_P1 | 6162 | 628 | 86.1 | globlastp |
| 2507 | LYD195 | b_juncea\|10v2\|E6ANDIZ01A38JW_P1 | 6163 | 628 | 86.1 | globlastp |
| 2508 | LYD195 | ipomoea\|gb157.2\|BU690759_P1 | 6164 | 628 | 86.1 | globlastp |
| 2509 | LYD195 | lettuce\|gb157.2\|DW054823_P1 | 6165 | 628 | 86.1 | globlastp |
| 2510 | LYD195 | sunflower\|gb162\|CF096542_P1 | 6166 | 628 | 86.1 | globlastp |
| 2511 | LYD195 | coffea\|10v1\|AF534905_P1 | 6167 | 628 | 85.9 | globlastp |
| 2512 | LYD195 | coffea\|gb157.2\|AF534905_P1 | 6167 | 628 | 85.9 | globlastp |
| 2513 | LYD195 | eucalyptus\|gb166\|AF168780_P1 | 6168 | 628 | 85.9 | globlastp |
| 2514 | LYD195 | kiwi\|gb166\|FG421337_P1 | 6169 | 628 | 85.9 | globlastp |
| 2515 | LYD195 | flax\|09v1\|EU926495_P1 | 6170 | 628 | 85.8 | globlastp |
| 2516 | LYD195 | centaurea\|gb166\|EH730909_P1 | 6171 | 628 | 85.8 | globlastp |
| 2517 | LYD195 | flax\|09v1\|DQ090002_P1 | 6172 | 628 | 85.8 | globlastp |
| 2518 | LYD195 | flax\|gb157.3\|DQ090002_P1 | 6172 | 628 | 85.8 | globlastp |
| 2519 | LYD195 | safflower\|gb162\|EL382540_P1 | 6171 | 628 | 85.8 | globlastp |
| 2520 | LYD195 | artemisia\|gb164\|EY055561_P1 | 6173 | 628 | 85.7 | globlastp |
| 2521 | LYD195 | basilicum\|gb157.3\|DY321549_P1 | 6174 | 628 | 85.7 | globlastp |
| 2522 | LYD195 | lettuce\|gb157.2\|BQ986770_P1 | 6175 | 628 | 85.7 | globlastp |
| 2523 | LYD195 | lettuce\|gb157.2\|DW107581_P1 | 6176 | 628 | 85.7 | globlastp |
| 2524 | LYD195 | lettuce\|gb157.2\|DW110506_P1 | 6177 | 628 | 85.7 | globlastp |
| 2525 | LYD195 | lettuce\|gb157.2\|DW136638_P1 | 6176 | 628 | 85.7 | globlastp |
| 2526 | LYD195 | zinnia\|gb171\|ZEU13151_P1 | 6178 | 628 | 85.7 | globlastp |
| 2527 | LYD195 | lettuce\|10v1\|DW063228_P1 | 6176 | 628 | 85.7 | globlastp |
| 2528 | LYD195 | b_juncea\|10v2\|E6ANDIZ01A37PS_P1 | 6179 | 628 | 85.6 | globlastp |
| 2529 | LYD195 | b_juncea\|gb164\|EVGN00576715131914_P1 | 6180 | 628 | 85.5 | globlastp |
| 2530 | LYD195 | triphysaria\|10v1\|BE574803_P1 | 6181 | 628 | 85.5 | globlastp |
| 2531 | LYD195 | triphysaria\|gb164\|EX990149_P1 | 6181 | 628 | 85.5 | globlastp |
| 2532 | LYD195 | soybean\|gb168\|AI974778_P1 | 6182 | 628 | 85.4 | globlastp |
| 2533 | LYD195 | soybean\|gb168\|AW350997_P1 | 6183 | 628 | 85.4 | globlastp |
| 2534 | LYD195 | ipomoea\|gb157.2\|EE875282_T1 | 6184 | 628 | 85.31 | glotblastn |
| 2535 | LYD195 | lettuce\|gb157.2\|DW063228_P1 | 6185 | 628 | 85.3 | globlastp |
| 2536 | LYD195 | melon\|10v1\|AM722923_P1 | 6186 | 628 | 85.1 | globlastp |
| 2537 | LYD195 | monkeyflower\|10v1\|DV206851_P1 | 6187 | 628 | 85.1 | globlastp |
| 2538 | LYD195 | orobanche\|10v1\|SRR023189S0001619_P1 | 6188 | 628 | 85.1 | globlastp |
| 2539 | LYD195 | cowpea\|gb166\|FF383224_P1 | 6189 | 628 | 85.1 | globlastp |
| 2540 | LYD195 | artemisia\|10v1\|EY062910_P1 | 6190 | 628 | 85 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2541 | LYD195 | dandelion\|10v1\|DR400849_P1 | 6191 | 628 | 85 | globlastp |
| 2542 | LYD195 | cichorium\|gb171\|EH681911_P1 | 6192 | 628 | 84.9 | globlastp |
| 2543 | LYD195 | dandelion\|10v1\|DY822859_P1 | 6193 | 628 | 84.9 | globlastp |
| 2544 | LYD195 | dandelion\|gb161\|DY822859_P1 | 6193 | 628 | 84.9 | globlastp |
| 2545 | LYD195 | pepper\|gb171\|BM062476_P1 | 6194 | 628 | 84.9 | globlastp |
| 2546 | LYD195 | pepper\|gb171\|GD052907_P1 | 6195 | 628 | 84.9 | globlastp |
| 2547 | LYD195 | potato\|gb157.2\|AB061268_P1 | 6196 | 628 | 84.9 | globlastp |
| 2548 | LYD195 | potato\|10v1\|CK259364_P1 | 6197 | 628 | 84.9 | globlastp |
| 2549 | LYD195 | potato\|gb157.2\|CK259364_P1 | 6197 | 628 | 84.9 | globlastp |
| 2550 | LYD195 | safflower\|gb162\|EL401429_P1 | 6198 | 628 | 84.9 | globlastp |
| 2551 | LYD195 | catharanthus\|gb166\|FD416177_P1 | 6199 | 628 | 84.7 | globlastp |
| 2552 | LYD195 | peanut\|gb171\|EG029550_P1 | 6200 | 628 | 84.7 | globlastp |
| 2553 | LYD195 | safflower\|gb162\|EL401924_T1 | 6201 | 628 | 84.68 | glotblastn |
| 2554 | LYD195 | cacao\|gb167\|CF972935_P1 | 6202 | 628 | 84.6 | globlastp |
| 2555 | LYD195 | cotton\|gb164\|BQ409901_P1 | 6203 | 628 | 84.6 | globlastp |
| 2556 | LYD195 | cynara\|gb167\|GE585761_P1 | 6204 | 628 | 84.6 | globlastp |
| 2557 | LYD195 | artemisia\|gb164\|EY062910_T1 | 6205 | 628 | 84.55 | glotblastn |
| 2558 | LYD195 | basilicum\|10v1\|DY321550_P1 | 6206 | 628 | 84.5 | globlastp |
| 2559 | LYD195 | aquilegia\|10v1\|DR940223_P1 | 6207 | 628 | 84.5 | globlastp |
| 2560 | LYD195 | basilicum\|10v1\|DY322646_P1 | 6208 | 628 | 84.5 | globlastp |
| 2561 | LYD195 | basilicum\|gb157.3\|DY322646_P1 | 6208 | 628 | 84.5 | globlastp |
| 2562 | LYD195 | aquilegia\|gb157.3\|DR940223_T1 | 6209 | 628 | 84.49 | glotblastn |
| 2563 | LYD195 | lettuce\|gb157.2\|DW046035_T1 | 6210 | 628 | 84.49 | glotblastn |
| 2564 | LYD195 | cucumber\|09v1\|DQ178939_P1 | 6211 | 628 | 84.3 | globlastp |
| 2565 | LYD195 | bean\|gb167\|CB539234_P1 | 6212 | 628 | 84.3 | globlastp |
| 2566 | LYD195 | peanut\|10v1\|EG029550_P1 | 6213 | 628 | 84.3 | globlastp |
| 2567 | LYD195 | walnuts\|gb166\|EL893897_P1 | 6214 | 628 | 84.3 | globlastp |
| 2568 | LYD195 | cotton\|10v1\|BQ409901_P1 | 6215 | 628 | 84.2 | globlastp |
| 2569 | LYD195 | sunflower\|10v1\|DY918862_P1 | 6216 | 628 | 84.2 | globlastp |
| 2570 | LYD195 | sunflower\|gb162\|DY918862_P1 | 6216 | 628 | 84.2 | globlastp |
| 2571 | LYD195 | eggplant\|10v1\|FS002731_P1 | 6217 | 628 | 84.1 | globlastp |
| 2572 | LYD195 | lettuce\|gb157.2\|DW052563_P1 | 6218 | 628 | 84.1 | globlastp |
| 2573 | LYD195 | pepper\|gb171\|BM065108_P1 | 6219 | 628 | 84.1 | globlastp |
| 2574 | LYD195 | petunia\|gb171\|CV293837_P1 | 6220 | 628 | 84.1 | globlastp |
| 2575 | LYD195 | tomato\|gb164\|BG132250_P1 | 6221 | 628 | 84.1 | globlastp |
| 2576 | LYD195 | cynara\|gb167\|GE588483_T1 | 6222 | 628 | 84.08 | glotblastn |
| 2577 | LYD195 | onion\|gb162\|BI095707_T1 | 6223 | 628 | 84.08 | glotblastn |
| 2578 | LYD195 | lettuce\|10v1\|DW079335_P1 | 6224 | 628 | 84 | globlastp |
| 2579 | LYD195 | lettuce\|gb157.2\|DW079335_P1 | 6224 | 628 | 84 | globlastp |
| 2580 | LYD195 | cyamopsis\|10v1\|EG985137_P1 | 6225 | 628 | 83.9 | globlastp |
| 2581 | LYD195 | tragopogon\|10v1\|SRR020205S0054743_P1 | 6226 | 628 | 83.9 | globlastp |
| 2582 | LYD195 | sunflower\|10v1\|CD849237_P1 | 6227 | 628 | 83.8 | globlastp |
| 2583 | LYD195 | sunflower\|gb162\|CD849237_P1 | 6228 | 628 | 83.8 | globlastp |
| 2584 | LYD195 | eggplant\|10v1\|FS074698_P1 | 6229 | 628 | 83.7 | globlastp |
| 2585 | LYD195 | grape\|gb160\|CF213537_P1 | 6230 | 628 | 83.7 | globlastp |
| 2586 | LYD195 | lettuce\|gb157.2\|DW108949_P1 | 6231 | 628 | 83.7 | globlastp |
| 2587 | LYD195 | petunia\|gb171\|CV292827_P1 | 6232 | 628 | 83.7 | globlastp |
| 2588 | LYD195 | solanum_phureja\|09v1\|SPHAI488060_P1 | 6233 | 628 | 83.7 | globlastp |
| 2589 | LYD195 | lettuce\|10v1\|DW052563_P1 | 6231 | 628 | 83.7 | globlastp |
| 2590 | LYD195 | sunflower\|10v1\|DY952631_T1 | 6234 | 628 | 83.67 | glotblastn |
| 2591 | LYD195 | dandelion\|gb161\|DY818320_T1 | 6235 | 628 | 83.67 | glotblastn |
| 2592 | LYD195 | lettuce\|gb157.2\|DW167480_T1 | 6236 | 628 | 83.67 | glotblastn |
| 2593 | LYD195 | lovegrass\|gb167\|DN480953_P1 | 6237 | 628 | 83.67 | globlastp |
| 2593 | LYD211 | lovegrass\|gb167\|DN480953_P1 | 6237 | 638 | 89.3 | globlastp |
| 2594 | LYD195 | citrus\|gb166\|BQ623631_P1 | 6238 | 628 | 83.5 | globlastp |
| 2595 | LYD195 | grape\|gb160\|CB346952_P1 | 6239 | 628 | 83.4 | globlastp |
| 2596 | LYD195 | medicago\|09v1\|MSU20736_P1 | 6240 | 628 | 83.4 | globlastp |
| 2597 | LYD195 | avocado\|10v1\|CV459964_T1 | 6241 | 628 | 83.33 | glotblastn |
| 2598 | LYD195 | avocado\|gb164\|CV459964_T1 | 6242 | 628 | 83.33 | glotblastn |
| 2599 | LYD195 | basilicum\|gb157.3\|DY321420_P1 | 6243 | 628 | 83.3 | globlastp |
| 2600 | LYD195 | tobacco\|gb162\|NTU62734_P1 | 6244 | 628 | 83.3 | globlastp |
| 2601 | LYD195 | safflower\|gb162\|EL395137_T1 | 6245 | 628 | 83.27 | glotblastn |
| 2602 | LYD195 | wheat\|gb164\|BG605452_T1 | 6246 | 628 | 83.27 | glotblastn |
| 2602 | LYD211 | wheat\|gb164\|BG605452_P1 | 6246 | 638 | 86.6 | globlastp |
| 2603 | LYD195 | cotton\|10v1\|CO083019_P1 | 6247 | 628 | 83.1 | globlastp |
| 2604 | LYD195 | cotton\|gb164\|CO083019_P1 | 6247 | 628 | 83.1 | globlastp |
| 2605 | LYD195 | dandelion\|10v1\|DY813534_P1 | 6248 | 628 | 83.1 | globlastp |
| 2606 | LYD195 | eucalyptus\|gb166\|Y12228_P1 | 6249 | 628 | 83 | globlastp |
| 2607 | LYD195 | lotus\|09v1\|AW163940_P1 | 6250 | 628 | 83 | globlastp |
| 2608 | LYD195 | cichorium\|gb171\|EH703864_T1 | 6251 | 628 | 82.93 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog. to Gene Name | cluster name | Polypep. SEQ ID NO: | Homolog. To polypep. SEQ ID NO: | % global identity | Algor. |
|---|---|---|---|---|---|---|
| 2609 | LYD195 | b_rapa\|gb162\|BG544230_P1 | 6252 | 628 | 82.9 | globlastp |
| 2609 | LYD211 | b_rapa\|gb162\|BG544230_P1 | 6252 | 638 | 81.2 | globlastp |
| 2610 | LYD195 | dandelion\|10v1\|DY811080_P1 | 6253 | 628 | 82.9 | globlastp |
| 2611 | LYD195 | dandelion\|gb161\|DY811080_P1 | 6253 | 628 | 82.9 | globlastp |
| 2612 | LYD195 | ginger\|gb164\|DY345043_P1 | 6254 | 628 | 82.9 | globlastp |
| 2613 | LYD195 | radish\|gb164\|EV525011_P1 | 6255 | 628 | 82.9 | globlastp |
| 2613 | LYD211 | radish\|gb164\|EV525011_P1 | 6255 | 638 | 80.5 | globlastp |
| 2614 | LYD195 | radish\|gb164\|EV525082_P1 | 6256 | 628 | 82.9 | globlastp |
| 2614 | LYD211 | radish\|gb164\|EV525082_P1 | 6256 | 638 | 81.2 | globlastp |
| 2615 | LYD195 | tobacco\|gb162\|NTU38612_P1 | 6257 | 628 | 82.9 | globlastp |
| 2616 | LYD195 | tomato\|gb164\|EU161983_P1 | 6258 | 628 | 82.9 | globlastp |
| 2617 | LYD195 | pseudoroegneria\|gb167\|FF344366_T1 | 6259 | 628 | 82.86 | glotblastn |
| 2617 | LYD211 | pseudoroegneria\|gb167\|FF344366_P1 | 6259 | 638 | 86.6 | globlastp |
| 2618 | LYD195 | wheat\|gb164\|BE499248_T1 | 6260 | 628 | 82.86 | glotblastn |
| 2618 | LYD211 | wheat\|gb164\|BE499248_T1 | 6260 | 638 | 85.39 | globlastp |
| 2619 | LYD195 | cleome_spinosa\|10v1\|GR934613_T1 | 6261 | 628 | 82.8 | glotblastn |
| 2620 | LYD195 | papaya\|gb165\|AM903875_P1 | 6262 | 628 | 82.7 | globlastp |
| 2621 | LYD195 | cynodon\|10v1\|ES293249_T1 | 6263 | 628 | 82.66 | glotblastn |
| 2621 | LYD211 | cynodon\|10v1\|ES293249_P1 | 6263 | 638 | 90.1 | globlastp |
| 2622 | LYD195 | b_juncea\|10v2\|E6ANDIZ01B5QRG_P1 | 6264 | 628 | 82.6 | globlastp |
| 2622 | LYD211 | b_juncea\|10v2\|E6ANDIZ01B5QRG_P1 | 6264 | 638 | 81.6 | globlastp |
| 2623 | LYD195 | monkeyflower\|10v1\|GO983307_P1 | 6265 | 628 | 82.6 | globlastp |
| 2624 | LYD195 | basilicum\|10v1\|DY326108_P1 | 6266 | 628 | 82.6 | globlastp |
| 2625 | LYD195 | basilicum\|gb157.3\|DY326108_P1 | 6266 | 628 | 82.6 | globlastp |
| 2626 | LYD195 | canola\|10v1\|CD832570_P1 | 6267 | 628 | 82.6 | globlastp |
| 2626 | LYD211 | canola\|10v1\|CD832570_P1 | 6267 | 638 | 81.2 | globlastp |
| 2627 | LYD195 | canola\|gb161\|CD832570_P1 | 6267 | 628 | 82.6 | globlastp |
| 2627 | LYD211 | canola\|gb161\|CD832570_P1 | 6267 | 638 | 81.2 | globlastp |
| 2628 | LYD195 | clover\|gb162\|BB903730_P1 | 6268 | 628 | 82.6 | globlastp |
| 2629 | LYD195 | radish\|gb164\|EV535109_P1 | 6269 | 628 | 82.6 | globlastp |
| 2629 | LYD211 | radish\|gb164\|EV535109_P1 | 6269 | 638 | 80.1 | globlastp |
| 2630 | LYD195 | cichorium\|gb171\|EH694888_P1 | 6270 | 628 | 82.5 | globlastp |
| 2631 | LYD195 | brachypodium\|09v1\|GT831168_T1 | 6271 | 628 | 82.45 | glotblastn |
| 2631 | LYD211 | brachypodium\|09v1\|GT831168_P1 | 6271 | 638 | 87.1 | globlastp |
| 2632 | LYD195 | artemisia\|10v1\|EY073536_T1 | 6272 | 628 | 82.45 | glotblastn |
| 2633 | LYD195 | barley\|10v1\|BF623901_T1 | 6273 | 628 | 82.45 | glotblastn |
| 2633 | LYD211 | barley\|10v1\|BF623901_P1 | 6273 | 638 | 85.3 | globlastp |
| 2634 | LYD195 | barley\|gb157SOLEXA\|BF623901_T1 | 6273 | 628 | 82.45 | glotblastn |
| 2634 | LYD211 | barley\|gb157SOLEXA\|BF623901_P1 | 6273 | 638 | 85.3 | globlastp |
| 2635 | LYD195 | brachypodium\|gb169\|BE406401_T1 | 6271 | 628 | 82.45 | glotblastn |
| 2635 | LYD211 | brachypodium\|gb169\|BE406401_P1 | 6271 | 638 | 87.1 | globlastp |
| 2636 | LYD195 | ipomoea_nil\|10v1\|BJ562028_P1 | 6274 | 628 | 82.4 | globlastp |
| 2637 | LYD195 | citrus\|gb166\|GFXAB035144X1_P1 | 6275 | 628 | 82.4 | globlastp |
| 2638 | LYD195 | cynara\|gb167\|GE593594_P1 | 6276 | 628 | 82.4 | globlastp |
| 2639 | LYD195 | ipomoea\|gb157.2\|BJ562028_P1 | 6274 | 628 | 82.4 | globlastp |
| 2640 | LYD195 | lettuce\|gb157.2\|DW154323_T1 | 6277 | 628 | 82.33 | glotblastn |
| 2641 | LYD195 | dandelion\|10v1\|DR400478_P1 | 6278 | 628 | 82.3 | globlastp |
| 2642 | LYD195 | dandelion\|gb161\|DY802286_P1 | 6278 | 628 | 82.3 | globlastp |
| 2643 | LYD195 | oak\|10v1\|FP034949_P1 | 6279 | 628 | 82.2 | globlastp |
| 2644 | LYD195 | cacao\|gb167\|CU515299_P1 | 6280 | 628 | 82.2 | globlastp |
| 2645 | LYD195 | canola\|10v1\|CD813970_P1 | 6281 | 628 | 82.2 | globlastp |
| 2645 | LYD211 | canola\|10v1\|CD813970_P1 | 6281 | 638 | 80.8 | globlastp |
| 2646 | LYD195 | canola\|gb161\|CD813970_P1 | 6281 | 628 | 82.2 | globlastp |
| 2646 | LYD211 | canola\|gb161\|CD813970_P1 | 6281 | 638 | 80.8 | globlastp |
| 2647 | LYD195 | liquorice\|gb171\|FS288141_P1 | 6282 | 628 | 82.2 | globlastp |
| 2648 | LYD195 | centaurea\|gb166\|EH783138_T1 | 6283 | 628 | 82.04 | glotblastn |
| 2649 | LYD195 | ipomoea_batatas\|10v1\|EE875716_P1 | 6284 | 628 | 82 | globlastp |
| 2650 | LYD195 | cichorium\|gb171\|EH700384_P1 | 6285 | 628 | 82 | globlastp |
| 2651 | LYD195 | cotton\|gb164\|DT568345_P1 | 6286 | 628 | 82 | globlastp |
| 2652 | LYD195 | ipomoea\|gb157.2\|EE875716_P1 | 6284 | 628 | 82 | globlastp |
| 2653 | LYD195 | acacia\|10v1\|EU275979_P1 | 6287 | 628 | 81.9 | globlastp |
| 2654 | LYD195 | radish\|gb164\|EV539035_P1 | 6288 | 628 | 81.8 | globlastp |
| 2654 | LYD211 | radish\|gb164\|EV539035_P1 | 6288 | 638 | 80.1 | globlastp |
| 2655 | LYD195 | cassava\|09v1\|CK644701_P1 | 6289 | 628 | 81.7 | globlastp |
| 2656 | LYD195 | cassava\|gb164\|CK644701_P1 | 6289 | 628 | 81.7 | globlastp |
| 2657 | LYD195 | lettuce\|10v1\|DW079459_P1 | 6290 | 628 | 81.7 | globlastp |
| 2658 | LYD195 | lettuce\|gb157.2\|DW079459_P1 | 6290 | 628 | 81.7 | globlastp |
| 2659 | LYD195 | lettuce\|gb157.2\|DW114772_P1 | 6291 | 628 | 81.7 | globlastp |
| 2660 | LYD195 | lettuce\|10v1\|DW046035_P1 | 6291 | 628 | 81.7 | globlastp |
| 2661 | LYD195 | canola\|gb161\|CD817919_T1 | 6292 | 628 | 81.63 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2662 | LYD195 | gerbera|09v1|AJ761949_T1 | 6293 | 628 | 81.63 | glotblastn |
| 2663 | LYD195 | cotton|10v1|DT568345_P1 | 6294 | 628 | 81.6 | globlastp |
| 2664 | LYD195 | poppy|gb166|FE964281_P1 | 6295 | 628 | 81.6 | globlastp |
| 2665 | LYD195 | wheat|gb164|BE406401_T1 | 6296 | 628 | 81.53 | glotblastn |
| 2665 | LYD211 | wheat|gb164|BE406401_T1 | 6296 | 638 | 86.64 | glotblastn |
| 2666 | LYD195 | b_rapa|gb162|AT000531_P1 | 6297 | 628 | 81.5 | globlastp |
| 2666 | LYD211 | b_rapa|gb162|AT000531_P1 | 6297 | 638 | 80.1 | globlastp |
| 2667 | LYD195 | canola|gb161|CD825507_P1 | 6297 | 628 | 81.5 | globlastp |
| 2667 | LYD211 | canola|gb161|CD825507_P1 | 6297 | 638 | 80.1 | globlastp |
| 2668 | LYD195 | canola|gb161|CN827065_P1 | 6298 | 628 | 81.5 | globlastp |
| 2669 | LYD195 | castorbean|09v1|XM002518693_P1 | 6299 | 628 | 81.5 | globlastp |
| 2670 | LYD195 | iceplant|gb164|AF053553_P1 | 6300 | 628 | 81.5 | globlastp |
| 2671 | LYD195 | canola|10v1|CD817919_P1 | 6297 | 628 | 81.5 | globlastp |
| 2671 | LYD211 | canola|10v1|CD817919_P1 | 6297 | 638 | 80.1 | globlastp |
| 2672 | LYD195 | b_juncea|gb164|EVGN00208909581615_P1 | 6301 | 628 | 81.5 | globlastp |
| 2672 | LYD211 | b_juncea|gb164|EVGN00208909581615_P1 | 6301 | 638 | 80.1 | globlastp |
| 2673 | LYD195 | artemisia|gb164|EY073536_P1 | 6302 | 628 | 81.4 | globlastp |
| 2674 | LYD195 | thellungiella|gb167|DN775757_P1 | 6303 | 628 | 81.4 | globlastp |
| 2675 | LYD195 | jatropha|09v1|GO246755_T1 | 6304 | 628 | 81.38 | glotblastn |
| 2676 | LYD195 | cassava|gb164|DV443819_P1 | 6305 | 628 | 81.3 | globlastp |
| 2677 | LYD195 | cryptomeria|gb166|BP176134_T1 | 6306 | 628 | 81.27 | glotblastn |
| 2678 | LYD195 | pine|gb157.2|AF036095_T1 | 6307 | 628 | 81.22 | glotblastn |
| 2679 | LYD195 | b_oleracea|gb161|AM385464_P1 | 6308 | 628 | 81.2 | globlastp |
| 2680 | LYD195 | liriodendron|gb166|DT595199_P1 | 6309 | 628 | 81.2 | globlastp |
| 2681 | LYD195 | gerbera|09v1|AJ762598_P1 | 6310 | 628 | 81 | globlastp |
| 2682 | LYD195 | cassava|09v1|DV448480_T1 | 6311 | 628 | 80.97 | glotblastn |
| 2683 | LYD195 | cassava|09v1|DV443819_P1 | 6312 | 628 | 80.9 | globlastp |
| 2684 | LYD195 | spruce|gb162|CO226032_T1 | 6313 | 628 | 80.82 | glotblastn |
| 2685 | LYD195 | pine|10v1|AA556630_T1 | 6314 | 628 | 80.82 | glotblastn |
| 2686 | LYD195 | switchgrass|gb167|DN140691_T1 | 6315 | 628 | 80.82 | glotblastn |
| 2686 | LYD211 | switchgrass|gb167|DN140691_P1 | 6315 | 638 | 95.4 | globlastp |
| 2687 | LYD195 | switchgrass|gb167|DN143927_T1 | 6316 | 628 | 80.82 | glotblastn |
| 2687 | LYD211 | switchgrass|gb167|DN143927_P1 | 6316 | 638 | 93.9 | globlastp |
| 2688 | LYD195 | dandelion|gb161|DY813534_P1 | 6317 | 628 | 80.8 | globlastp |
| 2689 | LYD195 | arabidopsis_lyrata|09v1|JGIAL024592_P1 | 6318 | 628 | 80.7 | globlastp |
| 2689 | LYD211 | arabidopsis_lyrata|09v1|JGIAL024592_P1 | 6318 | 638 | 80.2 | globlastp |
| 2690 | LYD195 | arabidopsis|10v1|AT4G34050_P1 | 6318 | 628 | 80.7 | globlastp |
| 2690 | LYD211 | arabidopsis|10v1|AT4G34050_P1 | 6318 | 638 | 80.2 | globlastp |
| 2691 | LYD195 | arabidopsis|gb165|AT4G34050_P1 | 6318 | 628 | 80.7 | globlastp |
| 2691 | LYD211 | arabidopsis|gb165|AT4G34050_P1 | 6318 | 638 | 80.2 | globlastp |
| 2692 | LYD195 | pine|10v1|AI812878_T1 | 6319 | 628 | 80.41 | glotblastn |
| 2693 | LYD195 | pine|gb157.2|AA556630_T1 | 6320 | 628 | 80.41 | glotblastn |
| 2694 | LYD195 | pine|gb157.2|AL750465_T1 | 6321 | 628 | 80.41 | glotblastn |
| 2695 | LYD195 | artemisia|10v1|EY053286_P1 | 6322 | 628 | 80.4 | globlastp |
| 2696 | LYD195 | cassava|gb164|DV448480_T1 | 6323 | 628 | 80.16 | glotblastn |
| 2697 | LYD195 | fescue|gb161|DT707061_T1 | 6324 | 628 | 80.08 | glotblastn |
| 2697 | LYD211 | fescue|gb161|DT707061_P1 | 6324 | 638 | 82.3 | globlastp |
| 2698 | LYD195 | castorbean|09v1|XM002523572_T1 | 6325 | 628 | 80 | glotblastn |
| 2699 | LYD196 | sorghum|09v1|SB01G046160_T1 | 6326 | 629 | 96.47 | glotblastn |
| 2700 | LYD197 | arabidopsis_lyrata|09v1|JGIAL031045_P1 | 6327 | 630 | 92.9 | globlastp |
| 2701 | LYD200 | canola|10v1|EE435493_P1 | 6328 | 631 | 93.3 | globlastp |
| 2702 | LYD200 | canola|gb161|EE435493_P1 | 6328 | 631 | 93.3 | globlastp |
| 2703 | LYD200 | b_rapa|gb162|L35788_P1 | 6329 | 631 | 90 | globlastp |
| 2704 | LYD201 | b_oleracea|gb161|DY023468_P1 | 632 | 632 | 100 | globlastp |
| 2705 | LYD201 | b_rapa|gb162|L33494_P1 | 632 | 632 | 100 | globlastp |
| 2706 | LYD201 | canola|gb161|CD814222_P1 | 632 | 632 | 100 | globlastp |
| 2707 | LYD201 | radish|gb164|EV536280_P1 | 632 | 632 | 100 | globlastp |
| 2708 | LYD201 | radish|gb164|EV543503_P1 | 632 | 632 | 100 | globlastp |
| 2709 | LYD201 | canola|10v1|CN736580_P1 | 6330 | 632 | 99.5 | globlastp |
| 2710 | LYD201 | b_rapa|gb162|CX266259_P1 | 6330 | 632 | 99.5 | globlastp |
| 2711 | LYD201 | canola|10v1|CD814222_P1 | 6331 | 632 | 99.5 | globlastp |
| 2712 | LYD201 | canola|gb161|CD822065_P1 | 6331 | 632 | 99.5 | globlastp |
| 2713 | LYD201 | canola|gb161|CN736580_P1 | 6330 | 632 | 99.5 | globlastp |
| 2714 | LYD201 | canola|10v1|H74733_P1 | 6330 | 632 | 99.5 | globlastp |
| 2715 | LYD201 | canola|gb161|H74733_P1 | 6330 | 632 | 99.5 | globlastp |
| 2716 | LYD201 | radish|gb164|EV535404_P1 | 6330 | 632 | 99.5 | globlastp |
| 2717 | LYD201 | arabidopsis_lyrata|09v1|JGIAL000178_P1 | 6332 | 632 | 97.9 | globlastp |
| 2718 | LYD201 | arabidopsis_lyrata|09v1|JGIAL023653_P1 | 6333 | 632 | 97.9 | globlastp |
| 2719 | LYD201 | arabidopsis|10v1|AT4G02080_P1 | 6334 | 632 | 97.9 | globlastp |
| 2720 | LYD201 | arabidopsis|gb165|AT4G02080_P1 | 6334 | 632 | 97.9 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2721 | LYD201 | apple\|gb171\|CN578516_P1 | 6335 | 632 | 96.9 | globlastp |
| 2722 | LYD201 | citrus\|gb166\|BE213489_P1 | 6336 | 632 | 96.9 | globlastp |
| 2723 | LYD201 | strawberry\|gb164\|CO381157_P1 | 6337 | 632 | 96.9 | globlastp |
| 2724 | LYD201 | cassava\|09v1\|DB923790_P1 | 6338 | 632 | 96.4 | globlastp |
| 2725 | LYD201 | cleome_spinosa\|10v1\|GR935463_P1 | 6339 | 632 | 96.4 | globlastp |
| 2726 | LYD201 | cucumber\|09v1\|EB714467_P1 | 6340 | 632 | 96.4 | globlastp |
| 2727 | LYD201 | melon\|10v1\|EB714467_P1 | 6341 | 632 | 96.4 | globlastp |
| 2728 | LYD201 | nasturtium\|10v1\|GH166857_P1 | 6342 | 632 | 96.4 | globlastp |
| 2729 | LYD201 | apple\|gb171\|CN495817_P1 | 6343 | 632 | 96.4 | globlastp |
| 2730 | LYD201 | cassava\|09v1\|DV456795_P1 | 6344 | 632 | 96.4 | globlastp |
| 2731 | LYD201 | cassava\|gb164\|DV456795_P1 | 6344 | 632 | 96.4 | globlastp |
| 2732 | LYD201 | castorbean\|09v1\|EE257238_P1 | 6345 | 632 | 96.4 | globlastp |
| 2733 | LYD201 | grape\|gb160\|BQ792627_P1 | 6346 | 632 | 96.4 | globlastp |
| 2734 | LYD201 | medicago\|09v1\|AW329400_P1 | 6347 | 632 | 96.4 | globlastp |
| 2735 | LYD201 | melon\|gb165\|EB714467_P1 | 6341 | 632 | 96.4 | globlastp |
| 2736 | LYD201 | cucumber\|09v1\|AM714944_P1 | 6348 | 632 | 95.9 | globlastp |
| 2737 | LYD201 | millet\|10v1\|EVO454PM015862_P1 | 6349 | 632 | 95.9 | globlastp |
| 2738 | LYD201 | apple\|gb171\|CN580897_P1 | 6350 | 632 | 95.9 | globlastp |
| 2739 | LYD201 | poplar\|10v1\|AI164063_P1 | 6351 | 632 | 95.9 | globlastp |
| 2740 | LYD201 | poplar\|gb170\|AI164063_P1 | 6351 | 632 | 95.9 | globlastp |
| 2741 | LYD201 | poplar\|10v1\|BU821219_P1 | 6352 | 632 | 95.9 | globlastp |
| 2742 | LYD201 | poplar\|gb170\|BU821219_P1 | 6352 | 632 | 95.9 | globlastp |
| 2743 | LYD201 | jatropha\|09v1\|GT228862_T1 | 6353 | 632 | 95.85 | glotblastn |
| 2744 | LYD201 | brachypodium\|09v1\|DV481100_P1 | 6354 | 632 | 95.3 | globlastp |
| 2745 | LYD201 | cleome_gynandra\|10v1\|SRR015532S0002941_P1 | 6355 | 632 | 95.3 | globlastp |
| 2746 | LYD201 | heritiera\|10v1\|SRR005794S0002344_P1 | 6356 | 632 | 95.3 | globlastp |
| 2747 | LYD201 | heritiera\|10v1\|SRR005795S0007601_P1 | 6357 | 632 | 95.3 | globlastp |
| 2748 | LYD201 | melon\|10v1\|AM714944_P1 | 6358 | 632 | 95.3 | globlastp |
| 2749 | LYD201 | melon\|10v1\|DV635115_P1 | 6359 | 632 | 95.3 | globlastp |
| 2750 | LYD201 | millet\|10v1\|CD725311_P1 | 6354 | 632 | 95.3 | globlastp |
| 2751 | LYD201 | oak\|10v1\|FP041158_P1 | 6360 | 632 | 95.3 | globlastp |
| 2752 | LYD201 | apple\|gb171\|CN488933_P1 | 6361 | 632 | 95.3 | globlastp |
| 2753 | LYD201 | apple\|gb171\|CN495761_P1 | 6362 | 632 | 95.3 | globlastp |
| 2754 | LYD201 | barley\|gb157SOLEXA\|BE411202_P1 | 6363 | 632 | 95.3 | globlastp |
| 2755 | LYD201 | brachypodium\|gb169\|BE412821_P1 | 6354 | 632 | 95.3 | globlastp |
| 2756 | LYD201 | cacao\|gb167\|CF972901_P1 | 6364 | 632 | 95.3 | globlastp |
| 2757 | LYD201 | castorbean\|09v1\|EE257230_P1 | 6365 | 632 | 95.3 | globlastp |
| 2758 | LYD201 | cenchrus\|gb166\|EB655029_P1 | 6354 | 632 | 95.3 | globlastp |
| 2759 | LYD201 | chestnut\|gb170\|SRR006295S0004786_P1 | 6366 | 632 | 95.3 | globlastp |
| 2760 | LYD201 | citrus\|gb166\|CF418356_P1 | 6367 | 632 | 95.3 | globlastp |
| 2761 | LYD201 | citrus\|gb166\|CF506461_P1 | 6368 | 632 | 95.3 | globlastp |
| 2762 | LYD201 | cotton\|10v1\|AI726023_P1 | 6369 | 632 | 95.3 | globlastp |
| 2763 | LYD201 | cotton\|gb164\|AI726023_P1 | 6369 | 632 | 95.3 | globlastp |
| 2764 | LYD201 | cotton\|gb164\|DR455589_P1 | 6370 | 632 | 95.3 | globlastp |
| 2765 | LYD201 | eucalyptus\|gb166\|ES593417_P1 | 6371 | 632 | 95.3 | globlastp |
| 2766 | LYD201 | grape\|gb160\|BM437739_P1 | 6372 | 632 | 95.3 | globlastp |
| 2767 | LYD201 | lolium\|09v1\|ES699563_P1 | 6373 | 632 | 95.3 | globlastp |
| 2768 | LYD201 | lolium\|10v1\|ES699563_P1 | 6373 | 632 | 95.3 | globlastp |
| 2769 | LYD201 | maize\|10v1\|AW288509_P1 | 6354 | 632 | 95.3 | globlastp |
| 2770 | LYD201 | maize\|10v1\|T14655_P1 | 6354 | 632 | 95.3 | globlastp |
| 2771 | LYD201 | maize\|gb170\|T14655_P1 | 6354 | 632 | 95.3 | globlastp |
| 2772 | LYD201 | melon\|gb165\|DV635115_P1 | 6359 | 632 | 95.3 | globlastp |
| 2773 | LYD201 | oak\|gb170\|DB998925_P1 | 6360 | 632 | 95.3 | globlastp |
| 2774 | LYD201 | oak\|gb170\|SRR006307S0000395_P1 | 6360 | 632 | 95.3 | globlastp |
| 2775 | LYD201 | onion\|gb162\|CF446497_P1 | 6374 | 632 | 95.3 | globlastp |
| 2776 | LYD201 | sorghum\|09v1\|SB03G013550_P1 | 6354 | 632 | 95.3 | globlastp |
| 2777 | LYD201 | strawberry\|gb164\|EX661290_P1 | 6375 | 632 | 95.3 | globlastp |
| 2778 | LYD201 | sugarcane\|gb157.3\|CA071822_P1 | 6354 | 632 | 95.3 | globlastp |
| 2779 | LYD201 | sugarcane\|gb157.3\|CA119203_P1 | 6354 | 632 | 95.3 | globlastp |
| 2780 | LYD201 | switchgrass\|gb167\|DN143835_P1 | 6354 | 632 | 95.3 | globlastp |
| 2781 | LYD201 | switchgrass\|gb167\|DN144781_P1 | 6354 | 632 | 95.3 | globlastp |
| 2782 | LYD201 | wheat\|gb164\|BE426680_P1 | 6376 | 632 | 95.3 | globlastp |
| 2783 | LYD201 | sugarcane\|10v1\|CA071822_P1 | 6354 | 632 | 95.3 | globlastp |
| 2784 | LYD201 | oak\|10v1\|DB998925_T1 | 6377 | 632 | 94.82 | glotblastn |
| 2785 | LYD201 | grape\|gb160\|CA815541_T1 | 6378 | 632 | 94.82 | glotblastn |
| 2786 | LYD201 | arabidopsis_lyrata\|09v1\|JGIAL005252_P1 | 6379 | 632 | 94.8 | globlastp |
| 2787 | LYD201 | arabidopsis_lyrata\|09v1\|JGIAL019603_P1 | 6380 | 632 | 94.8 | globlastp |
| 2788 | LYD201 | cotton\|10v1\|DR455589_P1 | 6381 | 632 | 94.8 | globlastp |
| 2789 | LYD201 | cucumber\|09v1\|DV635115_P1 | 6382 | 632 | 94.8 | globlastp |
| 2790 | LYD201 | eggplant\|10v1\|FS000694_P1 | 6383 | 632 | 94.8 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2791 | LYD201 | oat\|10v2\|AF084005_P1 | 6384 | 632 | 94.8 | globlastp |
| 2792 | LYD201 | prunus\|10v1\|AF048825_P1 | 6385 | 632 | 94.8 | globlastp |
| 2793 | LYD201 | arabidopsis\|10v1\|AT1G56330_P1 | 6386 | 632 | 94.8 | globlastp |
| 2794 | LYD201 | barley\|10v1\|BE412821_P1 | 6387 | 632 | 94.8 | globlastp |
| 2795 | LYD201 | barley\|gb157SOLEXA\|BE412821_P1 | 6387 | 632 | 94.8 | globlastp |
| 2796 | LYD201 | cotton\|10v1\|BF277532_P1 | 6388 | 632 | 94.8 | globlastp |
| 2797 | LYD201 | cotton\|10v1\|BQ416087_P1 | 6389 | 632 | 94.8 | globlastp |
| 2798 | LYD201 | cowpea\|gb166\|FF386015_P1 | 6390 | 632 | 94.8 | globlastp |
| 2799 | LYD201 | ginger\|gb164\|DY349578_P1 | 6391 | 632 | 94.8 | globlastp |
| 2800 | LYD201 | pepper\|gb171\|CO908545_P1 | 6383 | 632 | 94.8 | globlastp |
| 2801 | LYD201 | poppy\|gb166\|FE964246_P1 | 6392 | 632 | 94.8 | globlastp |
| 2802 | LYD201 | poppy\|gb166\|FE965260_P1 | 6393 | 632 | 94.8 | globlastp |
| 2803 | LYD201 | potato\|10v1\|BG350081_P1 | 6383 | 632 | 94.8 | globlastp |
| 2804 | LYD201 | potato\|gb157.2\|BG350081_P1 | 6383 | 632 | 94.8 | globlastp |
| 2805 | LYD201 | prunus\|10v1\|BU047217_P1 | 6394 | 632 | 94.8 | globlastp |
| 2806 | LYD201 | prunus\|gb167\|BU047217_P1 | 6394 | 632 | 94.8 | globlastp |
| 2807 | LYD201 | pseudoroegneria\|gb167\|FF340041_P1 | 6395 | 632 | 94.8 | globlastp |
| 2808 | LYD201 | rose\|10v1\|BI977245_P1 | 6396 | 632 | 94.8 | globlastp |
| 2809 | LYD201 | rose\|gb157.2\|BI977245_P1 | 6396 | 632 | 94.8 | globlastp |
| 2810 | LYD201 | solanum_phureja\|09v1\|SPHBG123382_P1 | 6383 | 632 | 94.8 | globlastp |
| 2811 | LYD201 | soybean\|gb168\|CA907801_P1 | 6390 | 632 | 94.8 | globlastp |
| 2812 | LYD201 | strawberry\|gb164\|EX684999_P1 | 6397 | 632 | 94.8 | globlastp |
| 2813 | LYD201 | switchgrass\|gb167\|DN143500_P1 | 6398 | 632 | 94.8 | globlastp |
| 2814 | LYD201 | tomato\|09v1\|BG123382_P1 | 6399 | 632 | 94.8 | globlastp |
| 2815 | LYD201 | tomato\|gb164\|BG123382_P1 | 6399 | 632 | 94.8 | globlastp |
| 2816 | LYD201 | triphysaria\|10v1\|EY129553_P1 | 6400 | 632 | 94.8 | globlastp |
| 2817 | LYD201 | wheat\|gb164\|BE405729_P1 | 6401 | 632 | 94.8 | globlastp |
| 2818 | LYD201 | ipomoea_nil\|10v1\|BJ556321_P1 | 6402 | 632 | 94.3 | globlastp |
| 2819 | LYD201 | oat\|10v2\|GO588070_P1 | 6403 | 632 | 94.3 | globlastp |
| 2820 | LYD201 | orobanche\|10v1\|SRR023189S0020719_P1 | 6404 | 632 | 94.3 | globlastp |
| 2821 | LYD201 | rhizophora\|10v1\|SRR005792S0001094_P1 | 6405 | 632 | 94.3 | globlastp |
| 2822 | LYD201 | apple\|gb171\|CN580370_P1 | 6406 | 632 | 94.3 | globlastp |
| 2823 | LYD201 | apple\|gb171\|CN863209_P1 | 6407 | 632 | 94.3 | globlastp |
| 2824 | LYD201 | arabidopsis\|10v1\|AT3G62560_P1 | 6408 | 632 | 94.3 | globlastp |
| 2825 | LYD201 | banana\|10v1\|BBS1216T3_P1 | 6409 | 632 | 94.3 | globlastp |
| 2826 | LYD201 | banana\|10v1\|FF562066_P1 | 6410 | 632 | 94.3 | globlastp |
| 2827 | LYD201 | cacao\|gb167\|CU473711_P1 | 6411 | 632 | 94.3 | globlastp |
| 2828 | LYD201 | cacao\|gb167\|CU504692_P1 | 6412 | 632 | 94.3 | globlastp |
| 2829 | LYD201 | coffea\|10v1\|DV663797_P1 | 6413 | 632 | 94.3 | globlastp |
| 2830 | LYD201 | coffea\|gb157.2\|DV663797_P1 | 6413 | 632 | 94.3 | globlastp |
| 2831 | LYD201 | cotton\|10v1\|AI730854_P1 | 6414 | 632 | 94.3 | globlastp |
| 2832 | LYD201 | cotton\|gb164\|BF277532_P1 | 6415 | 632 | 94.3 | globlastp |
| 2833 | LYD201 | cotton\|gb164\|BQ416087_P1 | 6416 | 632 | 94.3 | globlastp |
| 2834 | LYD201 | iceplant\|gb164\|AW053482_P1 | 6417 | 632 | 94.3 | globlastp |
| 2835 | LYD201 | ipomoea\|gb157.2\|BJ556321_P1 | 6402 | 632 | 94.3 | globlastp |
| 2836 | LYD201 | kiwi\|gb166\|FG442511_P1 | 6418 | 632 | 94.3 | globlastp |
| 2837 | LYD201 | monkeyflower\|09v1\|DV210070_P1 | 6419 | 632 | 94.3 | globlastp |
| 2838 | LYD201 | monkeyflower\|10v1\|DV210070_P1 | 6419 | 632 | 94.3 | globlastp |
| 2839 | LYD201 | papaya\|gb165\|EX231956_P1 | 6420 | 632 | 94.3 | globlastp |
| 2840 | LYD201 | pea\|09v1\|CD860823_P1 | 6421 | 632 | 94.3 | globlastp |
| 2841 | LYD201 | poplar\|10v1\|BI070125_P1 | 6422 | 632 | 94.3 | globlastp |
| 2842 | LYD201 | poplar\|gb170\|BI070125_P1 | 6422 | 632 | 94.3 | globlastp |
| 2843 | LYD201 | poplar\|10v1\|BI126257_P1 | 6423 | 632 | 94.3 | globlastp |
| 2844 | LYD201 | prunus\|10v1\|BU043075_P1 | 6424 | 632 | 94.3 | globlastp |
| 2845 | LYD201 | prunus\|gb167\|BU043075_P1 | 6424 | 632 | 94.3 | globlastp |
| 2846 | LYD201 | prunus\|10v1\|BU047261_P1 | 6425 | 632 | 94.3 | globlastp |
| 2847 | LYD201 | prunus\|gb167\|BU047261_P1 | 6425 | 632 | 94.3 | globlastp |
| 2848 | LYD201 | rice\|gb170\|OS01G23620_P1 | 6426 | 632 | 94.3 | globlastp |
| 2849 | LYD201 | thellungiella\|gb167\|DN775726_P1 | 6427 | 632 | 94.3 | globlastp |
| 2850 | LYD201 | cucumber\|09v1\|AM736613_P1 | 6428 | 632 | 93.8 | globlastp |
| 2851 | LYD201 | curcuma\|10v1\|DY383352_P1 | 6429 | 632 | 93.8 | globlastp |
| 2852 | LYD201 | eggplant\|10v1\|FS011441_P1 | 6430 | 632 | 93.8 | globlastp |
| 2853 | LYD201 | melon\|10v1\|AM736613_P1 | 6428 | 632 | 93.8 | globlastp |
| 2854 | LYD201 | nasturtium\|10v1\|SRR032558S0063645_P1 | 6431 | 632 | 93.8 | globlastp |
| 2855 | LYD201 | oak\|10v1\|FP039659_P1 | 6432 | 632 | 93.8 | globlastp |
| 2856 | LYD201 | pigeonpea\|10v1\|GW348949_P1 | 6433 | 632 | 93.8 | globlastp |
| 2857 | LYD201 | salvia\|10v1\|SRR014553S0002915_P1 | 6434 | 632 | 93.8 | globlastp |
| 2858 | LYD201 | tragopogon\|10v1\|SRR020205S0011036_P1 | 6435 | 632 | 93.8 | globlastp |
| 2859 | LYD201 | amborella\|gb166\|CD482203_P1 | 6436 | 632 | 93.8 | globlastp |
| 2860 | LYD201 | banana\|gb167\|FF562066_P1 | 6437 | 632 | 93.8 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2861 | LYD201 | basilicum\|10v1\|DY342472_P1 | 6438 | 632 | 93.8 | globlastp |
| 2862 | LYD201 | cassava\|09v1\|DV458296_P1 | 6439 | 632 | 93.8 | globlastp |
| 2863 | LYD201 | cassava\|gb164\|DR085772_P1 | 6439 | 632 | 93.8 | globlastp |
| 2864 | LYD201 | cassava\|09v1\|DV441309_P1 | 6440 | 632 | 93.8 | globlastp |
| 2865 | LYD201 | cassava\|gb164\|DV441309_P1 | 6440 | 632 | 93.8 | globlastp |
| 2866 | LYD201 | castorbean\|09v1\|EV521574_P1 | 6441 | 632 | 93.8 | globlastp |
| 2867 | LYD201 | chestnut\|gb170\|SRR006295S0016299_P1 | 6442 | 632 | 93.8 | globlastp |
| 2868 | LYD201 | coffea\|10v1\|CF588658_P1 | 6443 | 632 | 93.8 | globlastp |
| 2869 | LYD201 | coffea\|gb157.2\|CF588658_P1 | 6443 | 632 | 93.8 | globlastp |
| 2870 | LYD201 | cotton\|10v1\|AI728302_P1 | 6444 | 632 | 93.8 | globlastp |
| 2871 | LYD201 | cotton\|gb164\|AI730854_P1 | 6445 | 632 | 93.8 | globlastp |
| 2872 | LYD201 | cowpea\|gb166\|FC461231_P1 | 6446 | 632 | 93.8 | globlastp |
| 2873 | LYD201 | eucalyptus\|gb166\|CT980876_P1 | 6447 | 632 | 93.8 | globlastp |
| 2874 | LYD201 | ginger\|gb164\|DY361206_P1 | 6429 | 632 | 93.8 | globlastp |
| 2875 | LYD201 | medicago\|09v1\|LLAJ389002_P1 | 6448 | 632 | 93.8 | globlastp |
| 2876 | LYD201 | melon\|gb165\|AM714944_P1 | 6449 | 632 | 93.8 | globlastp |
| 2877 | LYD201 | nuphar\|gb166\|CK746937_P1 | 6450 | 632 | 93.8 | globlastp |
| 2878 | LYD201 | oak\|gb170\|SRR006307S0016171_P1 | 6451 | 632 | 93.8 | globlastp |
| 2879 | LYD201 | peanut\|10v1\|ES722249_P1 | 6452 | 632 | 93.8 | globlastp |
| 2880 | LYD201 | pepper\|gb171\|BM059626_P1 | 6430 | 632 | 93.8 | globlastp |
| 2881 | LYD201 | poplar\|10v1\|BU861778_P1 | 6453 | 632 | 93.8 | globlastp |
| 2882 | LYD201 | poplar\|gb170\|BU861778_P1 | 6453 | 632 | 93.8 | globlastp |
| 2883 | LYD201 | radish\|gb164\|EX772918_P1 | 6454 | 632 | 93.8 | globlastp |
| 2884 | LYD201 | solanum_phureja\|09v1\|SPHAW034613_P1 | 6455 | 632 | 93.8 | globlastp |
| 2885 | LYD201 | sorghum\|09v1\|SB0111S002010_P1 | 6456 | 632 | 93.8 | globlastp |
| 2886 | LYD201 | soybean\|gb168\|AW329400_P1 | 6457 | 632 | 93.8 | globlastp |
| 2887 | LYD201 | soybean\|gb168\|BE239992_P1 | 6458 | 632 | 93.8 | globlastp |
| 2888 | LYD201 | sugarcane\|10v1\|BQ536213_P1 | 6456 | 632 | 93.8 | globlastp |
| 2889 | LYD201 | sugarcane\|gb157.3\|BQ536213_P1 | 6459 | 632 | 93.8 | globlastp |
| 2890 | LYD201 | sunflower\|10v1\|DY925572_P1 | 6460 | 632 | 93.8 | globlastp |
| 2891 | LYD201 | sunflower\|gb162\|DY925572_P1 | 6460 | 632 | 93.8 | globlastp |
| 2892 | LYD201 | switchgrass\|gb167\|FL890345_P1 | 6461 | 632 | 93.8 | globlastp |
| 2893 | LYD201 | switchgrass\|gb167\|FL925071_P1 | 6462 | 632 | 93.8 | globlastp |
| 2894 | LYD201 | tomato\|09v1\|AW034613_P1 | 6455 | 632 | 93.8 | globlastp |
| 2895 | LYD201 | tomato\|gb164\|AW034613_P1 | 6455 | 632 | 93.8 | globlastp |
| 2896 | LYD201 | triphysaria\|10v1\|EX983317_P1 | 6463 | 632 | 93.8 | globlastp |
| 2897 | LYD201 | triphysaria\|gb164\|EX983317_P1 | 6463 | 632 | 93.8 | globlastp |
| 2898 | LYD201 | triphysaria\|10v1\|EY126729_P1 | 6464 | 632 | 93.8 | globlastp |
| 2899 | LYD201 | triphysaria\|gb164\|EY126729_P1 | 6464 | 632 | 93.8 | globlastp |
| 2900 | LYD201 | triphysaria\|gb164\|EY129553_P1 | 6465 | 632 | 93.8 | globlastp |
| 2901 | LYD201 | canola\|10v1\|FG554744_P1 | 6466 | 632 | 93.3 | globlastp |
| 2902 | LYD201 | cleome_spinosa\|10v1\|GR931642_P1 | 6467 | 632 | 93.3 | globlastp |
| 2903 | LYD201 | heritiera\|10v1\|SRR005794S0007553_P1 | 6468 | 632 | 93.3 | globlastp |
| 2904 | LYD201 | ipomoea_nil\|10v1\|BJ553656_P1 | 6469 | 632 | 93.3 | globlastp |
| 2905 | LYD201 | lettuce\|10v1\|DW074507_P1 | 6470 | 632 | 93.3 | globlastp |
| 2906 | LYD201 | salvia\|10v1\|CV163233_P1 | 6471 | 632 | 93.3 | globlastp |
| 2907 | LYD201 | tea\|10v1\|GE651401_P1 | 6472 | 632 | 93.3 | globlastp |
| 2908 | LYD201 | tragopogon\|10v1\|SRR020205S0016454_P1 | 6473 | 632 | 93.3 | globlastp |
| 2909 | LYD201 | antirrhinum\|gb166\|AJ559518_P1 | 6474 | 632 | 93.3 | globlastp |
| 2910 | LYD201 | apple\|gb171\|AF048825_P1 | 6475 | 632 | 93.3 | globlastp |
| 2911 | LYD201 | b_rapa\|gb162\|BCU55036_P1 | 6466 | 632 | 93.3 | globlastp |
| 2912 | LYD201 | canola\|10v1\|CD812447_P1 | 6466 | 632 | 93.3 | globlastp |
| 2913 | LYD201 | canola\|gb161\|CD812447_P1 | 6466 | 632 | 93.3 | globlastp |
| 2914 | LYD201 | canola\|10v1\|DY006847_P1 | 6466 | 632 | 93.3 | globlastp |
| 2915 | LYD201 | canola\|gb161\|DY006847_P1 | 6466 | 632 | 93.3 | globlastp |
| 2916 | LYD201 | cassava\|09v1\|DR085772_P1 | 6476 | 632 | 93.3 | globlastp |
| 2917 | LYD201 | cassava\|gb164\|DR086941_P1 | 6477 | 632 | 93.3 | globlastp |
| 2918 | LYD201 | centaurea\|gb166\|EH714735_P1 | 6470 | 632 | 93.3 | globlastp |
| 2919 | LYD201 | centaurea\|gb166\|EH755488_P1 | 6470 | 632 | 93.3 | globlastp |
| 2920 | LYD201 | cichorium\|gb171\|DT212637_P1 | 6470 | 632 | 93.3 | globlastp |
| 2921 | LYD201 | cichorium\|gb171\|EH689329_P1 | 6478 | 632 | 93.3 | globlastp |
| 2922 | LYD201 | cotton\|gb164\|AI728302_P1 | 6479 | 632 | 93.3 | globlastp |
| 2923 | LYD201 | cowpea\|gb166\|FC457632_P1 | 6480 | 632 | 93.3 | globlastp |
| 2924 | LYD201 | cynara\|gb167\|GE587803_P1 | 6470 | 632 | 93.3 | globlastp |
| 2925 | LYD201 | dandelion\|10v1\|DR399381_P1 | 6470 | 632 | 93.3 | globlastp |
| 2926 | LYD201 | dandelion\|gb161\|DY807874_P1 | 6470 | 632 | 93.3 | globlastp |
| 2927 | LYD201 | ipomoea\|gb157.2\|BJ553656_P1 | 6469 | 632 | 93.3 | globlastp |
| 2928 | LYD201 | lettuce\|gb157.2\|DW074507_P1 | 6470 | 632 | 93.3 | globlastp |
| 2929 | LYD201 | lettuce\|gb157.2\|DW112970_P1 | 6473 | 632 | 93.3 | globlastp |
| 2930 | LYD201 | lettuce\|gb157.2\|DW145079_P1 | 6473 | 632 | 93.3 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 2931 | LYD201 | lotus\|09v1\|LLAI967735_P1 | 6481 | 632 | 93.3 | globlastp |
| 2932 | LYD201 | peanut\|10v1\|ES718834_P1 | 6482 | 632 | 93.3 | globlastp |
| 2933 | LYD201 | peanut\|gb171\|EH045041_P1 | 6482 | 632 | 93.3 | globlastp |
| 2934 | LYD201 | peanut\|10v1\|ES721921_P1 | 6483 | 632 | 93.3 | globlastp |
| 2935 | LYD201 | potato\|gb157.2\|BF459589_P1 | 6484 | 632 | 93.3 | globlastp |
| 2936 | LYD201 | radish\|gb164\|EV535849_P1 | 6466 | 632 | 93.3 | globlastp |
| 2937 | LYD201 | rice\|gb170\|OS01G15010_P1 | 6485 | 632 | 93.3 | globlastp |
| 2938 | LYD201 | rice\|gb170\|OS12G37360_P1 | 6486 | 632 | 93.3 | globlastp |
| 2939 | LYD201 | safflower\|gb162\|EL392690_P1 | 6470 | 632 | 93.3 | globlastp |
| 2940 | LYD201 | senecio\|gb170\|DY659667_P1 | 6487 | 632 | 93.3 | globlastp |
| 2941 | LYD201 | solanum_phureja\|09v1\|SPHBG130022_P1 | 6484 | 632 | 93.3 | globlastp |
| 2942 | LYD201 | sunflower\|gb162\|CD852926_P1 | 6470 | 632 | 93.3 | globlastp |
| 2943 | LYD201 | sunflower\|10v1\|CD852926_P1 | 6470 | 632 | 93.3 | globlastp |
| 2944 | LYD201 | sunflower\|gb162\|EL441563_P1 | 6470 | 632 | 93.3 | globlastp |
| 2945 | LYD201 | tea\|gb171\|CV066987_P1 | 6472 | 632 | 93.3 | globlastp |
| 2946 | LYD201 | tomato\|09v1\|BG130022_P1 | 6484 | 632 | 93.3 | globlastp |
| 2947 | LYD201 | tomato\|gb164\|BG130022_P1 | 6484 | 632 | 93.3 | globlastp |
| 2948 | LYD201 | lettuce\|10v1\|DW055345_P1 | 6473 | 632 | 93.3 | globlastp |
| 2949 | LYD201 | potato\|10v1\|BF459589_P1 | 6484 | 632 | 93.3 | globlastp |
| 2950 | LYD201 | eucalyptus\|gb166\|CT987357_T1 | 6488 | 632 | 93.26 | glotblastn |
| 2951 | LYD201 | b_juncea\|10v2\|E6ANDIZ01BLEAU_P1 | 6489 | 632 | 92.8 | globlastp |
| 2952 | LYD201 | b_rapa\|gb162\|ES932634_P1 | 6489 | 632 | 92.8 | globlastp |
| 2953 | LYD201 | canola\|gb161\|DY010851_P1 | 6489 | 632 | 92.8 | globlastp |
| 2954 | LYD201 | radish\|gb164\|EV543721_P1 | 6489 | 632 | 92.8 | globlastp |
| 2955 | LYD201 | radish\|gb164\|EX770221_P1 | 6489 | 632 | 92.8 | globlastp |
| 2956 | LYD201 | canola\|10v1\|DY010851_P1 | 6489 | 632 | 92.8 | globlastp |
| 2957 | LYD201 | ipomoea_batatas\|10v1\|EE882235_T1 | 6490 | 632 | 92.75 | glotblastn |
| 2958 | LYD201 | pigeonpea\|10v1\|GW359950_T1 | 6491 | 632 | 92.75 | glotblastn |
| 2959 | LYD201 | pigeonpea\|10v1\|SRR054580S0024079_T1 | 6492 | 632 | 92.75 | glotblastn |
| 2960 | LYD201 | triphysaria\|10v1\|EX999862_T1 | 6493 | 632 | 92.75 | glotblastn |
| 2961 | LYD201 | melon\|gb165\|AM736613_T1 | 6494 | 632 | 92.75 | glotblastn |
| 2962 | LYD201 | aquilegia\|10v1\|DR922692_P1 | 6495 | 632 | 92.7 | globlastp |
| 2963 | LYD201 | ipomoea_nil\|10v1\|BJ554402_P1 | 6496 | 632 | 92.7 | globlastp |
| 2964 | LYD201 | nasturtium\|10v1\|SRR032558S0002294_P1 | 6497 | 632 | 92.7 | globlastp |
| 2965 | LYD201 | triphysaria\|10v1\|DR172714_P1 | 6498 | 632 | 92.7 | globlastp |
| 2966 | LYD201 | antirrhinum\|gb166\|AJ559528_P1 | 6499 | 632 | 92.7 | globlastp |
| 2967 | LYD201 | avocado\|10v1\|CO998056_P1 | 6500 | 632 | 92.7 | globlastp |
| 2968 | LYD201 | avocado\|gb164\|CO998056_P1 | 6500 | 632 | 92.7 | globlastp |
| 2969 | LYD201 | basilicum\|gb157.3\|DY342472_P1 | 6501 | 632 | 92.7 | globlastp |
| 2970 | LYD201 | bean\|gb167\|CA898565_P1 | 6502 | 632 | 92.7 | globlastp |
| 2971 | LYD201 | bean\|gb167\|CA907815_P1 | 6503 | 632 | 92.7 | globlastp |
| 2972 | LYD201 | bean\|gb167\|CA907901_P1 | 6504 | 632 | 92.7 | globlastp |
| 2973 | LYD201 | beet\|gb162\|BQ489381_P1 | 6505 | 632 | 92.7 | globlastp |
| 2974 | LYD201 | brachypodium\|09v1\|DV484252_P1 | 6506 | 632 | 92.7 | globlastp |
| 2975 | LYD201 | brachypodium\|gb169\|BE405729_P1 | 6506 | 632 | 92.7 | globlastp |
| 2976 | LYD201 | canola\|gb161\|DY010564_P1 | 6507 | 632 | 92.7 | globlastp |
| 2977 | LYD201 | chickpea\|09v2\|GR403699_P1 | 6508 | 632 | 92.7 | globlastp |
| 2978 | LYD201 | cotton\|10v1\|AI726130_P1 | 6509 | 632 | 92.7 | globlastp |
| 2979 | LYD201 | cryptomeria\|gb166\|BJ940282_P1 | 6510 | 632 | 92.7 | globlastp |
| 2980 | LYD201 | cynara\|gb167\|GE585770_P1 | 6511 | 632 | 92.7 | globlastp |
| 2981 | LYD201 | ipomoea\|gb157.2\|BJ554402_P1 | 6496 | 632 | 92.7 | globlastp |
| 2982 | LYD201 | kiwi\|gb166\|FG431590_P1 | 6512 | 632 | 92.7 | globlastp |
| 2983 | LYD201 | lettuce\|gb157.2\|DW055345_P1 | 6513 | 632 | 92.7 | globlastp |
| 2984 | LYD201 | liquorice\|gb171\|FS244269_P1 | 6514 | 632 | 92.7 | globlastp |
| 2985 | LYD201 | lotus\|09v1\|BP071405_P1 | 6515 | 632 | 92.7 | globlastp |
| 2986 | LYD201 | peanut\|10v1\|EE124259_P1 | 6516 | 632 | 92.7 | globlastp |
| 2987 | LYD201 | peanut\|gb171\|EE124259_P1 | 6516 | 632 | 92.7 | globlastp |
| 2988 | LYD201 | pepper\|gb171\|CA520057_P1 | 6517 | 632 | 92.7 | globlastp |
| 2989 | LYD201 | petunia\|gb171\|CV293121_P1 | 6518 | 632 | 92.7 | globlastp |
| 2990 | LYD201 | poppy\|gb166\|FG607099_P1 | 6519 | 632 | 92.7 | globlastp |
| 2991 | LYD201 | potato\|gb157.2\|BG595658_P1 | 6520 | 632 | 92.7 | globlastp |
| 2992 | LYD201 | safflower\|gb162\|EL399824_P1 | 6521 | 632 | 92.7 | globlastp |
| 2993 | LYD201 | soybean\|gb168\|AI967735_P1 | 6522 | 632 | 92.7 | globlastp |
| 2994 | LYD201 | soybean\|gb168\|AJ389002_P1 | 6523 | 632 | 92.7 | globlastp |
| 2995 | LYD201 | soybean\|gb168\|AL375445_P1 | 6524 | 632 | 92.7 | globlastp |
| 2996 | LYD201 | soybean\|gb168\|CF922718_P1 | 6525 | 632 | 92.7 | globlastp |
| 2997 | LYD201 | spurge\|gb161\|DV112769_P1 | 6526 | 632 | 92.7 | globlastp |
| 2998 | LYD201 | switchgrass\|gb167\|DN140651_P1 | 6527 | 632 | 92.7 | globlastp |
| 2999 | LYD201 | switchgrass\|gb167\|DN141173_P1 | 6527 | 632 | 92.7 | globlastp |
| 3000 | LYD201 | tobacco\|gb162\|BP192482_P1 | 6528 | 632 | 92.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3001 | LYD201 | tobacco\|gb162\|D87821_P1 | 6528 | 632 | 92.7 | globlastp |
| 3002 | LYD201 | tobacco\|gb162\|NTU46928_P1 | 6529 | 632 | 92.7 | globlastp |
| 3003 | LYD201 | walnuts\|gb166\|CV195326_P1 | 6530 | 632 | 92.7 | globlastp |
| 3004 | LYD201 | radish\|gb164\|EV528328_P1 | 6531 | 632 | 92.3 | globlastp |
| 3005 | LYD201 | chestnut\|gb170\|SRR006295S0022297_T1 | 6532 | 632 | 92.23 | glotblastn |
| 3006 | LYD201 | cassava\|09v1\|FG805794_P1 | 6533 | 632 | 92.2 | globlastp |
| 3007 | LYD201 | curcuma\|10v1\|DY389286_P1 | 6534 | 632 | 92.2 | globlastp |
| 3008 | LYD201 | millet\|10v1\|EVO454PM010619_P1 | 6535 | 632 | 92.2 | globlastp |
| 3009 | LYD201 | orobanche\|10v1\|SRR023189S0005863_P1 | 6536 | 632 | 92.2 | globlastp |
| 3010 | LYD201 | tragopogon\|10v1\|SRR020205S0008368_P1 | 6537 | 632 | 92.2 | globlastp |
| 3011 | LYD201 | bean\|gb167\|CA907810_P1 | 6538 | 632 | 92.2 | globlastp |
| 3012 | LYD201 | centaurea\|gb166\|EH724820_P1 | 6539 | 632 | 92.2 | globlastp |
| 3013 | LYD201 | centaurea\|gb166\|EH737464_P1 | 6540 | 632 | 92.2 | globlastp |
| 3014 | LYD201 | cowpea\|gb166\|ES884134_P1 | 6538 | 632 | 92.2 | globlastp |
| 3015 | LYD201 | lettuce\|10v1\|DW117562_P1 | 6541 | 632 | 92.2 | globlastp |
| 3016 | LYD201 | lettuce\|gb157.2\|DW117562_P1 | 6541 | 632 | 92.2 | globlastp |
| 3017 | LYD201 | maize\|10v1\|AI947720_P1 | 6542 | 632 | 92.2 | globlastp |
| 3018 | LYD201 | maize\|gb170\|AI947720_P1 | 6542 | 632 | 92.2 | globlastp |
| 3019 | LYD201 | papaya\|gb165\|EX261772_P1 | 6543 | 632 | 92.2 | globlastp |
| 3020 | LYD201 | pine\|10v1\|BE662420_P1 | 6544 | 632 | 92.2 | globlastp |
| 3021 | LYD201 | pine\|gb157.2\|BE662420_P1 | 6544 | 632 | 92.2 | globlastp |
| 3022 | LYD201 | radish\|gb164\|EV527447_P1 | 6545 | 632 | 92.2 | globlastp |
| 3023 | LYD201 | safflower\|gb162\|EL384996_P1 | 6539 | 632 | 92.2 | globlastp |
| 3024 | LYD201 | sorghum\|09v1\|SB03G009760_P1 | 6542 | 632 | 92.2 | globlastp |
| 3025 | LYD201 | soybean\|gb168\|AL370671_P1 | 6546 | 632 | 92.2 | globlastp |
| 3026 | LYD201 | soybean\|gb168\|BE659271_P1 | 6547 | 632 | 92.2 | globlastp |
| 3027 | LYD201 | spruce\|gb162\|CO217770_P1 | 6548 | 632 | 92.2 | globlastp |
| 3028 | LYD201 | sunflower\|10v1\|CD846865_P1 | 6549 | 632 | 92.2 | globlastp |
| 3029 | LYD201 | sunflower\|10v1\|CD848519_P1 | 6550 | 632 | 92.2 | globlastp |
| 3030 | LYD201 | sunflower\|gb162\|DY912940_P1 | 6550 | 632 | 92.2 | globlastp |
| 3031 | LYD201 | tea\|gb171\|GE650564_P1 | 6551 | 632 | 92.2 | globlastp |
| 3032 | LYD201 | tobacco\|gb162\|CV017890_P1 | 6552 | 632 | 92.2 | globlastp |
| 3033 | LYD201 | tobacco\|gb162\|X97967_P1 | 6552 | 632 | 92.2 | globlastp |
| 3034 | LYD201 | tea\|10v1\|CV067078_T1 | 6553 | 632 | 91.71 | glotblastn |
| 3035 | LYD201 | brachypodium\|09v1\|GT772462_P1 | 6554 | 632 | 91.7 | globlastp |
| 3036 | LYD201 | cotton\|10v1\|BQ406141_P1 | 6555 | 632 | 91.7 | globlastp |
| 3037 | LYD201 | dandelion\|10v1\|DR398699_P1 | 6556 | 632 | 91.7 | globlastp |
| 3038 | LYD201 | ipomoea_nil\|10v1\|BJ562653_P1 | 6557 | 632 | 91.7 | globlastp |
| 3039 | LYD201 | pigeonpea\|10v1\|SRR054580S0006204_P1 | 6558 | 632 | 91.7 | globlastp |
| 3040 | LYD201 | antirrhinum\|gb166\|AJ788613_P1 | 6559 | 632 | 91.7 | globlastp |
| 3041 | LYD201 | artemisia\|10v1\|EY048595_P1 | 6560 | 632 | 91.7 | globlastp |
| 3042 | LYD201 | b_juncea\|10v2\|E6ANDIZ01BI3CE_P1 | 6561 | 632 | 91.7 | globlastp |
| 3043 | LYD201 | b_juncea\|gb164\|EVGN00335318190411_P1 | 6561 | 632 | 91.7 | globlastp |
| 3044 | LYD201 | b_rapa\|gb162\|CA991946_P1 | 6561 | 632 | 91.7 | globlastp |
| 3045 | LYD201 | barley\|gb157SOLEXA\|BE411848_P1 | 6562 | 632 | 91.7 | globlastp |
| 3046 | LYD201 | canola\|10v1\|CD820737_P1 | 6561 | 632 | 91.7 | globlastp |
| 3047 | LYD201 | canola\|gb161\|CD820737_P1 | 6561 | 632 | 91.7 | globlastp |
| 3048 | LYD201 | cotton\|gb164\|BQ406141_P1 | 6555 | 632 | 91.7 | globlastp |
| 3049 | LYD201 | dandelion\|gb161\|DY808686_P1 | 6556 | 632 | 91.7 | globlastp |
| 3050 | LYD201 | ipomoea\|gb157.2\|BJ562653_P1 | 6563 | 632 | 91.7 | globlastp |
| 3051 | LYD201 | kiwi\|gb166\|FG404500_P1 | 6564 | 632 | 91.7 | globlastp |
| 3052 | LYD201 | lotus\|09v1\|BW597745_P1 | 6565 | 632 | 91.7 | globlastp |
| 3053 | LYD201 | medicago\|09v1\|AJ388771_P1 | 6566 | 632 | 91.7 | globlastp |
| 3054 | LYD201 | poplar\|gb170\|BI126257_P1 | 6567 | 632 | 91.7 | globlastp |
| 3055 | LYD201 | pseudoroegneria\|gb167\|FF340656_P1 | 6562 | 632 | 91.7 | globlastp |
| 3056 | LYD201 | radish\|gb164\|EV535478_P1 | 6561 | 632 | 91.7 | globlastp |
| 3057 | LYD201 | radish\|gb164\|EV565516_P1 | 6561 | 632 | 91.7 | globlastp |
| 3058 | LYD201 | radish\|gb164\|EW725190_P1 | 6568 | 632 | 91.7 | globlastp |
| 3059 | LYD201 | radish\|gb164\|EX902413_P1 | 6569 | 632 | 91.7 | globlastp |
| 3060 | LYD201 | rye\|gb164\|BE494444_P1 | 6562 | 632 | 91.7 | globlastp |
| 3061 | LYD201 | senecio\|gb170\|DY657889_P1 | 6570 | 632 | 91.7 | globlastp |
| 3062 | LYD201 | senecio\|gb170\|DY664540_P1 | 6571 | 632 | 91.7 | globlastp |
| 3063 | LYD201 | soybean\|gb168\|BI970298_P1 | 6572 | 632 | 91.7 | globlastp |
| 3064 | LYD201 | sugarcane\|10v1\|BQ530239_P1 | 6573 | 632 | 91.7 | globlastp |
| 3065 | LYD201 | sugarcane\|gb157.3\|BQ530239_P1 | 6573 | 632 | 91.7 | globlastp |
| 3066 | LYD201 | sunflower\|gb162\|CD846865_P1 | 6574 | 632 | 91.7 | globlastp |
| 3067 | LYD201 | wheat\|gb164\|BE500854_P1 | 6562 | 632 | 91.7 | globlastp |
| 3068 | LYD201 | wheat\|gb164\|BQ235923_P1 | 6562 | 632 | 91.7 | globlastp |
| 3069 | LYD201 | arabidopsis_lyrata\|09v1\|JGIAL000882_P1 | 6575 | 632 | 91.2 | globlastp |
| 3070 | LYD201 | cynodon\|10v1\|BG322359_P1 | 6576 | 632 | 91.2 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3071 | LYD201 | nasturtium\|10v1\|SRR032558S0000930_P1 | 6577 | 632 | 91.2 | globlastp |
| 3072 | LYD201 | canola\|10v1\|CD812048_P1 | 6578 | 632 | 91.2 | globlastp |
| 3073 | LYD201 | canola\|gb161\|CD812048_P1 | 6578 | 632 | 91.2 | globlastp |
| 3074 | LYD201 | canola\|10v1\|EL593228_P1 | 6579 | 632 | 91.2 | globlastp |
| 3075 | LYD201 | canola\|gb161\|EL593228_P1 | 6579 | 632 | 91.2 | globlastp |
| 3076 | LYD201 | centaurea\|gb166\|EH755694_P1 | 6580 | 632 | 91.2 | globlastp |
| 3077 | LYD201 | lettuce\|10v1\|DW070398_P1 | 6581 | 632 | 91.2 | globlastp |
| 3078 | LYD201 | lettuce\|gb157.2\|DW070398_P1 | 6581 | 632 | 91.2 | globlastp |
| 3079 | LYD201 | liquorice\|gb171\|FS247073_P1 | 6582 | 632 | 91.2 | globlastp |
| 3080 | LYD201 | monkeyflower\|09v1\|DV212911_P1 | 6583 | 632 | 91.2 | globlastp |
| 3081 | LYD201 | monkeyflower\|10v1\|DV212911_P1 | 6583 | 632 | 91.2 | globlastp |
| 3082 | LYD201 | spurge\|gb161\|DV113174_P1 | 6584 | 632 | 91.2 | globlastp |
| 3083 | LYD201 | tobacco\|gb162\|NTU46929_P1 | 6585 | 632 | 91.2 | globlastp |
| 3084 | LYD201 | banana\|gb167\|FF558115_T1 | 6586 | 632 | 91.19 | glotblastn |
| 3085 | LYD201 | cynara\|gb167\|GE585844_T1 | 6587 | 632 | 91.19 | glotblastn |
| 3086 | LYD201 | onion\|gb162\|CF435014_T1 | 6588 | 632 | 91.19 | glotblastn |
| 3087 | LYD201 | oat\|10v2\|GO582075_P1 | 6589 | 632 | 90.7 | globlastp |
| 3088 | LYD201 | pepper\|gb171\|CA514007_P1 | 6590 | 632 | 90.7 | globlastp |
| 3089 | LYD201 | oak\|10v1\|FN640780_P1 | 6591 | 632 | 90.5 | globlastp |
| 3090 | LYD201 | barley\|10v1\|BE411848_P1 | 6592 | 632 | 90.2 | globlastp |
| 3091 | LYD201 | citrus\|gb166\|CX076831_P1 | 6593 | 632 | 90.2 | globlastp |
| 3092 | LYD201 | tobacco\|gb162\|EB683024_P1 | 6594 | 632 | 90.2 | globlastp |
| 3093 | LYD201 | beet\|gb162\|BI543263_P1 | 6595 | 632 | 89.8 | globlastp |
| 3094 | LYD201 | arabidopsis\|10v1\|AT1G09180_P1 | 6596 | 632 | 89.6 | globlastp |
| 3095 | LYD201 | arabidopsis\|gb165\|AT1G09180_P1 | 6596 | 632 | 89.6 | globlastp |
| 3096 | LYD201 | cryptomeria\|gb166\|AU299041_P1 | 6597 | 632 | 89.6 | globlastp |
| 3097 | LYD201 | cycas\|gb166\|CB091054_P1 | 6598 | 632 | 89.6 | globlastp |
| 3098 | LYD201 | pine\|10v1\|AA739841_P1 | 6599 | 632 | 89.6 | globlastp |
| 3099 | LYD201 | pine\|gb157.2\|AA739841_P1 | 6599 | 632 | 89.6 | globlastp |
| 3100 | LYD201 | spruce\|gb162\|CO238693_P1 | 6600 | 632 | 89.6 | globlastp |
| 3101 | LYD201 | triphysaria\|10v1\|EY147779_P1 | 6601 | 632 | 89.6 | globlastp |
| 3102 | LYD201 | triphysaria\|gb164\|EY147779_P1 | 6601 | 632 | 89.6 | globlastp |
| 3103 | LYD201 | orobanche\|10v1\|SRR023189S0022597_P1 | 6602 | 632 | 89.1 | globlastp |
| 3104 | LYD201 | physcomitrella\|10v1\|BJ161116_P1 | 6603 | 632 | 89.1 | globlastp |
| 3105 | LYD201 | physcomitrella\|gb157\|BJ161116_P1 | 6603 | 632 | 89.1 | globlastp |
| 3106 | LYD201 | radish\|gb164\|EX771703_P1 | 6604 | 632 | 89.1 | globlastp |
| 3107 | LYD201 | physcomitrella\|10v1\|BQ827385_P1 | 6605 | 632 | 88.6 | globlastp |
| 3108 | LYD201 | avocado\|gb164\|FD509067_P1 | 6606 | 632 | 88.6 | globlastp |
| 3109 | LYD201 | ginger\|gb164\|DY346355_P1 | 6607 | 632 | 88.6 | globlastp |
| 3110 | LYD201 | peanut\|gb171\|ES722249_P1 | 6608 | 632 | 88.6 | globlastp |
| 3111 | LYD201 | potato\|10v1\|BG351944_P1 | 6609 | 632 | 88.6 | globlastp |
| 3112 | LYD201 | potato\|gb157.2\|BG351944_P1 | 6609 | 632 | 88.6 | globlastp |
| 3113 | LYD201 | solanum_phureja\|09v1\|SPHTOMGTPASE_P1 | 6609 | 632 | 88.6 | globlastp |
| 3114 | LYD201 | b_oleracea\|gb161\|AM062522_P1 | 6610 | 632 | 88.1 | globlastp |
| 3115 | LYD201 | marchantia\|gb166\|C95806_P1 | 6611 | 632 | 88.1 | globlastp |
| 3116 | LYD201 | petunia\|gb171\|CV300582_P1 | 6612 | 632 | 88.1 | globlastp |
| 3117 | LYD201 | tomato\|09v1\|TOMGTPASE_P1 | 6613 | 632 | 88.1 | globlastp |
| 3118 | LYD201 | tomato\|gb164\|TOMGTPASE_P1 | 6613 | 632 | 88.1 | globlastp |
| 3119 | LYD201 | cassava\|09v1\|DB922382_T1 | — | 632 | 87.56 | glotblastn |
| 3120 | LYD201 | gerbera\|09v1\|AJ754374_P1 | 6614 | 632 | 87.2 | globlastp |
| 3121 | LYD201 | b_juncea\|10v2\|E6ANDIZ01B5J2W_P1 | 6615 | 632 | 87 | globlastp |
| 3122 | LYD201 | rhizophora\|10v1\|SRR005792S0006460_P1 | 6616 | 632 | 87 | globlastp |
| 3123 | LYD201 | canola\|10v1\|EE502143_P1 | 6617 | 632 | 87 | globlastp |
| 3124 | LYD201 | canola\|gb161\|EE502143_P1 | 6617 | 632 | 87 | globlastp |
| 3125 | LYD201 | cotton\|gb164\|AI726130_P1 | 6618 | 632 | 87 | globlastp |
| 3126 | LYD201 | ipomoea_batatas\|10v1\|DV036611_T1 | 6619 | 632 | 86.53 | glotblastn |
| 3127 | LYD201 | acacia\|10v1\|FS584353_P1 | 6620 | 632 | 86.5 | globlastp |
| 3128 | LYD201 | antirrhinum\|gb166\|AJ790137_P1 | 6621 | 632 | 86.5 | globlastp |
| 3129 | LYD201 | antirrhinum\|gb166\|AJ793609_P1 | 6622 | 632 | 86.5 | globlastp |
| 3130 | LYD201 | petunia\|gb171\|FN000859_P1 | 6623 | 632 | 86.5 | globlastp |
| 3131 | LYD201 | spikemoss\|gb165\|FE450778_P1 | 6624 | 632 | 86.5 | globlastp |
| 3132 | LYD201 | wheat\|gb164\|BG606923_P1 | 6625 | 632 | 86.5 | globlastp |
| 3133 | LYD201 | cyamopsis\|10v1\|EG990518_T1 | 6626 | 632 | 86.01 | glotblastn |
| 3134 | LYD201 | cichorium\|gb171\|EH690632_P1 | 6627 | 632 | 85.5 | globlastp |
| 3135 | LYD201 | fern\|gb171\|DK945400_P1 | 6628 | 632 | 85.5 | globlastp |
| 3136 | LYD201 | artemisia\|10v1\|SRR019254S0321327_T1 | 6629 | 632 | 85.49 | glotblastn |
| 3137 | LYD201 | artemisia\|gb164\|EY061569_P1 | 6630 | 632 | 85 | globlastp |
| 3138 | LYD201 | kiwi\|gb166\|FG404662_P1 | 6631 | 632 | 85 | globlastp |
| 3139 | LYD201 | petunia\|gb171\|FN000129_P1 | 6632 | 632 | 85 | globlastp |
| 3140 | LYD201 | spikemoss\|gb165\|FE448726_P1 | 6633 | 632 | 84.5 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3141 | LYD201 | iceplant\|gb164\|BE033433_T1 | 6634 | 632 | 84.46 | glotblastn |
| 3142 | LYD201 | chickpea\|09v2\|GR403467_T1 | 6635 | 632 | 83.94 | glotblastn |
| 3143 | LYD201 | physcomitrella\|10v1\|AW126671_P1 | 6636 | 632 | 83.9 | globlastp |
| 3144 | LYD201 | physcomitrella\|gb157\|AW126671_P1 | 6636 | 632 | 83.9 | globlastp |
| 3145 | LYD201 | monkeyflower\|10v1\|MGJGI004466_P1 | 6637 | 632 | 83.4 | globlastp |
| 3146 | LYD201 | peanut\|gb171\|ES721921_P1 | 6638 | 632 | 83.4 | globlastp |
| 3147 | LYD201 | dandelion\|gb161\|DY812100_T1 | 6639 | 632 | 82.99 | glotblastn |
| 3148 | LYD201 | chickpea\|09v2\|GR402896_P1 | 6640 | 632 | 82.9 | globlastp |
| 3149 | LYD201 | physcomitrella\|10v1\|BJ174310_P1 | 6641 | 632 | 82.9 | globlastp |
| 3150 | LYD201 | physcomitrella\|gb157\|BJ174310_P1 | 6641 | 632 | 82.9 | globlastp |
| 3151 | LYD201 | spikemoss\|gb165\|FE517935_P1 | 6642 | 632 | 82.9 | globlastp |
| 3152 | LYD201 | basilicum\|10v1\|DY339599_P1 | 6643 | 632 | 82.3 | globlastp |
| 3153 | LYD201 | spikemoss\|gb165\|DN839042_P1 | 6644 | 632 | 81.9 | globlastp |
| 3154 | LYD201 | lovegrass\|gb167\|EH189602_T1 | 6645 | 632 | 81.87 | glotblastn |
| 3155 | LYD201 | zinnia\|gb171\|DV017338_P1 | 6646 | 632 | 81.3 | globlastp |
| 3156 | LYD201 | barley\|10v1\|BE411202_P1 | 6647 | 632 | 81.2 | globlastp |
| 3157 | LYD201 | eschscholzia\|10v1\|CK747995_P1 | 6648 | 632 | 80.8 | globlastp |
| 3158 | LYD201 | avocado\|gb164\|CK752490_P1 | 6649 | 632 | 80.8 | globlastp |
| 3159 | LYD201 | lolium\|09v1\|AU245847_P1 | 6650 | 632 | 80.8 | globlastp |
| 3160 | LYD201 | lotus\|09v1\|CB828505_P1 | 6651 | 632 | 80.8 | globlastp |
| 3161 | LYD201 | oil_palm\|gb166\|EY411937_P1 | 6652 | 632 | 80.8 | globlastp |
| 3162 | LYD201 | pigeonpea\|10v1\|SRR054580S0000341_T1 | 6653 | 632 | 80.31 | glotblastn |
| 3163 | LYD201 | lolium\|10v1\|AU245847_T1 | 6654 | 632 | 80.31 | glotblastn |
| 3164 | LYD201 | ostreococcus\|gb162\|XM001422553_T1 | 6655 | 632 | 80.31 | glotblastn |
| 3165 | LYD201 | ipomoea_batatas\|10v1\|BU691028_P1 | 6656 | 632 | 80.3 | globlastp |
| 3166 | LYD201 | avocado\|10v1\|CK752490_P1 | 6657 | 632 | 80.3 | globlastp |
| 3167 | LYD202 | b_oleracea\|gb161\|AM058040_P1 | 6658 | 633 | 98.8 | globlastp |
| 3168 | LYD202 | canola\|gb161\|CD843895_P1 | 6659 | 633 | 98.8 | globlastp |
| 3169 | LYD202 | canola\|gb161\|EE434181_P1 | 6658 | 633 | 98.8 | globlastp |
| 3170 | LYD202 | canola\|10v1\|CD843895_P1 | 6658 | 633 | 98.8 | globlastp |
| 3171 | LYD202 | cleome_gynandra\|10v1\|SRR015532S0006952_P1 | 6660 | 633 | 86.7 | globlastp |
| 3172 | LYD202 | avocado\|10v1\|CO998009_P1 | 6661 | 633 | 82.5 | globlastp |
| 3173 | LYD202 | avocado\|gb164\|CO998009_P1 | 6661 | 633 | 82.5 | globlastp |
| 3174 | LYD204 | canola\|10v1\|DW999856_P1 | 6662 | 634 | 98.2 | globlastp |
| 3175 | LYD204 | canola\|gb161\|EG019813_P1 | 6663 | 634 | 98.1 | globlastp |
| 3176 | LYD206 | canola\|10v1\|CD827387_P1 | 6664 | 635 | 99.2 | globlastp |
| 3177 | LYD206 | canola\|10v1\|CD822629_P1 | 6665 | 635 | 97.3 | globlastp |
| 3178 | LYD206 | b_rapa\|gb162\|BG544285_P1 | 6666 | 635 | 96.2 | globlastp |
| 3179 | LYD206 | canola\|gb161\|CD827387_P1 | 6667 | 635 | 96.2 | globlastp |
| 3180 | LYD206 | b_oleracea\|gb161\|AM387196_P1 | 6668 | 635 | 93.8 | globlastp |
| 3181 | LYD206 | canola\|gb161\|CD822629_P1 | 6669 | 635 | 92.9 | globlastp |
| 3182 | LYD206 | radish\|gb164\|EV535046_P1 | 6670 | 635 | 88.9 | globlastp |
| 3183 | LYD206 | thellungiella\|gb167\|BY801344_P1 | 6671 | 635 | 88.3 | globlastp |
| 3184 | LYD206 | arabidopsis_lyrata\|09v1\|JGIAL025591_P1 | 6672 | 635 | 85.3 | globlastp |
| 3185 | LYD206 | arabidopsis\|10v1\|AT4G25130_P1 | 6673 | 635 | 84.6 | globlastp |
| 3186 | LYD206 | arabidopsis\|gb165\|AT4G25130_P1 | 6673 | 635 | 84.6 | globlastp |
| 3187 | LYD206 | canola\|10v1\|CN825961_P1 | 6674 | 635 | 82 | globlastp |
| 3188 | LYD206 | radish\|gb164\|EW713423_P1 | 6675 | 635 | 82 | globlastp |
| 3189 | LYD206 | canola\|gb161\|CN825961_P1 | 6676 | 635 | 80.1 | globlastp |
| 3190 | LYD208 | canola\|10v1\|CD823590_P1 | 6677 | 636 | 99.4 | globlastp |
| 3191 | LYD208 | b_rapa\|gb162\|EF110932_P1 | 6677 | 636 | 99.4 | globlastp |
| 3192 | LYD208 | canola\|gb161\|CD823590_P1 | 6677 | 636 | 99.4 | globlastp |
| 3193 | LYD208 | b_nigra\|09v1\|GT069367_P1 | 6678 | 636 | 98.2 | globlastp |
| 3194 | LYD208 | b_oleracea\|gb161\|DY027427_P1 | 6679 | 636 | 97.1 | globlastp |
| 3195 | LYD208 | canola\|10v1\|CD822474_P1 | 6679 | 636 | 97.1 | globlastp |
| 3196 | LYD208 | canola\|gb161\|CD822474_P1 | 6679 | 636 | 97.1 | globlastp |
| 3197 | LYD208 | canola\|10v1\|EE468408_P1 | 6680 | 636 | 86 | globlastp |
| 3198 | LYD208 | canola\|gb161\|EE468408_P1 | 6681 | 636 | 84.9 | globlastp |
| 3199 | LYD208 | canola\|10v1\|EE561855_P1 | 6682 | 636 | 83.7 | globlastp |
| 3200 | LYD208 | canola\|gb161\|EE561855_P1 | 6682 | 636 | 83.7 | globlastp |
| 3201 | LYD209 | b_rapa\|gb162\|EE520539_P1 | 637 | 637 | 100 | globlastp |
| 3202 | LYD209 | canola\|10v1\|CD817560_P1 | 637 | 637 | 100 | globlastp |
| 3203 | LYD209 | canola\|gb161\|CD817560_P1 | 637 | 637 | 100 | globlastp |
| 3204 | LYD209 | canola\|10v1\|H07613_T1 | 6683 | 637 | 100 | glotblastn |
| 3205 | LYD209 | canola\|gb161\|H07613_T1 | 6684 | 637 | 100 | glotblastn |
| 3206 | LYD209 | arabidopsis_lyrata\|09v1\|JGIAL009284_T1 | 6685 | 637 | 98.82 | glotblastn |
| 3207 | LYD209 | arabidopsis_lyrata\|09v1\|JGIAL009283_P1 | 6686 | 637 | 98.8 | globlastp |
| 3208 | LYD209 | radish\|gb164\|EV552598_P1 | 6687 | 637 | 98.8 | globlastp |
| 3209 | LYD209 | radish\|gb164\|EX756792_P1 | 6687 | 637 | 98.8 | globlastp |
| 3210 | LYD209 | arabidopsis\|10v1\|AT3G08890_P1 | 6688 | 637 | 98.2 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3211 | LYD209 | b_oleracea\|gb161\|DY013753_P1 | 6689 | 637 | 98.2 | globlastp |
| 3212 | LYD209 | thellungiella\|gb167\|BY808308_P1 | 6690 | 637 | 97.6 | globlastp |
| 3213 | LYD209 | cleome_spinosa\|10v1\|GR933525_P1 | 6691 | 637 | 91.2 | globlastp |
| 3214 | LYD209 | radish\|gb164\|EV528123_P1 | 6692 | 637 | 88.2 | globlastp |
| 3215 | LYD209 | nasturtium\|10v1\|SRR032558S0012424_P1 | 6693 | 637 | 87.6 | globlastp |
| 3216 | LYD209 | cleome_gynandra\|10v1\|SRR015532S0013802_P1 | 6694 | 637 | 87.1 | globlastp |
| 3217 | LYD209 | arabidopsis\|10v1\|AT5G37070_P1 | 6695 | 637 | 86.5 | globlastp |
| 3218 | LYD209 | arabidopsis\|gb165\|AT5G37070_P1 | 6695 | 637 | 86.5 | globlastp |
| 3219 | LYD209 | papaya\|gb165\|EX268088_P1 | 6696 | 637 | 86.5 | globlastp |
| 3220 | LYD209 | radish\|gb164\|EW731568_P1 | 6697 | 637 | 85.9 | globlastp |
| 3221 | LYD209 | canola\|gb161\|EE464762_P1 | 6698 | 637 | 85.3 | globlastp |
| 3222 | LYD209 | canola\|10v1\|CD833480_P1 | 6698 | 637 | 85.3 | globlastp |
| 3223 | LYD209 | arabidopsis_lyrata\|09v1\|JGIAL019758_P1 | 6699 | 637 | 84.7 | globlastp |
| 3224 | LYD209 | canola\|10v1\|ES900549_P1 | 6700 | 637 | 84.7 | globlastp |
| 3225 | LYD209 | canola\|gb161\|CD833480_P1 | 6701 | 637 | 84.7 | globlastp |
| 3226 | LYD209 | eucalyptus\|gb166\|CT982262_P1 | 6702 | 637 | 84.7 | globlastp |
| 3227 | LYD209 | radish\|gb164\|EX888617_P1 | 6703 | 637 | 84.7 | globlastp |
| 3228 | LYD209 | arabidopsis_lyrata\|09v1\|JGIAL005254_P1 | 6704 | 637 | 84.1 | globlastp |
| 3229 | LYD209 | arabidopsis\|10v1\|AT5G01610_P1 | 6705 | 637 | 84.1 | globlastp |
| 3230 | LYD209 | b_oleracea\|gb161\|EH421224_P1 | 6706 | 637 | 84.1 | globlastp |
| 3231 | LYD209 | canola\|10v1\|CX194506_P1 | 6707 | 637 | 84.1 | globlastp |
| 3232 | LYD209 | cotton\|10v1\|AI729006_P1 | 6708 | 637 | 84.1 | globlastp |
| 3233 | LYD209 | cotton\|gb164\|AI729006_P1 | 6708 | 637 | 84.1 | globlastp |
| 3234 | LYD209 | ipomoea_nil\|10v1\|BJ562434_P1 | 6709 | 637 | 83.5 | globlastp |
| 3235 | LYD209 | cassava\|09v1\|CK642907_P1 | 6710 | 637 | 83.5 | globlastp |
| 3236 | LYD209 | ipomoea\|gb157.2\|BJ562434_P1 | 6709 | 637 | 83.5 | globlastp |
| 3237 | LYD209 | orobanche\|10v1\|SRR023189S0000873_P1 | 6711 | 637 | 82.9 | globlastp |
| 3238 | LYD209 | cacao\|gb167\|CU484903_P1 | 6712 | 637 | 82.9 | globlastp |
| 3239 | LYD209 | coffea\|10v1\|DV673843_P1 | 6713 | 637 | 82.9 | globlastp |
| 3240 | LYD209 | coffea\|gb157.2\|DV673843_P1 | 6713 | 637 | 82.9 | globlastp |
| 3241 | LYD209 | liriodendron\|gb166\|DT599690_P1 | 6714 | 637 | 82.9 | globlastp |
| 3242 | LYD209 | triphysaria\|10v1\|EY125780_P1 | 6715 | 637 | 82.9 | globlastp |
| 3243 | LYD209 | cleome_gynandra\|10v1\|SRR015532S0000548_P1 | 6716 | 637 | 82.5 | globlastp |
| 3244 | LYD209 | flax\|09v1\|CV478759_P1 | 6717 | 637 | 82.4 | globlastp |
| 3245 | LYD209 | cassava\|gb164\|CK642907_P1 | 6718 | 637 | 82.4 | globlastp |
| 3246 | LYD209 | grape\|gb160\|CB343986_P1 | 6719 | 637 | 82.4 | globlastp |
| 3247 | LYD209 | poplar\|10v1\|AI162985_P1 | 6720 | 637 | 82.4 | globlastp |
| 3248 | LYD209 | poplar\|gb170\|AI162985_P1 | 6721 | 637 | 82.4 | globlastp |
| 3249 | LYD209 | triphysaria\|gb164\|EY125780_P1 | 6722 | 637 | 82.4 | globlastp |
| 3250 | LYD209 | salvia\|10v1\|FE536769_P1 | 6723 | 637 | 81.8 | globlastp |
| 3251 | LYD209 | kiwi\|gb166\|FG437681_P1 | 6724 | 637 | 81.8 | globlastp |
| 3252 | LYD209 | pepper\|gb171\|BM064893_P1 | 6725 | 637 | 81.8 | globlastp |
| 3253 | LYD209 | tobacco\|gb162\|EB428951_P1 | 6726 | 637 | 81.8 | globlastp |
| 3254 | LYD209 | tomato\|09v1\|BG131101_P1 | 6727 | 637 | 81.8 | globlastp |
| 3255 | LYD209 | tomato\|gb164\|BG131101_P1 | 6727 | 637 | 81.8 | globlastp |
| 3256 | LYD209 | walnuts\|gb166\|CV195525_P1 | 6728 | 637 | 81.8 | globlastp |
| 3257 | LYD209 | ipomoea_batatas\|10v1\|EE875075_T1 | 6729 | 637 | 81.76 | glotblastn |
| 3258 | LYD209 | castorbean\|09v1\|XM002526627_P1 | 6730 | 637 | 81.2 | globlastp |
| 3259 | LYD209 | chestnut\|gb170\|SRR006295S0007436_P1 | 6731 | 637 | 81.2 | globlastp |
| 3260 | LYD209 | peanut\|10v1\|ES720496_P1 | 6732 | 637 | 81.2 | globlastp |
| 3261 | LYD209 | peanut\|gb171\|DQ099062_P1 | 6732 | 637 | 81.2 | globlastp |
| 3262 | LYD209 | heritiera\|10v1\|SRR005794S0004663_T1 | 6733 | 637 | 81.18 | glotblastn |
| 3263 | LYD209 | basilicum\|10v1\|DY332932_P1 | 6734 | 637 | 80.6 | globlastp |
| 3264 | LYD209 | eggplant\|10v1\|FS000729_P1 | 6735 | 637 | 80.6 | globlastp |
| 3265 | LYD209 | oak\|10v1\|FN759515_P1 | 6736 | 637 | 80.6 | globlastp |
| 3266 | LYD209 | oak\|10v1\|FP038685_P1 | 6736 | 637 | 80.6 | globlastp |
| 3267 | LYD209 | rhizophora\|10v1\|SRR005793S0022511_P1 | 6737 | 637 | 80.6 | globlastp |
| 3268 | LYD209 | oak\|gb170\|SRR006307S0005811_P1 | 6736 | 637 | 80.6 | globlastp |
| 3269 | LYD209 | poplar\|10v1\|AI161586_P1 | 6738 | 637 | 80.6 | globlastp |
| 3270 | LYD209 | poplar\|gb170\|AI161586_P1 | 6738 | 637 | 80.6 | globlastp |
| 3271 | LYD209 | potato\|10v1\|BG351980_P1 | 6739 | 637 | 80.6 | globlastp |
| 3272 | LYD209 | potato\|gb157.2\|BG351980_P1 | 6739 | 637 | 80.6 | globlastp |
| 3273 | LYD209 | solanum_phureja\|09v1\|SPHBG131101_P1 | 6739 | 637 | 80.6 | globlastp |
| 3274 | LYD209 | tea\|10v1\|CV014110_P1 | 6740 | 637 | 80.6 | globlastp |
| 3275 | LYD209 | tea\|gb171\|CV014110_P1 | 6740 | 637 | 80.6 | globlastp |
| 3276 | LYD209 | tobacco\|gb162\|CV020672_P1 | 6741 | 637 | 80.6 | globlastp |
| 3277 | LYD209 | tobacco\|gb162\|EB440426_P1 | 6742 | 637 | 80.6 | globlastp |
| 3278 | LYD209 | tomato\|09v1\|BG630491_P1 | 6743 | 637 | 80.6 | globlastp |
| 3279 | LYD209 | tomato\|gb164\|BG630491_P1 | 6743 | 637 | 80.6 | globlastp |
| 3280 | LYD209 | eggplant\|10v1\|FS003717_P1 | 6744 | 637 | 80 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3281 | LYD209 | avocado\|10v1\|CO996840_T1 | 6745 | 637 | 80 | glotblastn |
| 3282 | LYD209 | medicago\|09v1\|BF520968_P1 | 6746 | 637 | 80 | globlastp |
| 3283 | LYD209 | walnuts\|gb166\|EL902338_P1 | 6747 | 637 | 80 | globlastp |
| 3284 | LYD211 | maize\|10v1\|W59814_P1 | 6748 | 638 | 95.4 | globlastp |
| 3285 | LYD211 | maize\|gb170\|W59814_P1 | 6748 | 638 | 95.4 | globlastp |
| 3286 | LYD211 | wheat\|gb164\|CA617581_T1 | 6749 | 638 | 93.49 | glotblastn |
| 3287 | LYD211 | maize\|10v1\|AI637136_P1 | 6750 | 638 | 93.2 | globlastp |
| 3288 | LYD211 | maize\|gb170\|AI637136_P1 | 6750 | 638 | 93.2 | globlastp |
| 3289 | LYD211 | sugarcane\|10v1\|CA067172_P1 | 6751 | 638 | 92.3 | globlastp |
| 3290 | LYD211 | millet\|10v1\|OXPMSLX0000399D1T1_T1 | 6752 | 638 | 88.26 | glotblastn |
| 3291 | LYD211 | rice\|gb170\|OS06G06980_P1 | 6753 | 638 | 87 | globlastp |
| 3292 | LYD211 | sugarcane\|10v1\|CA080520_P1 | 6754 | 638 | 81.2 | globlastp |
| 3293 | LYD212 | arabidopsis_lyrata\|09v1\|JGIAL002279_P1 | 6755 | 639 | 83.3 | globlastp |
| 3294 | LYD213 | arabidopsis_lyrata\|09v1\|JGIAL005546_P1 | 6756 | 640 | 94 | globlastp |
| 3295 | LYD213 | radish\|gb164\|EV528455_P1 | 6757 | 640 | 91 | globlastp |
| 3296 | LYD213 | radish\|gb164\|EX896578_P1 | 6758 | 640 | 91 | globlastp |
| 3297 | LYD213 | thellungiella\|gb167\|BY806901_P1 | 6759 | 640 | 91 | globlastp |
| 3298 | LYD213 | canola\|10v1\|CD823783_P1 | 6760 | 640 | 90.4 | globlastp |
| 3299 | LYD213 | canola\|gb161\|CD823783_P1 | 6760 | 640 | 90.4 | globlastp |
| 3300 | LYD213 | canola\|10v1\|EE565774_P1 | 6761 | 640 | 90.4 | globlastp |
| 3301 | LYD213 | canola\|gb161\|EE565774_P1 | 6761 | 640 | 90.4 | globlastp |
| 3302 | LYD213 | b_oleracea\|gb161\|DY027463_P1 | 6762 | 640 | 89.8 | globlastp |
| 3303 | LYD213 | b_rapa\|gb162\|EX046427_P1 | 6763 | 640 | 83.2 | globlastp |
| 3304 | LYD213 | cleome_spinosa\|10v1\|GR935047_T1 | 6764 | 640 | 81.44 | glotblastn |
| 3305 | LYD213 | heritiera\|10v1\|SRR005795S0007448_T1 | 6765 | 640 | 80.24 | glotblastn |
| 3306 | LYD213 | poplar\|10v1\|BU837910_P1 | 6766 | 640 | 80 | globlastp |
| 3307 | LYD213 | poplar\|gb170\|BU837910_P1 | 6766 | 640 | 80 | globlastp |
| 3308 | LYD214 | arabidopsis_lyrata\|09v1\|JGIAL013069_P1 | 6767 | 641 | 85.8 | globlastp |
| 3309 | LYD215 | arabidopsis_lyrata\|09v1\|JGIAL015680_P1 | 6768 | 642 | 96.6 | globlastp |
| 3310 | LYD215 | thellungiella\|gb167\|BY825912_P1 | 6769 | 642 | 81.1 | globlastp |
| 3311 | LYD216 | arabidopsis_lyrata\|09v1\|JGIAL008737_P1 | 6770 | 643 | 97.8 | globlastp |
| 3312 | LYD216 | canola\|10v1\|CD812868_P1 | 6771 | 643 | 95.8 | globlastp |
| 3313 | LYD216 | canola\|gb161\|CD812868_P1 | 6771 | 643 | 95.8 | globlastp |
| 3314 | LYD216 | b_rapa\|gb162\|BG543323_P1 | 6772 | 643 | 95.4 | globlastp |
| 3315 | LYD216 | canola\|10v1\|CD835674_P1 | 6773 | 643 | 95.4 | globlastp |
| 3316 | LYD216 | canola\|gb161\|CD835674_P1 | 6774 | 643 | 95.3 | globlastp |
| 3317 | LYD216 | radish\|gb164\|EV569880_T1 | 6775 | 643 | 94.54 | glotblastn |
| 3318 | LYD216 | arabidopsis_lyrata\|09v1\|JGIAL021535_P1 | 6776 | 643 | 92 | globlastp |
| 3319 | LYD216 | oak\|10v1\|CU656818_P1 | 6777 | 643 | 83.8 | globlastp |
| 3320 | LYD216 | peanut\|10v1\|ES710509_P1 | 6778 | 643 | 83.1 | globlastp |
| 3321 | LYD216 | lotus\|09v1\|AI967690_P1 | 6779 | 643 | 83.1 | globlastp |
| 3322 | LYD216 | poplar\|10v1\|AI163627_P1 | 6780 | 643 | 82.9 | globlastp |
| 3323 | LYD216 | poplar\|gb170\|AI163627_P1 | 6780 | 643 | 82.9 | globlastp |
| 3324 | LYD216 | grape\|gb160\|CF405689_P1 | 6781 | 643 | 82.7 | globlastp |
| 3325 | LYD216 | cassava\|09v1\|DB925080_P1 | 6782 | 643 | 82.5 | globlastp |
| 3326 | LYD216 | poplar\|10v1\|BU834708_P1 | 6783 | 643 | 82.3 | globlastp |
| 3327 | LYD216 | cassava\|09v1\|DB925255_P1 | 6784 | 643 | 82.1 | globlastp |
| 3328 | LYD216 | cucumber\|09v1\|CK085497_P1 | 6785 | 643 | 82.1 | globlastp |
| 3329 | LYD216 | pigeonpea\|10v1\|SRR054580S0001389_P1 | 6786 | 643 | 82.1 | globlastp |
| 3330 | LYD216 | soybean\|gb168\|AW720031_P1 | 6787 | 643 | 82.1 | globlastp |
| 3331 | LYD216 | cowpea\|gb166\|FC457814_P1 | 6788 | 643 | 82 | globlastp |
| 3332 | LYD216 | soybean\|gb168\|AI967690_P1 | 6789 | 643 | 82 | globlastp |
| 3333 | LYD216 | prunus\|10v1\|BU044770_P1 | 6790 | 643 | 81.8 | globlastp |
| 3334 | LYD216 | triphysaria\|10v1\|EX988561_P1 | 6791 | 643 | 81.6 | globlastp |
| 3335 | LYD216 | castorbean\|09v1\|EG663398_P1 | 6792 | 643 | 81.4 | globlastp |
| 3336 | LYD216 | monkeyflower\|09v1\|DV207330_P1 | 6793 | 643 | 81.4 | globlastp |
| 3337 | LYD216 | monkeyflower\|10v1\|DV207330_P1 | 6793 | 643 | 81.4 | globlastp |
| 3338 | LYD216 | monkeyflower\|10v1\|DV206598_P1 | 6794 | 643 | 81.2 | globlastp |
| 3339 | LYD216 | cotton\|10v1\|AI730956_P1 | 6795 | 643 | 81.2 | globlastp |
| 3340 | LYD216 | cotton\|gb164\|AI730956_P1 | 6796 | 643 | 81.2 | globlastp |
| 3341 | LYD216 | sorghum\|09v1\|SB05G022470_P1 | 6797 | 643 | 81.2 | globlastp |
| 3342 | LYD216 | triphysaria\|gb164\|EX988561_P1 | 6798 | 643 | 81.1 | globlastp |
| 3343 | LYD216 | prunus\|gb167\|BU044770_P1 | 6799 | 643 | 80.9 | globlastp |
| 3344 | LYD216 | rice\|gb170\|OS03G59020_P1 | 6800 | 643 | 80.9 | globlastp |
| 3345 | LYD216 | sugarcane\|10v1\|CA064935_P1 | 6801 | 643 | 80.7 | globlastp |
| 3346 | LYD216 | millet\|10v1\|EVO454PM003718_P1 | 6802 | 643 | 80.5 | globlastp |
| 3347 | LYD216 | maize\|10v1\|AI438833_P1 | 6803 | 643 | 80.5 | globlastp |
| 3348 | LYD216 | maize\|gb170\|AI438833_P1 | 6803 | 643 | 80.5 | globlastp |
| 3349 | LYD216 | switchgrass\|gb167\|FE635793_P1 | 6804 | 643 | 80.5 | globlastp |
| 3350 | LYD216 | orobanche\|10v1\|SRR023189S0000892_P1 | 6805 | 643 | 80.3 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3351 | LYD216 | sugarcane\|gb157.3\|CA064935_P1 | 6806 | 643 | 80.3 | globlastp |
| 3352 | LYD216 | tomato\|gb164\|BG123817_P1 | 6807 | 643 | 80.3 | globlastp |
| 3353 | LYD216 | cacao\|gb167\|CU508640_P1 | 6808 | 643 | 80.1 | globlastp |
| 3354 | LYD216 | maize\|10v1\|AI461542_P1 | 6809 | 643 | 80.1 | globlastp |
| 3355 | LYD216 | maize\|gb170\|AI461542_P1 | 6809 | 643 | 80.1 | globlastp |
| 3356 | LYD216 | sunflower\|10v1\|CD853040_P1 | 6810 | 643 | 80 | globlastp |
| 3357 | LYD216 | sunflower\|gb162\|CD853040_P1 | 6810 | 643 | 80 | globlastp |
| 3358 | LYD216 | tobacco\|gb162\|CV018317_P1 | 6811 | 643 | 80 | globlastp |
| 3359 | LYD217 | arabidopsis_lyrata\|09v1\|JGIAL008994_P1 | 6812 | 644 | 94 | globlastp |
| 3360 | LYD217 | canola\|10v1\|CD834062_P1 | 6813 | 644 | 82.2 | globlastp |
| 3361 | LYD217 | b_oleracea\|gb161\|DY027765_P1 | 6814 | 644 | 82.2 | globlastp |
| 3362 | LYD217 | b_rapa\|gb162\|L46482_P1 | 6815 | 644 | 82.2 | globlastp |
| 3363 | LYD217 | canola\|10v1\|CD823487_P1 | 6816 | 644 | 82.2 | globlastp |
| 3364 | LYD217 | canola\|gb161\|CD823487_P1 | 6816 | 644 | 82.2 | globlastp |
| 3365 | LYD217 | canola\|10v1\|DY003791_P1 | 6817 | 644 | 82.2 | globlastp |
| 3366 | LYD217 | canola\|gb161\|CD834062_P1 | 6817 | 644 | 82.2 | globlastp |
| 3367 | LYD217 | b_juncea\|10v2\|E6ANDIZ01BQQYN1_P1 | 6818 | 644 | 81.2 | globlastp |
| 3368 | LYD217 | radish\|gb164\|EV525090_P1 | 6819 | 644 | 81.2 | globlastp |
| 3369 | LYD217 | radish\|gb164\|EV551040_P1 | 6820 | 644 | 81.1 | globlastp |
| 3370 | LYD219 | arabidopsis_lyrata\|09v1\|JGIAL018329_P1 | 6821 | 645 | 96.1 | globlastp |
| 3371 | LYD219 | canola\|gb161\|CD824877_T1 | 6822 | 645 | 82.37 | glotblastn |
| 3372 | LYD219 | canola\|10v1\|CD824877_P1 | 6823 | 645 | 82.2 | globlastp |
| 3373 | LYD220 | arabidopsis_lyrata\|09v1\|JGIAL026614_P1 | 6824 | 646 | 97.8 | globlastp |
| 3374 | LYD220 | canola\|10v1\|CX190271_P1 | 6825 | 646 | 92.7 | globlastp |
| 3375 | LYD220 | canola\|gb161\|CX190271_P1 | 6825 | 646 | 92.7 | globlastp |
| 3376 | LYD220 | radish\|gb164\|EW716867_P1 | 6826 | 646 | 92.7 | globlastp |
| 3377 | LYD220 | canola\|10v1\|CD829020_P1 | 6827 | 646 | 91.6 | globlastp |
| 3378 | LYD220 | canola\|gb161\|CD829020_P1 | 6827 | 646 | 91.6 | globlastp |
| 3379 | LYD220 | b_oleracea\|gb161\|ES943495_P1 | 6828 | 646 | 91.1 | globlastp |
| 3380 | LYD220 | radish\|gb164\|EW714155_P1 | 6829 | 646 | 91 | globlastp |
| 3381 | LYD220 | b_rapa\|gb162\|ES935221_P1 | 6830 | 646 | 82.2 | globlastp |
| 3382 | LYD220 | canola\|10v1\|CN726066_P1 | 6831 | 646 | 82.2 | globlastp |
| 3383 | LYD220 | canola\|gb161\|CN726066_P1 | 6831 | 646 | 82.2 | globlastp |
| 3384 | LYD220 | canola\|gb161\|CN732719_P1 | 6832 | 646 | 81.7 | globlastp |
| 3385 | LYD220 | canola\|10v1\|CD821217_P1 | 6832 | 646 | 81.7 | globlastp |
| 3386 | LYD220 | canola\|gb161\|CD821217_T1 | 6833 | 646 | 81.67 | glotblastn |
| 3387 | LYD220 | b_oleracea\|gb161\|DY013876_P1 | 6834 | 646 | 81.1 | globlastp |
| 3388 | LYD221 | arabidopsis_lyrata\|09v1\|JGIAL024384_P1 | 6835 | 647 | 97.1 | globlastp |
| 3389 | LYD221 | canola\|10v1\|CX188183_P1 | 6836 | 647 | 88.3 | globlastp |
| 3390 | LYD221 | canola\|gb161\|CB686340_P1 | 6837 | 647 | 88.1 | globlastp |
| 3391 | LYD221 | b_rapa\|gb162\|CX266123_P1 | 6838 | 647 | 87.9 | globlastp |
| 3392 | LYD221 | canola\|gb161\|CD836701_P1 | 6839 | 647 | 87.9 | globlastp |
| 3393 | LYD221 | canola\|10v1\|CB686340_P1 | 6840 | 647 | 87.7 | globlastp |
| 3394 | LYD221 | radish\|gb164\|EV538382_P1 | 6841 | 647 | 87.7 | globlastp |
| 3395 | LYD222 | arabidopsis_lyrata\|09v1\|JGIAL024369_T1 | 6842 | 648 | 94.64 | glotblastn |
| 3396 | LYD223 | arabidopsis_lyrata\|09v1\|JGIAL021005_P1 | 6843 | 649 | 88.6 | globlastp |
| 3397 | LYD223 | b_rapa\|gb162\|BQ791203_P1 | 6844 | 649 | 85.8 | globlastp |
| 3398 | LYD223 | canola\|10v1\|CN728130_P1 | 6845 | 649 | 85.7 | globlastp |
| 3399 | LYD223 | canola\|10v1\|CN727598_P1 | 6846 | 649 | 85.5 | globlastp |
| 3400 | LYD223 | canola\|gb161\|CN727598_P1 | 6846 | 649 | 85.5 | globlastp |
| 3401 | LYD223 | b_oleracea\|gb161\|AM391646_P1 | 6847 | 649 | 85.1 | globlastp |
| 3402 | LYD223 | radish\|gb164\|EW717140_P1 | 6848 | 649 | 84.3 | globlastp |
| 3403 | LYD223 | radish\|gb164\|EW734029_P1 | 6849 | 649 | 83.5 | globlastp |
| 3404 | LYD224 | arabidopsis_lyrata\|09v1\|JGIAL030393_P1 | 6850 | 650 | 96.2 | globlastp |
| 3405 | LYD224 | canola\|10v1\|CD816983_T1 | 6851 | 650 | 89.25 | glotblastn |
| 3406 | LYD224 | canola\|10v1\|CN726221_P1 | 6852 | 650 | 88.2 | globlastp |
| 3407 | LYD224 | canola\|gb161\|CN726221_P1 | 6852 | 650 | 88.2 | globlastp |
| 3408 | LYD224 | maize\|gb170\|LLDQ245206_P1 | 6852 | 650 | 88.2 | globlastp |
| 3409 | LYD224 | radish\|gb164\|FD545244_P1 | 6853 | 650 | 88.2 | globlastp |
| 3410 | LYD224 | radish\|gb164\|EW717992_P1 | 6854 | 650 | 87.6 | globlastp |
| 3411 | LYD224 | canola\|10v1\|CD823092_P1 | 6855 | 650 | 87.2 | globlastp |
| 3412 | LYD224 | canola\|10v1\|EV083752_P1 | 6856 | 650 | 86.6 | globlastp |
| 3413 | LYD224 | b_rapa\|gb162\|BG544824_P1 | 6856 | 650 | 86.6 | globlastp |
| 3414 | LYD224 | canola\|gb161\|CD823092_P1 | 6856 | 650 | 86.6 | globlastp |
| 3415 | LYD224 | radish\|gb164\|EV568231_P1 | 6857 | 650 | 86.1 | globlastp |
| 3416 | LYD224 | radish\|gb164\|EX772197_P1 | 6858 | 650 | 86.1 | globlastp |
| 3417 | LYD224 | b_juncea\|10v2\|E6ANDIZ01DINO2_T1 | 6859 | 650 | 86.02 | glotblastn |
| 3418 | LYD224 | b_juncea\|10v2\|E6ANDIZ01D9PQH_P1 | 6860 | 650 | 85.6 | globlastp |
| 3419 | LYD224 | b_nigra\|09v1\|GT069734_P1 | 6861 | 650 | 85 | globlastp |
| 3420 | LYD224 | canola\|10v1\|CD830574_P1 | 6862 | 650 | 85 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3421 | LYD224 | b_rapa\|gb162\|BG543212_P1 | 6862 | 650 | 85 | globlastp |
| 3422 | LYD224 | canola\|gb161\|CD830574_P1 | 6862 | 650 | 85 | globlastp |
| 3423 | LYD224 | thellungiella\|gb167\|DN775467_P1 | 6863 | 650 | 85 | globlastp |
| 3424 | LYD224 | radish\|gb164\|EV528198_P1 | 6864 | 650 | 84.5 | globlastp |
| 3425 | LYD224 | radish\|gb164\|EV539693_P1 | 6864 | 650 | 84.5 | globlastp |
| 3426 | LYD224 | radish\|gb164\|EW735492_P1 | 6864 | 650 | 84.5 | globlastp |
| 3427 | LYD224 | b_rapa\|gb162\|DY008897_P1 | 6865 | 650 | 84.2 | globlastp |
| 3428 | LYD224 | b_juncea\|gb164\|EVGN00325314303466_P1 | 6866 | 650 | 84 | globlastp |
| 3429 | LYD224 | b_oleracea\|gb161\|AM058913_P1 | 6867 | 650 | 84 | globlastp |
| 3430 | LYD224 | canola\|10v1\|CD821086_P1 | 6867 | 650 | 84 | globlastp |
| 3431 | LYD224 | canola\|gb161\|CD821086_P1 | 6867 | 650 | 84 | globlastp |
| 3432 | LYD224 | b_juncea\|10v2\|BJ1SLX00014852D1_P1 | 6868 | 650 | 83.9 | globlastp |
| 3433 | LYD224 | radish\|gb164\|EV568887_P1 | 6869 | 650 | 83.4 | globlastp |
| 3434 | LYD224 | b_oleracea\|gb161\|ES947178_P1 | 6870 | 650 | 82.8 | globlastp |
| 3435 | LYD224 | radish\|gb164\|EX755825_T1 | 6871 | 650 | 82.26 | glotblastn |
| 3436 | LYD224 | cleome_spinosa\|10v1\|GR931469_P1 | 6872 | 650 | 81.7 | globlastp |
| 3437 | LYD224 | b_juncea\|10v2\|E6ANDIZ01BER52_P1 | 6873 | 650 | 81.2 | globlastp |
| 3438 | LYD224 | radish\|gb164\|EV551184_T1 | 6874 | 650 | 80.85 | glotblastn |
| 3439 | LYD224 | canola\|gb161\|CN725816_P1 | 6875 | 650 | 80.6 | globlastp |
| 3440 | LYD224 | orobanche\|10v1\|SRR023189S0014743_P1 | 6876 | 650 | 80.1 | globlastp |
| 3441 | LYD225 | leymus\|gb166\|EG378671_T1 | 6877 | 651 | 84.68 | glotblastn |
| 3441 | LYD228 | leymus\|gb166\|EG378671_T1 | 6877 | 653 | 84.74 | glotblastn |
| 3442 | LYD225 | wheat\|gb164\|BE430129_P1 | 6878 | 651 | 83.4 | globlastp |
| 3442 | LYD228 | wheat\|gb164\|BE430129_P1 | 6878 | 653 | 83.7 | globlastp |
| 3443 | LYD225 | wheat\|gb164\|BE493466_P1 | 6879 | 651 | 82.9 | globlastp |
| 3443 | LYD228 | wheat\|gb164\|BE493466_P1 | 6879 | 653 | 83.3 | globlastp |
| 3444 | LYD225 | wheat\|gb164\|BI751513_P1 | 6879 | 651 | 82.9 | globlastp |
| 3444 | LYD228 | wheat\|gb164\|BI751513_P1 | 6879 | 653 | 83.3 | globlastp |
| 3445 | LYD225 | barley\|gb157SOLEXA\|BI950425_P1 | 6880 | 651 | 81.5 | globlastp |
| 3445 | LYD228 | barley\|gb157SOLEXA\|BI950425_P1 | 6880 | 653 | 83.4 | globlastp |
| 3446 | LYD225 | barley\|10v1\|BI950425_P1 | 6880 | 651 | 81.5 | globlastp |
| 3446 | LYD228 | barley\|10v1\|BI950425_P1 | 6880 | 653 | 83.4 | globlastp |
| 3447 | LYD225 | brachypodium\|09v1\|DV473630_T1 | 6881 | 651 | 81.45 | glotblastn |
| 3447 | LYD228 | brachypodium\|09v1\|DV473630_P1 | 6881 | 653 | 82.1 | globlastp |
| 3448 | LYD225 | brachypodium\|gb169\|BE430129_T1 | 6881 | 651 | 81.45 | glotblastn |
| 3448 | LYD228 | brachypodium\|gb169\|BE430129_P1 | 6881 | 653 | 82.1 | globlastp |
| 3449 | LYD225 | oat\|10v2\|GR322675_P1 | 6882 | 651 | 80.8 | globlastp |
| 3449 | LYD228 | oat\|10v2\|GR322675_P1 | 6882 | 653 | 82.3 | globlastp |
| 3450 | LYD227 | sugarcane\|10v1\|BQ533190_P1 | 6883 | 652 | 95.9 | globlastp |
| 3451 | LYD227 | sugarcane\|gb157.3\|BQ533190_P1 | 6883 | 652 | 95.9 | globlastp |
| 3452 | LYD227 | maize\|10v1\|AI636982_P1 | 6884 | 652 | 93 | globlastp |
| 3453 | LYD227 | cynodon\|10v1\|ES293243_P1 | 6885 | 652 | 92.4 | globlastp |
| 3454 | LYD227 | switchgrass\|gb167\|DN150732_P1 | 6886 | 652 | 92.4 | globlastp |
| 3455 | LYD227 | millet\|10v1\|EVO454PM058462_T1 | 6887 | 652 | 91.81 | glotblastn |
| 3456 | LYD227 | switchgrass\|gb167\|FE617809_P1 | 6888 | 652 | 91.8 | globlastp |
| 3457 | LYD227 | oat\|10v2\|GO596450_T1 | 6889 | 652 | 90.06 | glotblastn |
| 3458 | LYD227 | pseudoroegneria\|gb167\|FF340032_T1 | 6890 | 652 | 88.3 | glotblastn |
| 3459 | LYD227 | wheat\|gb164\|BE426355_T1 | 6891 | 652 | 87.72 | glotblastn |
| 3460 | LYD227 | wheat\|gb164\|BE499789_T1 | 6892 | 652 | 87.72 | glotblastn |
| 3461 | LYD227 | rice\|gb170\|OS03G24380_P1 | 6893 | 652 | 87.7 | globlastp |
| 3462 | LYD227 | wheat\|gb164\|BE419519_T1 | 6894 | 652 | 86.55 | glotblastn |
| 3463 | LYD227 | fescue\|gb161\|DT680055_P1 | 6895 | 652 | 85.5 | globlastp |
| 3464 | LYD227 | brachypodium\|09v1\|DV472062_T1 | 6896 | 652 | 85.38 | glotblastn |
| 3465 | LYD227 | brachypodium\|gb169\|BE412952_T1 | 6896 | 652 | 85.38 | glotblastn |
| 3466 | LYD227 | barley\|10v1\|BE412952_P1 | 6897 | 652 | 85.3 | globlastp |
| 3467 | LYD227 | barley\|gb157SOLEXA\|BE412952_P1 | 6897 | 652 | 85.3 | globlastp |
| 3468 | LYD227 | leymus\|gb166\|CN465857_P1 | 6898 | 652 | 85.3 | globlastp |
| 3469 | LYD227 | rye\|gb164\|BF429400_P1 | 6899 | 652 | 82.5 | globlastp |
| 3470 | LYD227 | oat\|10v2\|GO584438_P1 | 6900 | 652 | 82.4 | globlastp |
| 3471 | LYD228 | sugarcane\|10v1\|BQ537170_P1 | 6901 | 653 | 98 | globlastp |
| 3472 | LYD228 | sugarcane\|gb157.3\|BQ537170_P1 | 6901 | 653 | 98 | globlastp |
| 3473 | LYD228 | maize\|10v1\|AI691314_P1 | 6902 | 653 | 95.6 | globlastp |
| 3474 | LYD228 | maize\|gb170\|LLAW506702_P1 | 6902 | 653 | 95.6 | globlastp |
| 3475 | LYD228 | millet\|10v1\|EVO454PM069124_P1 | 6903 | 653 | 91.2 | globlastp |
| 3476 | LYD228 | rice\|gb170\|OS07G08070_P1 | 6904 | 653 | 86.7 | globlastp |
| 3477 | LYD228 | cenchrus\|gb166\|EB666958_P1 | 6905 | 653 | 83.3 | globlastp |
| 3478 | LYD229 | maize\|10v1\|CD995946_P1 | 6906 | 654 | 97.2 | globlastp |
| 3479 | LYD229 | maize\|gb170\|CD995946_P1 | 6906 | 654 | 97.2 | globlastp |
| 3480 | LYD229 | maize\|10v1\|CO448545_P1 | 6907 | 654 | 97.2 | globlastp |
| 3481 | LYD229 | maize\|gb170\|CO448545_P1 | 6908 | 654 | 96.8 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3482 | LYD229 | switchgrass\|gb167\|FL722481_P1 | 6909 | 654 | 94.8 | globlastp |
| 3483 | LYD229 | barley\|10v1\|BM368785_P1 | 6910 | 654 | 90.4 | globlastp |
| 3484 | LYD229 | brachypodium\|09v1\|SRR031795S0033339_P1 | 6911 | 654 | 90.4 | globlastp |
| 3485 | LYD229 | brachypodium\|gb169\|BE430146_P1 | 6911 | 654 | 90.4 | globlastp |
| 3486 | LYD229 | wheat\|gb164\|BE430146_P1 | 6912 | 654 | 89.6 | globlastp |
| 3487 | LYD229 | rice\|gb170\|OS03G53400_P1 | 6913 | 654 | 88.8 | globlastp |
| 3488 | LYD230 | maize\|10v1\|CF006891_P1 | 6914 | 655 | 86.6 | globlastp |
| 3489 | LYD230 | maize\|gb170\|CF006891_P1 | 6914 | 655 | 86.6 | globlastp |
| 3490 | LYD230 | switchgrass\|gb167\|DN141172_P1 | 6915 | 655 | 84.5 | globlastp |
| 3491 | LYD231 | sugarcane\|gb157.3\|BQ534352_P1 | 6916 | 656 | 97.3 | globlastp |
| 3492 | LYD231 | maize\|10v1\|AW017610_P1 | 6917 | 656 | 93.2 | globlastp |
| 3493 | LYD231 | maize\|gb170\|AW017610_P1 | 6917 | 656 | 93.2 | globlastp |
| 3494 | LYD231 | brachypodium\|09v1\|DV477613_P1 | 6918 | 656 | 81.6 | globlastp |
| 3495 | LYD231 | rice\|gb170\|OS03G13840_P1 | 6919 | 656 | 81.4 | globlastp |
| 3496 | LYD232 | solanum_phureja\|09v1\|SPHAI774782_P1 | 6920 | 657 | 96.2 | globlastp |
| 3497 | LYD232 | pepper\|gb171\|BM066383_P1 | 6921 | 657 | 88 | globlastp |
| 3498 | LYD232 | solanum_phureja\|09v1\|SPHCRPSP045853_P1 | 6922 | 657 | 83.7 | globlastp |
| 3499 | LYD233 | potato\|10v1\|BI406530_P1 | 6923 | 658 | 97.7 | globlastp |
| 3500 | LYD233 | potato\|gb157.2\|BI406530_P1 | 6923 | 658 | 97.7 | globlastp |
| 3501 | LYD233 | solanum_phureja\|09v1\|SPHAW032486_P1 | 6924 | 658 | 97.5 | globlastp |
| 3502 | LYD234 | potato\|gb157.2\|BF052303_P1 | 6925 | 659 | 98.2 | globlastp |
| 3503 | LYD234 | solanum_phureja\|09v1\|SPHBG123219_P1 | 6926 | 659 | 98.2 | globlastp |
| 3504 | LYD234 | potato\|10v1\|BF052303_P1 | 6927 | 659 | 97.6 | globlastp |
| 3505 | LYD234 | pepper\|gb171\|BM063045_P1 | 6928 | 659 | 90 | globlastp |
| 3506 | LYD234 | solanum_phureja\|09v1\|SPHAI489595_P1 | 6929 | 659 | 82.9 | globlastp |
| 3507 | LYD234 | eggplant\|10v1\|FS038503_P1 | 6930 | 659 | 81.8 | globlastp |
| 3508 | LYD234 | tomato\|09v1\|AI489595_P1 | 6931 | 659 | 81.8 | globlastp |
| 3509 | LYD234 | potato\|10v1\|CK860071_P1 | 6932 | 659 | 81.2 | globlastp |
| 3510 | LYD234 | coffea\|10v1\|DV664407_P1 | 6933 | 659 | 80.6 | globlastp |
| 3511 | LYD234 | coffea\|gb157.2\|DV664407_P1 | 6933 | 659 | 80.6 | globlastp |
| 3512 | LYD234 | petunia\|gb171\|CV299482_P1 | 6934 | 659 | 80 | globlastp |
| 3513 | LYD234 | potato\|gb157.2\|CK860071_T1 | 6935 | 659 | 80 | glotblastn |
| 3514 | LYD236 | potato\|gb157.2\|BQ512865_P1 | 6936 | 661 | 98.3 | globlastp |
| 3515 | LYD236 | solanum_phureja\|09v1\|SPHBG629499_P1 | 6936 | 661 | 98.3 | globlastp |
| 3516 | LYD236 | potato\|10v1\|BQ512865_P1 | 6937 | 661 | 97.9 | globlastp |
| 3517 | LYD236 | eggplant\|10v1\|FS012987_P1 | 6938 | 661 | 96.7 | globlastp |
| 3518 | LYD236 | tobacco\|gb162\|EB425766_P1 | 6939 | 661 | 93.4 | globlastp |
| 3519 | LYD236 | pepper\|gb171\|BM060326_P1 | 6940 | 661 | 92.1 | globlastp |
| 3520 | LYD236 | petunia\|gb171\|DY396002_P1 | 6941 | 661 | 91.7 | globlastp |
| 3521 | LYD236 | orobanche\|10v1\|SRR023189S0003702_P1 | 6942 | 661 | 82.6 | globlastp |
| 3522 | LYD236 | nasturtium\|10v1\|SRR032558S0002662_P1 | 6943 | 661 | 82.2 | globlastp |
| 3523 | LYD236 | ipomoea_nil\|10v1\|CJ748154_P1 | 6944 | 661 | 81.4 | globlastp |
| 3524 | LYD236 | canola\|10v1\|CD843095_P1 | 6945 | 661 | 81.4 | globlastp |
| 3525 | LYD236 | canola\|gb161\|CD843095_P1 | 6945 | 661 | 81.4 | globlastp |
| 3526 | LYD236 | canola\|10v1\|CN828945_P1 | 6946 | 661 | 81.4 | globlastp |
| 3527 | LYD236 | canola\|gb161\|CN828945_P1 | 6946 | 661 | 81.4 | globlastp |
| 3528 | LYD236 | ipomoea\|gb157.2\|CJ748154_P1 | 6944 | 661 | 81.4 | globlastp |
| 3529 | LYD236 | radish\|gb164\|FD968048_P1 | 6947 | 661 | 81.4 | globlastp |
| 3530 | LYD236 | monkeyflower\|10v1\|GR139081_P1 | 6948 | 661 | 81.1 | globlastp |
| 3531 | LYD236 | arabidopsis_lyrata\|09v1\|JGIAL019688_P1 | 6949 | 661 | 81 | globlastp |
| 3532 | LYD236 | coffea\|10v1\|DV680032_P1 | 6950 | 661 | 81 | globlastp |
| 3533 | LYD236 | solanum_phureja\|09v1\|SPHAW930877_T1 | 6951 | 661 | 80.99 | glotblastn |
| 3534 | LYD236 | cassava\|09v1\|JGICASSAVA24594VALIDM1_P1 | 6952 | 661 | 80.6 | globlastp |
| 3535 | LYD236 | arabidopsis\|10v1\|AT3G63310_P1 | 6953 | 661 | 80.6 | globlastp |
| 3536 | LYD236 | arabidopsis\|gb165\|AT3G63310_P1 | 6953 | 661 | 80.6 | globlastp |
| 3537 | LYD236 | castorbean\|09v1\|EG657869_P1 | 6954 | 661 | 80.6 | globlastp |
| 3538 | LYD236 | tomato\|gb164\|AW930877_T1 | 6955 | 661 | 80.58 | glotblastn |
| 3539 | LYD236 | peanut\|10v1\|DT044283_P1 | 6956 | 661 | 80.3 | globlastp |
| 3540 | LYD236 | cotton\|10v1\|AI729700_P1 | 6957 | 661 | 80.2 | globlastp |
| 3541 | LYD236 | citrus\|gb166\|CF508840_P1 | 6958 | 661 | 80.2 | globlastp |
| 3542 | LYD236 | papaya\|gb165\|EX252004_P1 | 6959 | 661 | 80.2 | globlastp |
| 3543 | LYD238 | wheat\|gb164\|BE216948_P1 | 6960 | 662 | 92 | globlastp |
| 3544 | LYD238 | wheat\|gb164\|BE401874_P1 | 6961 | 662 | 92 | globlastp |
| 3545 | LYD238 | wheat\|gb164\|BE402639_P1 | 6962 | 662 | 91.5 | globlastp |
| 3546 | LYD238 | wheat\|gb164\|BE399415_P1 | 6963 | 662 | 91.4 | globlastp |
| 3547 | LYD238 | rye\|gb164\|BE493975_T1 | 6964 | 662 | 90.23 | glotblastn |
| 3548 | LYD238 | wheat\|gb164\|CK161460_P1 | 6965 | 662 | 89.5 | globlastp |
| 3549 | LYD238 | barley\|gb157SOLEXA\|BE412540_P1 | 6966 | 662 | 89.1 | globlastp |
| 3550 | LYD238 | barley\|10v1\|BE412540_P1 | 6966 | 662 | 89.1 | globlastp |
| 3551 | LYD238 | barley\|gb157SOLEXA\|BF625618_P1 | 6967 | 662 | 88.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3552 | LYD238 | oat\|10v2\|GO583734_P1 | 6968 | 662 | 88.4 | globlastp |
| 3553 | LYD238 | rye\|gb164\|BE495984_P1 | 6969 | 662 | 87.9 | globlastp |
| 3554 | LYD238 | millet\|10v1\|EVO454PM015488_P1 | 6970 | 662 | 86.5 | globlastp |
| 3555 | LYD238 | brachypodium\|gb169\|BE216948_P1 | 6971 | 662 | 86 | globlastp |
| 3556 | LYD238 | lolium\|10v1\|AU245719_P1 | 6972 | 662 | 84.9 | globlastp |
| 3557 | LYD238 | wheat\|gb164\|BE516428_P1 | 6973 | 662 | 84.9 | globlastp |
| 3558 | LYD238 | sugarcane\|10v1\|CA065337_P1 | 6974 | 662 | 84.2 | globlastp |
| 3559 | LYD238 | sugarcane\|gb157.3\|CA071836_P1 | 6975 | 662 | 83.6 | globlastp |
| 3560 | LYD238 | sorghum\|09v1\|SB04G000330_P1 | 6976 | 662 | 83 | globlastp |
| 3561 | LYD238 | sugarcane\|gb157.3\|CA076155_T1 | 6977 | 662 | 82.58 | glotblastn |
| 3562 | LYD238 | cynodon\|10v1\|ES293159_T1 | 6978 | 662 | 82.02 | glotblastn |
| 3563 | LYD240 | wheat\|gb164\|BF200876_P1 | 6979 | 663 | 88.4 | globlastp |
| 3564 | LYD244 | arabidopsis_lyrata\|09v1\|JGIAL007321_P1 | 6980 | 664 | 94.5 | globlastp |
| 3565 | LYD244 | b_juncea\|10v2\|E6ANDIZ01DG4SQ_P1 | 6981 | 664 | 85.5 | globlastp |
| 3566 | LYD244 | b_oleracea\|gb161\|EH415612_P1 | 6981 | 664 | 85.5 | globlastp |
| 3567 | LYD244 | canola\|10v1\|CD830211_P1 | 6981 | 664 | 85.5 | globlastp |
| 3568 | LYD244 | canola\|gb161\|CD830211_P1 | 6981 | 664 | 85.5 | globlastp |
| 3569 | LYD244 | canola\|10v1\|CD830816_P1 | 6981 | 664 | 85.5 | globlastp |
| 3570 | LYD244 | canola\|gb161\|CD830816_P1 | 6981 | 664 | 85.5 | globlastp |
| 3571 | LYD244 | radish\|gb164\|EV525014_P1 | 6982 | 664 | 83.6 | globlastp |
| 3572 | LYD244 | b_juncea\|10v2\|E6ANDIZ01EPIVN_P1 | 6983 | 664 | 83 | globlastp |
| 3573 | LYD244 | radish\|gb164\|EV545064_P1 | 6984 | 664 | 81.8 | globlastp |
| 3574 | LYD244 | b_rapa\|gb162\|EX024633_P1 | 6985 | 664 | 80.6 | globlastp |
| 3575 | LYD245 | thellungiella\|gb167\|DN774029_P1 | 6986 | 665 | 87 | globlastp |
| 3576 | LYD245 | radish\|gb164\|EX750107_T1 | 6987 | 665 | 84.9 | glotblastn |
| 3577 | LYD245 | canola\|gb161\|EE477076_P1 | 6988 | 665 | 84.5 | globlastp |
| 3578 | LYD245 | arabidopsis_lyrata\|09v1\|TMPLEV566587T1_T1 | 6989 | 665 | 84.38 | glotblastn |
| 3579 | LYD245 | radish\|gb164\|EV566587_P1 | 6990 | 665 | 83.9 | globlastp |
| 3580 | LYD246 | arabidopsis\|10v1\|AT4G08580_P1 | 6991 | 666 | 98.2 | globlastp |
| 3581 | LYD246 | arabidopsis\|gb165\|AT4G08580_P1 | 6991 | 666 | 98.2 | globlastp |
| 3582 | LYD246 | arabidopsis_lyrata\|09v1\|JGIAL021498_P1 | 6992 | 666 | 94.5 | globlastp |
| 3583 | LYD248 | b_rapa\|gb162\|BQ790922_P1 | 6993 | 667 | 98.6 | globlastp |
| 3584 | LYD248 | canola\|gb161\|CD816144_P1 | 6994 | 667 | 97.6 | globlastp |
| 3585 | LYD248 | canola\|10v1\|CD816250_P1 | 6995 | 667 | 87.2 | globlastp |
| 3586 | LYD248 | canola\|gb161\|CD816250_P1 | 6995 | 667 | 87.2 | globlastp |
| 3587 | LYD248 | b_rapa\|gb162\|CV544898_P1 | 6996 | 667 | 86.6 | globlastp |
| 3588 | LYD248 | canola\|gb161\|CD813767_P1 | 6997 | 667 | 85.8 | globlastp |
| 3589 | LYD248 | arabidopsis_lyrata\|09v1\|JGIAL010389_P1 | 6998 | 667 | 85.6 | globlastp |
| 3590 | LYD248 | canola\|10v1\|CD813767_P1 | 6999 | 667 | 85.4 | globlastp |
| 3591 | LYD248 | arabidopsis\|10v1\|AT3G18490_P1 | 7000 | 667 | 84.4 | globlastp |
| 3592 | LYD248 | canola\|gb161\|CD820800_P1 | 7001 | 667 | 83.2 | globlastp |
| 3593 | LYD248 | canola\|10v1\|CD820800_P1 | 7002 | 667 | 83 | globlastp |
| 3594 | LYD248 | canola\|10v1\|CD816721_T1 | 7003 | 667 | 82 | glotblastn |
| 3595 | LYD250 | canola\|gb161\|EV168840_P1 | 7004 | 668 | 93 | globlastp |
| 3596 | LYD250 | radish\|gb164\|EX755649_P1 | 7005 | 668 | 93 | globlastp |
| 3597 | LYD250 | arabidopsis_lyrata\|09v1\|JGIAL012240_P1 | 7006 | 668 | 88.4 | globlastp |
| 3598 | LYD250 | arabidopsis\|10v1\|AT2G17730_P1 | 7007 | 668 | 86.4 | globlastp |
| 3599 | LYD250 | canola\|10v1\|CD813120_P1 | 7008 | 668 | 84.5 | globlastp |
| 3600 | LYD250 | canola\|gb161\|CD813120_P1 | 7008 | 668 | 84.5 | globlastp |
| 3601 | LYD250 | canola\|10v1\|DY023893_P1 | 7009 | 668 | 84.5 | globlastp |
| 3602 | LYD250 | canola\|gb161\|DY023893_P1 | 7009 | 668 | 84.5 | globlastp |
| 3603 | LYD250 | canola\|gb161\|CD820111_P1 | 7010 | 668 | 83.8 | globlastp |
| 3604 | LYD250 | arabidopsis_lyrata\|09v1\|JGIAL024385_P1 | 7011 | 668 | 83.7 | globlastp |
| 3605 | LYD250 | canola\|10v1\|CD820111_P1 | 7012 | 668 | 83.7 | globlastp |
| 3606 | LYD250 | arabidopsis\|10v1\|AT4G35840_P1 | 7013 | 668 | 83.3 | globlastp |
| 3607 | LYD250 | radish\|gb164\|EX763901_P1 | 7014 | 668 | 82.8 | globlastp |
| 3608 | LYD250 | b_rapa\|gb162\|EE520070_T1 | 7015 | 668 | 81.67 | glotblastn |
| 3609 | LYD250 | radish\|gb164\|EW724552_P1 | 7016 | 668 | 80.4 | globlastp |
| 3610 | LYD250 | b_rapa\|gb162\|EX039808_P1 | 7017 | 668 | 80 | globlastp |
| 3611 | LYD252 | b_juncea\|10v2\|E6ANDIZ01D3YNI_P1 | 7018 | 669 | 98.4 | globlastp |
| 3612 | LYD252 | b_juncea\|gb164\|EVGN04288230702644_P1 | 7019 | 669 | 98.4 | globlastp |
| 3613 | LYD252 | b_rapa\|gb162\|CV545283_P1 | 7018 | 669 | 98.4 | globlastp |
| 3614 | LYD252 | canola\|10v1\|CD811728_P1 | 7018 | 669 | 98.4 | globlastp |
| 3615 | LYD252 | canola\|gb161\|CD811728_P1 | 7018 | 669 | 98.4 | globlastp |
| 3616 | LYD252 | canola\|10v1\|CD840433_P1 | 7018 | 669 | 98.4 | globlastp |
| 3617 | LYD252 | canola\|gb161\|CD818666_P1 | 7018 | 669 | 98.4 | globlastp |
| 3618 | LYD252 | canola\|10v1\|CD832702_P1 | 7019 | 669 | 98.4 | globlastp |
| 3619 | LYD252 | radish\|gb164\|EX761962_P1 | 7019 | 669 | 98.4 | globlastp |
| 3620 | LYD252 | radish\|gb164\|EX904863_P1 | 7020 | 669 | 98.4 | globlastp |
| 3621 | LYD252 | thellungiella\|gb167\|BY813144_P1 | 7021 | 669 | 98.4 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3622 | LYD252 | b_juncea|10v2|E6ANDIZ01EDC4C1_P1 | 7022 | 669 | 97.6 | globlastp |
| 3623 | LYD252 | canola|10v1|DY012004_P1 | 7023 | 669 | 97.6 | globlastp |
| 3624 | LYD252 | b_oleracea|gb161|CO729379_P1 | 7024 | 669 | 97.6 | globlastp |
| 3625 | LYD252 | b_oleracea|gb161|DY027071_P1 | 7025 | 669 | 97.6 | globlastp |
| 3626 | LYD252 | canola|10v1|CD814099_P1 | 7024 | 669 | 97.6 | globlastp |
| 3627 | LYD252 | canola|gb161|CD814099_P1 | 7024 | 669 | 97.6 | globlastp |
| 3628 | LYD252 | canola|gb161|CD832702_P1 | 7026 | 669 | 97.6 | globlastp |
| 3629 | LYD252 | radish|gb164|EV567261_P1 | 7027 | 669 | 97.6 | globlastp |
| 3630 | LYD252 | radish|gb164|EX748940_P1 | 7028 | 669 | 97.6 | globlastp |
| 3631 | LYD252 | b_juncea|10v2|E6ANDIZ01CCOGE_P1 | 7029 | 669 | 96.8 | globlastp |
| 3632 | LYD252 | b_rapa|gb162|CX271124_P1 | 7030 | 669 | 96.8 | globlastp |
| 3633 | LYD252 | canola|10v1|CD817829_P1 | 7031 | 669 | 96.8 | globlastp |
| 3634 | LYD252 | canola|gb161|CD817829_P1 | 7031 | 669 | 96.8 | globlastp |
| 3635 | LYD252 | b_rapa|gb162|CV432392_P1 | 7032 | 669 | 96 | globlastp |
| 3636 | LYD252 | b_rapa|gb162|CV434073_P1 | 7032 | 669 | 96 | globlastp |
| 3637 | LYD252 | arabidopsis_lyrata|09v1|JGIAL028037_P1 | 7033 | 669 | 94.4 | globlastp |
| 3638 | LYD252 | radish|gb164|FD966947_P1 | 7034 | 669 | 93.8 | globlastp |
| 3639 | LYD252 | arabidopsis|10v1|AT5G47570_P1 | 7035 | 669 | 93.6 | globlastp |
| 3640 | LYD252 | arabidopsis|gb165|AT5G47570_P1 | 7035 | 669 | 93.6 | globlastp |
| 3641 | LYD252 | cleome_spinosa|10v1|SRR015531S0006615_P1 | 7036 | 669 | 91.2 | globlastp |
| 3642 | LYD252 | eucalyptus|gb166|CU400330_P1 | 7037 | 669 | 91.2 | globlastp |
| 3643 | LYD252 | papaya|gb165|EX278970_P1 | 7038 | 669 | 90.4 | globlastp |
| 3644 | LYD252 | cleome_spinosa|10v1|GR933959_P1 | 7039 | 669 | 89.6 | globlastp |
| 3645 | LYD252 | sesame|10v1|BU667421_P1 | 7040 | 669 | 89.6 | globlastp |
| 3646 | LYD252 | sesame|gb157.2|BU667421_P1 | 7040 | 669 | 89.6 | globlastp |
| 3647 | LYD252 | lettuce|gb157.2|DW084867_P1 | 7041 | 669 | 88.8 | globlastp |
| 3648 | LYD252 | lettuce|gb157.2|DW162422_P1 | 7041 | 669 | 88.8 | globlastp |
| 3649 | LYD252 | rhizophora|10v1|SRR005793S0012361_P1 | 7042 | 669 | 88 | globlastp |
| 3650 | LYD252 | tragopogon|10v1|SRR020205S0001878_P1 | 7043 | 669 | 88 | globlastp |
| 3651 | LYD252 | citrus|gb166|CB292761_P1 | 7044 | 669 | 88 | globlastp |
| 3652 | LYD252 | lettuce|gb157.2|DW107481_P1 | 7045 | 669 | 88 | globlastp |
| 3653 | LYD252 | liquorice|gb171|FS256375_P1 | 7046 | 669 | 88 | globlastp |
| 3654 | LYD252 | lettuce|10v1|DW052883_P1 | 7045 | 669 | 88 | globlastp |
| 3655 | LYD252 | oak|10v1|FN740810_P1 | 7047 | 669 | 87.2 | globlastp |
| 3656 | LYD252 | salvia|10v1|SRR014553S0000292_P1 | 7048 | 669 | 87.2 | globlastp |
| 3657 | LYD252 | bruguiera|gb166|BP941272_P1 | 7049 | 669 | 87.2 | globlastp |
| 3658 | LYD252 | tea|gb171|GE650523_P1 | 7050 | 669 | 87.2 | globlastp |
| 3659 | LYD252 | cleome_gynandra|10v1|SRR015532S0001846_P1 | 7051 | 669 | 86.4 | globlastp |
| 3660 | LYD252 | tea|10v1|GE650523_P1 | 7052 | 669 | 86.4 | globlastp |
| 3661 | LYD252 | antirrhinum|gb166|AJ786955_P1 | 7053 | 669 | 86.4 | globlastp |
| 3662 | LYD252 | apple|gb171|CN496843_P1 | 7054 | 669 | 86.4 | globlastp |
| 3663 | LYD252 | cassava|09v1|DV452287_P1 | 7055 | 669 | 86.4 | globlastp |
| 3664 | LYD252 | cassava|gb164|DV452287_P1 | 7055 | 669 | 86.4 | globlastp |
| 3665 | LYD252 | centaurea|gb166|EH782240_P1 | 7056 | 669 | 86.4 | globlastp |
| 3666 | LYD252 | grape|gb160|CA816525_P1 | 7057 | 669 | 86.4 | globlastp |
| 3667 | LYD252 | poplar|10v1|AI165259_P1 | 7058 | 669 | 86.4 | globlastp |
| 3668 | LYD252 | poplar|gb170|AI165259_P1 | 7058 | 669 | 86.4 | globlastp |
| 3669 | LYD252 | potato|gb157.2|BF052445_P1 | 7059 | 669 | 86.4 | globlastp |
| 3670 | LYD252 | potato|gb157.2|BQ519344_P1 | 7059 | 669 | 86.4 | globlastp |
| 3671 | LYD252 | solanum_phureja|09v1|SPHBG133401_P1 | 7059 | 669 | 86.4 | globlastp |
| 3672 | LYD252 | tomato|09v1|BG133401_P1 | 7060 | 669 | 86.4 | globlastp |
| 3673 | LYD252 | tomato|gb164|BG133401_P1 | 7060 | 669 | 86.4 | globlastp |
| 3674 | LYD252 | potato|10v1|BF052445_P1 | 7059 | 669 | 86.4 | globlastp |
| 3675 | LYD252 | acacia|10v1|FS584402_P1 | 7061 | 669 | 85.6 | globlastp |
| 3676 | LYD252 | ipomoea_nil|10v1|BJ556249_P1 | 7062 | 669 | 85.6 | globlastp |
| 3677 | LYD252 | beet|gb162|BQ592121_T1 | 7063 | 669 | 85.6 | glotblastn |
| 3678 | LYD252 | chestnut|gb170|SRR006295S0021181_P1 | 7064 | 669 | 85.6 | globlastp |
| 3679 | LYD252 | cotton|10v1|CO070890_P1 | 7065 | 669 | 85.6 | globlastp |
| 3680 | LYD252 | cotton|gb164|AW187773_P1 | 7065 | 669 | 85.6 | globlastp |
| 3681 | LYD252 | ipomoea|gb157.2|BJ556249_P1 | 7062 | 669 | 85.6 | globlastp |
| 3682 | LYD252 | nicotiana_benthamiana|gb162|CN744797_P1 | 7066 | 669 | 85.6 | globlastp |
| 3683 | LYD252 | prunus|10v1|CB819220_P1 | 7067 | 669 | 85.6 | globlastp |
| 3684 | LYD252 | prunus|gb167|CB819220_P1 | 7067 | 669 | 85.6 | globlastp |
| 3685 | LYD252 | senecio|gb170|SRR006592S0007335_P1 | 7068 | 669 | 85.6 | globlastp |
| 3686 | LYD252 | tobacco|gb162|CV020459_T1 | 7069 | 669 | 85.6 | glotblastn |
| 3687 | LYD252 | walnuts|gb166|CV195294_P1 | 7070 | 669 | 84.9 | globlastp |
| 3688 | LYD252 | dandelion|10v1|DR399370_P1 | 7071 | 669 | 84.8 | globlastp |
| 3689 | LYD252 | sunflower|10v1|CD847361_P1 | 7072 | 669 | 84.8 | globlastp |
| 3690 | LYD252 | cotton|10v1|BF269151_P1 | 7073 | 669 | 84.8 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3691 | LYD252 | cynara\|gb167\|GE586064_P1 | 7074 | 669 | 84.8 | globlastp |
| 3692 | LYD252 | dandelion\|10v1\|DY817824_P1 | 7071 | 669 | 84.8 | globlastp |
| 3693 | LYD252 | dandelion\|gb161\|DY817824_P1 | 7071 | 669 | 84.8 | globlastp |
| 3694 | LYD252 | liriodendron\|gb166\|FD489562_P1 | 7075 | 669 | 84.8 | globlastp |
| 3695 | LYD252 | monkeyflower\|09v1\|GO963842_P1 | 7076 | 669 | 84.8 | globlastp |
| 3696 | LYD252 | monkeyflower\|10v1\|GO963842_P1 | 7076 | 669 | 84.8 | globlastp |
| 3697 | LYD252 | pepper\|gb171\|BM064183_P1 | 7077 | 669 | 84.8 | globlastp |
| 3698 | LYD252 | petunia\|gb171\|DY395455_P1 | 7078 | 669 | 84.8 | globlastp |
| 3699 | LYD252 | sunflower\|gb162\|CD847361_P1 | 7072 | 669 | 84.8 | globlastp |
| 3700 | LYD252 | tobacco\|gb162\|CV020284_P1 | 7079 | 669 | 84.8 | globlastp |
| 3701 | LYD252 | triphysaria\|10v1\|EX990359_P1 | 7080 | 669 | 84.8 | globlastp |
| 3702 | LYD252 | coffea\|10v1\|DV673928_P1 | 7081 | 669 | 84 | globlastp |
| 3703 | LYD252 | dandelion\|10v1\|DY835786_T1 | 7082 | 669 | 84 | glotblastn |
| 3704 | LYD252 | eggplant\|10v1\|FS000144_P1 | 7083 | 669 | 84 | globlastp |
| 3705 | LYD252 | centaurea\|gb166\|EH737005_P1 | 7084 | 669 | 84 | globlastp |
| 3706 | LYD252 | cotton\|gb164\|BF269151_P1 | 7085 | 669 | 84 | globlastp |
| 3707 | LYD252 | cowpea\|gb166\|FC458079_P1 | 7086 | 669 | 84 | globlastp |
| 3708 | LYD252 | petunia\|gb171\|CV296748_P1 | 7087 | 669 | 84 | globlastp |
| 3709 | LYD252 | soybean\|gb168\|BE320813_P1 | 7086 | 669 | 84 | globlastp |
| 3710 | LYD252 | triphysaria\|gb164\|EX990359_P1 | 7088 | 669 | 84 | globlastp |
| 3711 | LYD252 | kiwi\|gb166\|FG429909_P1 | 7089 | 669 | 83.7 | globlastp |
| 3712 | LYD252 | artemisia\|10v1\|EY037110_P1 | 7090 | 669 | 83.2 | globlastp |
| 3713 | LYD252 | ipomoea_batatas\|10v1\|EE881968_P1 | 7091 | 669 | 83.2 | globlastp |
| 3714 | LYD252 | triphysaria\|10v1\|EY018432_P1 | 7092 | 669 | 83.2 | globlastp |
| 3715 | LYD252 | artemisia\|gb164\|EY037110_P1 | 7090 | 669 | 83.2 | globlastp |
| 3716 | LYD252 | bean\|gb167\|CA912723_P1 | 7093 | 669 | 83.2 | globlastp |
| 3717 | LYD252 | castorbean\|09v1\|EG667738_T1 | 7094 | 669 | 83.2 | glotblastn |
| 3718 | LYD252 | oil_palm\|gb166\|EL684852_P1 | 7095 | 669 | 83.2 | globlastp |
| 3719 | LYD252 | peanut\|10v1\|EE125818_P1 | 7096 | 669 | 83.2 | globlastp |
| 3720 | LYD252 | peanut\|gb171\|EC365309_P1 | 7096 | 669 | 83.2 | globlastp |
| 3721 | LYD252 | pigeonpea\|gb171\|GR471435_P1 | 7097 | 669 | 83.2 | globlastp |
| 3722 | LYD252 | soybean\|gb168\|CA899926_P1 | 7098 | 669 | 83.2 | globlastp |
| 3723 | LYD252 | strawberry\|gb164\|CX662144_P1 | 7099 | 669 | 83.2 | globlastp |
| 3724 | LYD252 | b_juncea\|10v2\|E6ANDIZ01BOR0S1_P1 | 7100 | 669 | 82.4 | globlastp |
| 3725 | LYD252 | rose\|10v1\|BQ105459_P1 | 7101 | 669 | 82.4 | globlastp |
| 3726 | LYD252 | basilicum\|gb157.3\|DY323437_P1 | 7102 | 669 | 82.4 | globlastp |
| 3727 | LYD252 | bean\|gb167\|CA899926_P1 | 7103 | 669 | 82.4 | globlastp |
| 3728 | LYD252 | bean\|gb167\|EH040312_P1 | 7103 | 669 | 82.4 | globlastp |
| 3729 | LYD252 | chickpea\|09v2\|GR392149_P1 | 7104 | 669 | 82.4 | globlastp |
| 3730 | LYD252 | lettuce\|gb157.2\|DW052883_T1 | 7105 | 669 | 82.4 | glotblastn |
| 3731 | LYD252 | pigeonpea\|10v1\|GW346529XX2_T1 | 7106 | 669 | 82.4 | glotblastn |
| 3732 | LYD252 | tamarix\|gb166\|EH052332_P1 | 7107 | 669 | 82.4 | globlastp |
| 3733 | LYD252 | b_oleracea\|gb161\|EH421962_P1 | 7108 | 669 | 81.5 | globlastp |
| 3734 | LYD252 | nasturtium\|10v1\|SRR032558S0000551_P1 | 7109 | 669 | 80.8 | globlastp |
| 3735 | LYD252 | avocado\|10v1\|CK759662_T1 | 7110 | 669 | 80.8 | glotblastn |
| 3736 | LYD252 | avocado\|gb164\|CK759662_T1 | 7111 | 669 | 80.8 | glotblastn |
| 3737 | LYD252 | medicago\|09v1\|BE239635_P1 | 7112 | 669 | 80.8 | globlastp |
| 3738 | LYD252 | oak\|gb170\|SRR006307S0004113_P1 | 7113 | 669 | 80.8 | globlastp |
| 3739 | LYD252 | cucumber\|09v1\|AB029112_P1 | 7114 | 669 | 80.3 | globlastp |
| 3740 | LYD252 | melon\|10v1\|AM714236_P1 | 7114 | 669 | 80.3 | globlastp |
| 3741 | LYD252 | melon\|gb165\|AM714236_P1 | 7114 | 669 | 80.3 | globlastp |
| 3742 | LYD252 | orobanche\|10v1\|SRR023189S0009680_P1 | 7115 | 669 | 80 | globlastp |
| 3743 | LYD252 | gerbera\|09v1\|AJ759705_P1 | 7116 | 669 | 80 | globlastp |
| 3744 | LYD253 | arabidopsis_lyrata\|09v1\|JGIAL013828_P1 | 7117 | 670 | 97.4 | globlastp |
| 3745 | LYD253 | arabidopsis_lyrata\|09v1\|JGIAL000784_P1 | 7118 | 670 | 96.1 | globlastp |
| 3746 | LYD253 | cacao\|gb167\|CU481903_P1 | 7119 | 670 | 91.3 | globlastp |
| 3747 | LYD253 | soybean\|gb168\|BE352739_P1 | 7120 | 670 | 91 | globlastp |
| 3748 | LYD253 | cotton\|10v1\|AI725856_P1 | 7121 | 670 | 90.7 | globlastp |
| 3749 | LYD253 | cotton\|gb164\|AI725856_P1 | 7121 | 670 | 90.7 | globlastp |
| 3750 | LYD253 | bean\|gb167\|CA900778_P1 | 7122 | 670 | 90.2 | globlastp |
| 3751 | LYD253 | cowpea\|gb166\|FC459485_P1 | 7123 | 670 | 90 | globlastp |
| 3752 | LYD253 | lotus\|09v1\|BE122579_P1 | 7124 | 670 | 90 | globlastp |
| 3753 | LYD253 | peanut\|10v1\|CD038740_P1 | 7125 | 670 | 90 | globlastp |
| 3754 | LYD253 | peanut\|gb171\|CD038740_P1 | 7125 | 670 | 90 | globlastp |
| 3755 | LYD253 | ipomoea_nil\|10v1\|BJ553783_P1 | 7126 | 670 | 89.7 | globlastp |
| 3756 | LYD253 | orobanche\|10v1\|SRR023189S0017090_P1 | 7127 | 670 | 89.7 | globlastp |
| 3757 | LYD253 | apple\|gb171\|CN897567_P1 | 7128 | 670 | 89.7 | globlastp |
| 3758 | LYD253 | ipomoea\|gb157.2\|BJ566712_P1 | 7129 | 670 | 89.7 | globlastp |
| 3759 | LYD253 | pepper\|gb171\|BM064196_P1 | 7130 | 670 | 89.7 | globlastp |
| 3760 | LYD253 | tobacco\|gb162\|CV016523_P1 | 7131 | 670 | 89.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3761 | LYD253 | apple\|gb171\|CN489113_P1 | 7132 | 670 | 89.5 | globlastp |
| 3762 | LYD253 | potato\|10v1\|BG597511_P1 | 7133 | 670 | 89.5 | globlastp |
| 3763 | LYD253 | potato\|gb157.2\|BG597511_P1 | 7133 | 670 | 89.5 | globlastp |
| 3764 | LYD253 | solanum_phureja\|09v1\|SPHBG126888_P1 | 7134 | 670 | 89.5 | globlastp |
| 3765 | LYD253 | tomato\|09v1\|BG126888_P1 | 7135 | 670 | 89.5 | globlastp |
| 3766 | LYD253 | tomato\|gb164\|BG126888_P1 | 7135 | 670 | 89.5 | globlastp |
| 3767 | LYD253 | triphysaria\|10v1\|BM356747_P1 | 7136 | 670 | 89.5 | globlastp |
| 3768 | LYD253 | triphysaria\|gb164\|BM356747_P1 | 7136 | 670 | 89.5 | globlastp |
| 3769 | LYD253 | prunus\|10v1\|BU039615_P1 | 7137 | 670 | 89.3 | globlastp |
| 3770 | LYD253 | nasturtium\|10v1\|SRR032558S0017324_P1 | 7138 | 670 | 89.2 | globlastp |
| 3771 | LYD253 | orobanche\|10v1\|SRR023189S0044816_P1 | 7139 | 670 | 89.2 | globlastp |
| 3772 | LYD253 | aquilegia\|gb157.3\|DR917957_P1 | 7140 | 670 | 89.2 | globlastp |
| 3773 | LYD253 | prunus\|gb167\|BU039615_P1 | 7141 | 670 | 89 | globlastp |
| 3774 | LYD253 | soybean\|gb168\|AW329346_P1 | 7142 | 670 | 88.9 | globlastp |
| 3775 | LYD253 | melon\|10v1\|DV635041_P1 | 7143 | 670 | 88.7 | globlastp |
| 3776 | LYD253 | pepper\|gb171\|BM062796_P1 | 7144 | 670 | 88.7 | globlastp |
| 3777 | LYD253 | sunflower\|10v1\|CD849269_P1 | 7145 | 670 | 88.7 | globlastp |
| 3778 | LYD253 | sunflower\|gb162\|CD849269_P1 | 7145 | 670 | 88.7 | globlastp |
| 3779 | LYD253 | cucumber\|09v1\|DN909683_P1 | 7146 | 670 | 88.5 | globlastp |
| 3780 | LYD253 | sunflower\|10v1\|CX946716_P1 | 7147 | 670 | 88.4 | globlastp |
| 3781 | LYD253 | bean\|gb167\|CA901796_P1 | 7148 | 670 | 88.4 | globlastp |
| 3782 | LYD253 | artemisia\|gb164\|EY074319_P1 | 7149 | 670 | 88.2 | globlastp |
| 3783 | LYD253 | soybean\|gb168\|BE205188_P1 | 7150 | 670 | 88 | globlastp |
| 3784 | LYD253 | tobacco\|gb162\|DV160802_T1 | 7151 | 670 | 87.92 | glotblastn |
| 3785 | LYD253 | nasturtium\|10v1\|SRR032558S0003407_P1 | 7152 | 670 | 87.9 | globlastp |
| 3786 | LYD253 | nicotiana_benthamiana\|gb162\|AY391715_P1 | 7153 | 670 | 87.9 | globlastp |
| 3787 | LYD253 | artemisia\|10v1\|EY062281_P1 | 7154 | 670 | 87.7 | globlastp |
| 3788 | LYD253 | medicago\|09v1\|LLAW256687_P1 | 7155 | 670 | 87.7 | globlastp |
| 3789 | LYD253 | petunia\|gb171\|CV300000_P1 | 7156 | 670 | 87.7 | globlastp |
| 3790 | LYD253 | peanut\|10v1\|EE125037_P1 | 7157 | 670 | 87.3 | globlastp |
| 3791 | LYD253 | clover\|gb162\|BB902680_P1 | 7158 | 670 | 87.2 | globlastp |
| 3792 | LYD253 | cowpea\|gb166\|FC459335_P1 | 7159 | 670 | 87.2 | globlastp |
| 3793 | LYD253 | petunia\|gb171\|CV293199_P1 | 7160 | 670 | 87.2 | globlastp |
| 3794 | LYD253 | senecio\|gb170\|DY658575_P1 | 7161 | 670 | 86.9 | globlastp |
| 3795 | LYD253 | artemisia\|gb164\|EY062281_P1 | 7162 | 670 | 86.5 | globlastp |
| 3796 | LYD253 | aquilegia\|10v1\|DT732268_T1 | 7163 | 670 | 85.5 | glotblastn |
| 3796 | LYD253 | aquilegia\|gb157.3\|DT732268_T1 | 7164 | 670 | 85.5 | glotblastn |
| 3797 | LYD253 | triphysaria\|10v1\|EX993275_P1 | 7165 | 670 | 85.1 | globlastp |
| 3798 | LYD253 | cryptomeria\|gb166\|AU298755_P1 | 7166 | 670 | 84.4 | globlastp |
| 3799 | LYD253 | pine\|10v1\|AA556316_P1 | 7167 | 670 | 83.6 | globlastp |
| 3800 | LYD253 | pine\|gb157.2\|AA556316_P1 | 7167 | 670 | 83.6 | globlastp |
| 3801 | LYD253 | spruce\|gb162\|CO225443_P1 | 7168 | 670 | 83.3 | globlastp |
| 3802 | LYD253 | barley\|10v1\|BG299537_P1 | 7169 | 670 | 83 | globlastp |
| 3803 | LYD253 | barley\|gb157SOLEXA\|AL450653_P1 | 7169 | 670 | 83 | globlastp |
| 3804 | LYD253 | switchgrass\|gb167\|FL691026_P1 | 7170 | 670 | 82.6 | globlastp |
| 3805 | LYD253 | medicago\|09v1\|CRPMT031758_T1 | 7171 | 670 | 82.52 | glotblastn |
| 3806 | LYD253 | maize\|gb170\|AI372143_P1 | 7172 | 670 | 81.5 | globlastp |
| 3807 | LYD253 | maize\|gb170\|LLDR828710_P1 | 7172 | 670 | 81.5 | globlastp |
| 3808 | LYD253 | maize\|10v1\|AI372143_P1 | 7172 | 670 | 81.5 | globlastp |
| 3809 | LYD253 | brachypodium\|09v1\|DV478807_P1 | 7173 | 670 | 81.4 | globlastp |
| 3810 | LYD253 | brachypodium\|gb169\|BE414141_P1 | 7173 | 670 | 81.4 | globlastp |
| 3811 | LYD253 | centaurea\|gb166\|EH718869_T1 | 7174 | 670 | 81.23 | glotblastn |
| 3812 | LYD253 | sugarcane\|gb157.3\|CA084163_T1 | 7175 | 670 | 80.98 | glotblastn |
| 3813 | LYD253 | rice\|gb170\|OS01G73790_P1 | 7176 | 670 | 80.9 | globlastp |
| 3814 | LYD253 | sorghum\|09v1\|SB03G047200_P1 | 7177 | 670 | 80.4 | globlastp |
| 3815 | LYD253 | millet\|10v1\|EVO454PM000133_P1 | 7178 | 670 | 80.2 | globlastp |
| 3816 | LYD253 | tobacco\|gb162\|EB428947_P1 | 7179 | 670 | 80.2 | globlastp |
| 3817 | LYD253 | maize\|10v1\|AI795749_P1 | 7180 | 670 | 80.1 | globlastp |
| 3818 | LYD253 | maize\|gb170\|AI795749_P1 | 7180 | 670 | 80.1 | globlastp |
| 3819 | LYD256 | arabidopsis\|10v1\|AT1G75500_P1 | 7181 | 671 | 95.9 | globlastp |
| 3820 | LYD256 | arabidopsis_lyrata\|09v1\|JGIAL007823_P1 | 7182 | 671 | 95.7 | globlastp |
| 3821 | LYD256 | b_rapa\|gb162\|AT002231_P1 | 7183 | 671 | 95.2 | globlastp |
| 3822 | LYD256 | castorbean\|09v1\|EE256014_P1 | 7184 | 671 | 80.1 | globlastp |
| 3823 | LYD257 | canola\|gb161\|CD825913_P1 | 7185 | 672 | 90.7 | globlastp |
| 3824 | LYD257 | b_rapa\|gb162\|EX036030_P1 | 7186 | 672 | 87.5 | globlastp |
| 3825 | LYD257 | radish\|gb164\|EX773473_P1 | 7187 | 672 | 86.9 | globlastp |
| 3826 | LYD260 | radish\|gb164\|FD571121_T1 | 7188 | 673 | 86.86 | glotblastn |
| 3827 | LYD267 | canola\|10v1\|EL588214_P1 | 7189 | 677 | 97.3 | globlastp |
| 3828 | LYD267 | b_rapa\|gb162\|EX090717_P1 | 7190 | 677 | 94.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3829 | LYD267 | canola\|gb161\|EL588214_P1 | 7191 | 677 | 91 | globlastp |
| 3830 | LYD267 | arabidopsis\|10v1\|AT1G64790_T1 | 813 | 677 | 88.86 | glotblastn |
| 3831 | LYD267 | arabidopsis_lyrata\|09v1\|JGIAL006242_T1 | 7192 | 677 | 88.14 | glotblastn |
| 3831 | LYD267_H0 | arabidopsis_lyrata\|09v1\|JGIAL006242_P1 | 7192 | 693 | 96.9 | globlastp |
| 3832 | LYD267 | radish\|gb164\|EX773772_P1 | 7193 | 677 | 84.3 | globlastp |
| 3833 | LYD271 | b_rapa\|gb162\|BG543457_P1 | 7194 | 679 | 93.3 | globlastp |
| 3833 | LYD271_H0 | b_rapa\|gb162\|BG543457_P1 | 7194 | 694 | 91.8 | globlastp |
| 3834 | LYD271 | arabidopsis\|10v1\|AT2G47240_P1 | 694 | 679 | 90.6 | globlastp |
| 3835 | LYD271 | arabidopsis_lyrata\|09v1\|TMPLAT2G47240T1_P1 | 7195 | 679 | 90.5 | globlastp |
| 3835 | LYD271_H0 | arabidopsis_lyrata\|09v1\|TMPLAT2G47240T1_P1 | 7195 | 694 | 99.8 | globlastp |
| 3836 | LYD271 | arabidopsis_lyrata\|09v1\|JGIAL016147_P1 | 7196 | 679 | 90 | globlastp |
| 3836 | LYD271_H0 | arabidopsis_lyrata\|09v1\|JGIAL016147_P1 | 7196 | 694 | 97.7 | globlastp |
| 3837 | LYD271 | canola\|gb161\|BQ704756_P1 | 7197 | 679 | 89.7 | globlastp |
| 3837 | LYD271_H0 | canola\|gb161\|BQ704756_P1 | 7197 | 694 | 90.6 | globlastp |
| 3838 | LYD271 | canola\|10v1\|CX189606_P1 | 7198 | 679 | 89.2 | globlastp |
| 3838 | LYD271_H0 | canola\|10v1\|CX189606_P1 | 7198 | 694 | 90.5 | globlastp |
| 3839 | LYD275 | b_oleracea\|gb161\|EE535125_T1 | 7199 | 681 | 100 | glotblastn |
| 3840 | LYD275 | b_rapa\|gb162\|CV432945_T1 | 7200 | 681 | 100 | glotblastn |
| 3841 | LYD275 | canola\|10v1\|DW997986_P1 | 7201 | 681 | 98.6 | globlastp |
| 3842 | LYD275 | canola\|gb161\|DW997986_T1 | 7202 | 681 | 98.57 | glotblastn |
| 3843 | LYD275 | canola\|gb161\|CD811838_T1 | 7203 | 681 | 97.14 | glotblastn |
| 3844 | LYD275 | canola\|10v1\|CD811838_P1 | 7204 | 681 | 97.1 | globlastp |
| 3845 | LYD275 | b_nigra\|09v1\|GT069340_P1 | 7205 | 681 | 95.8 | globlastp |
| 3846 | LYD275 | radish\|gb164\|EW726140_P1 | 7206 | 681 | 95.8 | globlastp |
| 3847 | LYD275 | thellungiella\|gb167\|BY806064_P1 | 7207 | 681 | 95.7 | globlastp |
| 3848 | LYD275 | b_juncea\|10v2\|E6ANDIZ01B0QZR_P1 | 7208 | 681 | 94.5 | globlastp |
| 3849 | LYD275 | radish\|gb164\|EW715126_T1 | 7209 | 681 | 92.96 | glotblastn |
| 3850 | LYD275 | arabidopsis_lyrata\|09v1\|JGIAL011098_T1 | 7210 | 681 | 87.14 | glotblastn |
| 3851 | LYD275 | bruguiera\|gb166\|BP941672_P1 | 7211 | 681 | 86.1 | globlastp |
| 3852 | LYD275 | arabidopsis\|gb165\|AT3G24100_T1 | 7212 | 681 | 85.92 | glotblastn |
| 3852 | LYD275 | arabidopsis\|10v1\|AT3G24100_P1 | 7213 | 681 | 85.9 | globlastp |
| 3853 | LYD275 | b_juncea\|10v2\|E6ANDIZ01A1JBJ_P1 | 7214 | 681 | 84.5 | globlastp |
| 3854 | LYD275 | b_juncea\|gb164\|EVGN00148214090597_P1 | 7214 | 681 | 84.5 | globlastp |
| 3855 | LYD275 | cleome_gynandra\|10v1\|SRR015532S0021751_P1 | 7215 | 681 | 84.3 | globlastp |
| 3856 | LYD275 | catharanthus\|gb166\|EG554988_P1 | 7216 | 681 | 84.3 | globlastp |
| 3857 | LYD275 | b_juncea\|gb164\|EVGN21009617052518_T1 | 7217 | 681 | 84.29 | glotblastn |
| 3858 | LYD275 | b_juncea\|10v2\|E6ANDIZ01A3AK6_P1 | 7218 | 681 | 83.3 | globlastp |
| 3859 | LYD275 | b_juncea\|10v2\|E6ANDIZ01A9VK9_P1 | 7218 | 681 | 83.3 | globlastp |
| 3860 | LYD275 | b_juncea\|gb164\|EVGN00053230610138_P1 | 7218 | 681 | 83.3 | globlastp |
| 3861 | LYD275 | b_oleracea\|gb161\|AM057498_P1 | 7218 | 681 | 83.3 | globlastp |
| 3862 | LYD275 | b_rapa\|gb162\|CV433987_P1 | 7218 | 681 | 83.3 | globlastp |
| 3863 | LYD275 | b_rapa\|gb162\|CX270574_P1 | 7218 | 681 | 83.3 | globlastp |
| 3864 | LYD275 | b_rapa\|gb162\|L38045_P1 | 7218 | 681 | 83.3 | globlastp |
| 3865 | LYD275 | canola\|10v1\|CD811804_P1 | 7219 | 681 | 83.3 | globlastp |
| 3866 | LYD275 | canola\|gb161\|CD811804_P1 | 7219 | 681 | 83.3 | globlastp |
| 3867 | LYD275 | canola\|10v1\|CD812134_P1 | 7218 | 681 | 83.3 | globlastp |
| 3868 | LYD275 | canola\|gb161\|CD812134_P1 | 7218 | 681 | 83.3 | globlastp |
| 3869 | LYD275 | radish\|gb164\|EV534832_P1 | 7220 | 681 | 83.3 | globlastp |
| 3870 | LYD275 | radish\|gb164\|EV544053_P1 | 7220 | 681 | 83.3 | globlastp |
| 3871 | LYD275 | arabidopsis\|10v1\|AT4G13615_P1 | 7221 | 681 | 83.1 | globlastp |
| 3872 | LYD275 | arabidopsis\|gb165\|AT4G13615_P1 | 7221 | 681 | 83.1 | globlastp |
| 3873 | LYD275 | cleome_spinosa\|10v1\|SRR015531S0030693_P1 | 7222 | 681 | 82.9 | globlastp |
| 3874 | LYD275 | orobanche\|10v1\|SRR023189S0002896_P1 | 7223 | 681 | 82.9 | globlastp |
| 3875 | LYD275 | jatropha\|09v1\|GH295750_P1 | 7224 | 681 | 82.9 | globlastp |
| 3876 | LYD275 | lettuce\|10v1\|DW044456_P1 | 7225 | 681 | 82.9 | globlastp |
| 3877 | LYD275 | radish\|gb164\|EW723920_P1 | 7226 | 681 | 82.9 | globlastp |
| 3878 | LYD275 | safflower\|gb162\|EL405248_P1 | 7227 | 681 | 82.9 | globlastp |
| 3879 | LYD275 | tea\|gb171\|GH623887_P1 | 7228 | 681 | 82.9 | globlastp |
| 3880 | LYD275 | citrus\|gb166\|BQ622948_T1 | 7229 | 681 | 82.86 | glotblastn |
| 3881 | LYD275 | cassava\|09v1\|CK650049_P1 | 7230 | 681 | 81.9 | globlastp |
| 3882 | LYD275 | thellungiella\|gb167\|EC599068_P1 | 7231 | 681 | 81.7 | globlastp |
| 3883 | LYD275 | basilicum\|10v1\|DY322319_P1 | 7232 | 681 | 81.4 | globlastp |
| 3884 | LYD275 | centaurea\|gb166\|EH719505_P1 | 7233 | 681 | 81.4 | globlastp |
| 3885 | LYD275 | lettuce\|10v1\|DW103133_P1 | 7234 | 681 | 81.4 | globlastp |
| 3886 | LYD275 | kiwi\|gb166\|FG441257_P1 | 7235 | 681 | 81.4 | globlastp |
| 3887 | LYD275 | lettuce\|10v1\|DW122916_P1 | 7236 | 681 | 81.4 | globlastp |
| 3888 | LYD275 | lettuce\|gb157.2\|DW122916_P1 | 7236 | 681 | 81.4 | globlastp |
| 3889 | LYD275 | poplar\|10v1\|BI123668_P1 | 7237 | 681 | 81.4 | globlastp |
| 3890 | LYD275 | poplar\|gb170\|BI123668_P1 | 7237 | 681 | 81.4 | globlastp |
| 3891 | LYD275 | poplar\|10v1\|CN521361_P1 | 7238 | 681 | 80.3 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3892 | LYD275 | poplar\|gb170\|CN521361_P1 | 7238 | 681 | 80.3 | globlastp |
| 3893 | LYD275 | cassava\|gb164\|CK650049_T1 | 7239 | 681 | 80.28 | glotblastn |
| 3894 | LYD275 | cleome_gynandra\|10v1\|SRR015532S0006496_P1 | 7240 | 681 | 80 | globlastp |
| 3895 | LYD275 | cleome_spinosa\|10v1\|SRR015531S0002266_P1 | 7241 | 681 | 80 | globlastp |
| 3896 | LYD275 | melon\|10v1\|EB715280_P1 | 7242 | 681 | 80 | globlastp |
| 3897 | LYD275 | antirrhinum\|gb166\|AJ788137_P1 | 7243 | 681 | 80 | globlastp |
| 3898 | LYD275 | gerbera\|09v1\|AJ751325_P1 | 7244 | 681 | 80 | globlastp |
| 3899 | LYD275 | melon\|gb165\|EB715280_P1 | 7242 | 681 | 80 | globlastp |
| 3900 | LYD278 | canola\|10v1\|CN830844_P1 | 7245 | 683 | 95.9 | globlastp |
| 3901 | LYD278 | canola\|gb161\|CN830844_P1 | 7245 | 683 | 95.9 | globlastp |
| 3902 | LYD278 | arabidopsis\|10v1\|AT4G28480_P1 | 7246 | 683 | 83.7 | globlastp |
| 3903 | LYD278 | citrus\|gb166\|BQ624949_P1 | 7247 | 683 | 81.3 | globlastp |
| 3904 | LYD278 | spurge\|gb161\|BE231328_P1 | 7248 | 683 | 81.2 | globlastp |
| 3905 | LYD278 | cassava\|09v1\|DR084651_P1 | 7249 | 683 | 80.2 | globlastp |
| 3906 | LYD278 | cowpea\|gb166\|FC461152_P1 | 7250 | 683 | 80.2 | globlastp |
| 3907 | LYD279 | arabidopsis\|gb165\|AT3G10740_P1 | 7251 | 684 | 90.6 | globlastp |
| 3907 | LYD279 | arabidopsis\|10v1\|AT3G10740_P1 | 7253 | 684 | 90.3 | globlastp |
| 3908 | LYD279 | arabidopsis_lyrata\|09v1\|JGIAL009496_P1 | 7252 | 684 | 90.5 | globlastp |
| 3909 | LYD282 | arabidopsis_lyrata\|09v1\|JGIAL003543_P1 | 7254 | 685 | 83 | globlastp |
| 3910 | LYD283 | b_rapa\|gb162\|CA991797_P1 | 7255 | 686 | 99.6 | globlastp |
| 3911 | LYD283 | canola\|10v1\|CN727072_P1 | 7256 | 686 | 99.3 | globlastp |
| 3912 | LYD283 | radish\|gb164\|EV535929_P1 | 7257 | 686 | 97 | globlastp |
| 3913 | LYD283 | arabidopsis_lyrata\|09v1\|JGIAL016001_P1 | 7258 | 686 | 94.1 | globlastp |
| 3914 | LYD283 | canola\|10v1\|CD814370_P1 | 7259 | 686 | 93.7 | globlastp |
| 3915 | LYD283 | arabidopsis\|10v1\|AT2G45990_P1 | 7260 | 686 | 92.6 | globlastp |
| 3916 | LYD283 | cleome_spinosa\|10v1\|SRR015531S0008712_P1 | 7261 | 686 | 88.1 | globlastp |
| 3917 | LYD283 | thellungiella\|gb167\|BY806738_P1 | 7262 | 686 | 83.6 | globlastp |
| 3918 | LYD283 | castorbean\|09v1\|XM002511832_P1 | 7263 | 686 | 81.4 | globlastp |
| 3919 | LYD283 | citrus\|gb166\|CV885783_P1 | 7264 | 686 | 81.4 | globlastp |
| 3920 | LYD283 | prunus\|10v1\|CN862535_P1 | 7265 | 686 | 81.4 | globlastp |
| 3921 | LYD283 | prunus\|gb167\|CV047726_P1 | 7266 | 686 | 80.7 | globlastp |
| 3922 | LYD283 | nasturtium\|10v1\|SRR032558S0041419_P1 | 7267 | 686 | 80.1 | globlastp |
| 3923 | LYD285 | canola\|10v1\|CD811710_P1 | 7268 | 687 | 99.6 | globlastp |
| 3924 | LYD285 | canola\|gb161\|CD811710_P1 | 7268 | 687 | 99.6 | globlastp |
| 3925 | LYD285 | maize\|gb170\|LLDQ245309_P1 | 7268 | 687 | 99.6 | globlastp |
| 3926 | LYD285 | b_rapa\|gb162\|BG543481_P1 | 7269 | 687 | 98.2 | globlastp |
| 3927 | LYD285 | thellungiella\|gb167\|BY810002_P1 | 7270 | 687 | 90.6 | globlastp |
| 3928 | LYD285 | arabidopsis_lyrata\|09v1\|JGIAL017442_P1 | 7271 | 687 | 85 | globlastp |
| 3929 | LYD285 | arabidopsis\|10v1\|AT3G44260_P1 | 7272 | 687 | 84.3 | globlastp |
| 3930 | LYD285 | arabidopsis_lyrata\|09v1\|JGIAL021902_P1 | 7273 | 687 | 81.2 | globlastp |
| 3931 | LYD285 | canola\|gb161\|EV120613_T1 | 7274 | 687 | 81.09 | glotblastn |
| 3932 | LYD285 | canola\|10v1\|EV120613_P1 | 7275 | 687 | 80.7 | globlastp |
| 3933 | LYD285 | canola\|10v1\|EV132851_P1 | 7276 | 687 | 80.4 | globlastp |
| 3934 | LYD286 | b_juncea\|10v2\|E6ANDIZ02GYJJE_T1 | 7277 | 688 | 81.74 | glotblastn |
| 3935 | LYD287 | arabidopsis_lyrata\|09v1\|JGIAL020774_P1 | 7278 | 689 | 92.8 | globlastp |
| 3936 | LYD287 | thellungiella\|gb167\|BY808494_P1 | 7279 | 689 | 87.6 | globlastp |
| 3937 | LYD287 | radish\|gb164\|EX896249_P1 | 7280 | 689 | 82.5 | globlastp |
| 3938 | LYD287 | radish\|gb164\|EY904290_P1 | 7281 | 689 | 82.5 | globlastp |
| 3939 | LYD287 | radish\|gb164\|EV567071_P1 | 7282 | 689 | 81.7 | globlastp |
| 3940 | LYD287 | canola\|10v1\|CD824727_P1 | 7283 | 689 | 81.6 | globlastp |
| 3941 | LYD287 | canola\|gb161\|CD824727_P1 | 7283 | 689 | 81.6 | globlastp |
| 3942 | LYD287 | b_rapa\|gb162\|EX086492_T1 | 7284 | 689 | 80 | glotblastn |
| 3943 | LYD288 | b_juncea\|gb164\|EVGN00074614260895_P1 | 7285 | 690 | 93.1 | globlastp |
| 3944 | LYD288 | canola\|10v1\|DY000958_P1 | 7286 | 690 | 92.7 | globlastp |
| 3945 | LYD288 | canola\|gb161\|DY000958_P1 | 7286 | 690 | 92.7 | globlastp |
| 3946 | LYD288 | canola\|10v1\|DY002813_P1 | 7287 | 690 | 92.3 | globlastp |
| 3947 | LYD288 | b_oleracea\|gb161\|AM385538_P1 | 7288 | 690 | 92.3 | globlastp |
| 3948 | LYD288 | b_rapa\|gb162\|BQ791265_P1 | 7289 | 690 | 92.3 | globlastp |
| 3949 | LYD288 | radish\|gb164\|EV525658_P1 | 7290 | 690 | 91.1 | globlastp |
| 3950 | LYD288 | radish\|gb164\|EY926221_P1 | 7291 | 690 | 89.4 | globlastp |
| 3951 | LYD288 | canola\|10v1\|CD819767_P1 | 7292 | 690 | 89 | globlastp |
| 3952 | LYD288 | canola\|gb161\|CD819767_P1 | 7293 | 690 | 89 | globlastp |
| 3953 | LYD288 | arabidopsis_lyrata\|09v1\|JGIAL027537_P1 | 7294 | 690 | 85.4 | globlastp |
| 3954 | LYD288 | b_juncea\|10v2\|E6ANDIZ01AIU14_P1 | 7295 | 690 | 84.6 | globlastp |
| 3955 | LYD288 | thellungiella\|gb167\|BY826525_P1 | 7296 | 690 | 84.1 | globlastp |
| 3956 | LYD288 | arabidopsis\|10v1\|AT5G41210_P1 | 7297 | 690 | 83.7 | globlastp |
| 3957 | LYD288 | arabidopsis\|10v1\|AT5G41240_T1 | 7298 | 690 | 80.89 | glotblastn |
| 3958 | LYD124_H7 | canola\|10v1\|EE444087_P1 | 7299 | 691 | 98.4 | globlastp |
| 3958 | LYD124 | canola\|10v1\|EE444087_T1 | 7299 | 724 | 89.29 | glotblastn |
| 3959 | LYD124_H7 | b_juncea\|10v2\|E6ANDIZ01BWQ1T_P1 | 7300 | 691 | 93.7 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 3959 | LYD124 | b_juncea\|10v2\|E6ANDIZ01BWQ1T__P1 | 7300 | 724 | 83.9 | globlastp |
| 3960 | LYD124_H7 | b_juncea\|10v2\|SEQ3090__P1 | 7301 | 691 | 88.9 | globlastp |
| 3960 | LYD124 | b_juncea\|10v2\|SEQ3090__P1 | 7301 | 724 | 82.3 | globlastp |
| 3961 | LYD124_H7 | b_juncea\|gb164\|EVGN23155006653935__P1 | 7302 | 691 | 88.9 | globlastp |
| 3961 | LYD124 | b_juncea\|gb164\|EVGN23155006653935__T1 | 7302 | 724 | 89.09 | glotblastn |
| 3962 | LYD124_H7 | b_juncea\|10v2\|SEQ3040__P1 | 7303 | 691 | 87.3 | globlastp |
| 3962 | LYD124 | b_juncea\|10v2\|SEQ3040__P1 | 7303 | 724 | 83.9 | globlastp |
| 3963 | LYD124_H7 | canola\|10v1\|EE503725__P1 | 7303 | 691 | 87.3 | globlastp |
| 3963 | LYD124 | canola\|10v1\|EE503725__P1 | 7303 | 724 | 83.9 | globlastp |
| 3964 | LYD124_H7 | arabidopsis\|gb165\|AT4G27654__T1 | 7304 | 691 | 85.71 | glotblastn |
| 3964 | LYD124 | arabidopsis\|gb165\|AT4G27654__T1 | 7304 | 724 | 90.91 | glotblastn |
| 3965 | LYD124_H7 | arabidopsis\|10v1\|AT4G27654__P1 | 7305 | 691 | 85.7 | globlastp |
| 3965 | LYD124 | arabidopsis\|10v1\|AT4G27654__P1 | 7305 | 724 | 80.6 | globlastp |
| 3966 | LYD124_H7 | b_juncea\|10v2\|BJ1SLX00015037D1__P1 | 7306 | 691 | 84.1 | globlastp |
| 3966 | LYD124 | b_juncea\|10v2\|BJ1SLX00015037D1__T1 | 7306 | 724 | 83.64 | glotblastn |
| 3967 | LYD124_H7 | b_juncea\|10v2\|BJ1SLX00075379D1__P1 | 7307 | 691 | 84.1 | globlastp |
| 3967 | LYD124 | b_juncea\|10v2\|BJ1SLX00075379D1__T1 | 7307 | 724 | 83.64 | glotblastn |
| 3968 | LYD124_H7 | b_juncea\|10v2\|E6ANDIZ02HWTS1__P1 | 7308 | 691 | 84.1 | globlastp |
| 3968 | LYD124 | b_juncea\|10v2\|E6ANDIZ02HWTS1__T1 | 7308 | 724 | 83.64 | glotblastn |
| 3969 | LYD124_H7 | canola\|10v1\|EE413458__P1 | 7308 | 691 | 84.1 | globlastp |
| 3969 | LYD124 | canola\|10v1\|EE413458__T1 | 7308 | 724 | 83.64 | glotblastn |
| 3970 | LYD124_H7 | canola\|gb161\|EE413458__P1 | 7308 | 691 | 84.1 | globlastp |
| 3970 | LYD124 | canola\|gb161\|EE413458__T1 | 7308 | 724 | 83.64 | glotblastn |
| 3971 | LYD124_H7 | arabidopsis_lyrata\|09v1\|JGIAL025317__P1 | 7309 | 691 | 82.5 | globlastp |
| 3971 | LYD124 | arabidopsis_lyrata\|09v1\|JGIAL025317__T1 | 7309 | 724 | 85.45 | glotblastn |
| 3972 | LYD124_H7 | arabidopsis_lyrata\|09v1\|JGIAL029923__P1 | 7310 | 691 | 82.5 | globlastp |
| 3973 | LYD124_H7 | b_juncea\|10v2\|BJ1SLX00015379D1__P1 | 7311 | 691 | 82.5 | globlastp |
| 3973 | LYD124 | b_juncea\|10v2\|BJ1SLX00015379D1__T1 | 7311 | 724 | 81.82 | glotblastn |
| 3974 | LYD124_H7 | b_juncea\|10v2\|BJ1SLX00044885D1__P1 | 7311 | 691 | 82.5 | globlastp |
| 3974 | LYD124 | b_juncea\|10v2\|BJ1SLX00044885D1__T1 | 7311 | 724 | 81.82 | glotblastn |
| 3975 | LYD124_H7 | canola\|10v1\|DY000500__P1 | 7312 | 691 | 82.5 | globlastp |
| 3975 | LYD124 | canola\|10v1\|DY000500__T1 | 7312 | 724 | 81.82 | glotblastn |
| 3976 | LYD124_H7 | canola\|gb161\|DY000500__P1 | 7312 | 691 | 82.5 | globlastp |
| 3976 | LYD124 | canola\|gb161\|DY000500__T1 | 7312 | 724 | 81.82 | glotblastn |
| 3977 | LYD124_H7 | arabidopsis\|10v1\|AT4G27657__P1 | 7313 | 691 | 81 | globlastp |
| 3977 | LYD124 | arabidopsis\|10v1\|AT4G27657__T1 | 7313 | 724 | 87.27 | glotblastn |
| 3978 | LYD124_H7 | arabidopsis\|gb165\|AT4G27657__P1 | 7313 | 691 | 81 | globlastp |
| 3978 | LYD124 | arabidopsis\|gb165\|AT4G27657__T1 | 7313 | 724 | 87.27 | glotblastn |
| 3979 | LYD89_H0 | arabidopsis_lyrata\|09v1\|JGIAL006995__P1 | 7314 | 695 | 95.4 | globlastp |
| 3980 | LYD89_H0 | soybean\|gb168\|AW684990__P1 | 7315 | 695 | 81.5 | globlastp |
| 3981 | LYD89_H0 | cucumber\|09v1\|BGI454H0057707__P1 | 7316 | 695 | 80.9 | globlastp |
| 3982 | LYD89_H0 | cotton\|10v1\|CO073167__P1 | 7317 | 695 | 80.8 | globlastp |
| 3983 | LYD89_H0 | cassava\|09v1\|CK643245__P1 | 7318 | 695 | 80.3 | globlastp |
| 3984 | LYD89_H0 | soybean\|gb168\|AW719229__P1 | 7319 | 695 | 80.3 | globlastp |
| 3985 | LYM104 | rice\|gb170\|OS11G03070__P1 | 7320 | 696 | 96.5 | globlastp |
| 3986 | LYM275 | rye\|gb164\|BE586411__P1 | 7321 | 697 | 88.7 | globlastp |
| 3987 | LYM275 | wheat\|gb164\|CA597846__P1 | 7322 | 697 | 86.7 | globlastp |
| 3988 | LYM275 | rice\|gb170\|OS07G47750__P1 | 7323 | 697 | 82.1 | globlastp |
| 3989 | LYD29 | pigeonpea\|10v1\|SRR054580S0018176__T1 | 7324 | 699 | 83.11 | glotblastn |
| 3990 | LYD29 | cowpea\|gb166\|FF383388__T1 | 7325 | 699 | 83.11 | glotblastn |
| 3991 | LYD45 | solanum_phureja\|09v1\|SPHAW618293__P1 | 7326 | 703 | 87.5 | globlastp |
| 3992 | LYD45 | solanum_phureja\|09v1\|SPHBQ515895__T1 | 7327 | 703 | 80.53 | glotblastn |
| 3993 | LYD49 | potato\|gb157.2\|BF052426__P1 | 7328 | 705 | 97 | globlastp |
| 3994 | LYD49 | solanum_phureja\|09v1\|SPHBG123989__P1 | 7329 | 705 | 96.7 | globlastp |
| 3995 | LYD49 | eggplant\|10v1\|FS000181__P1 | 7330 | 705 | 84.5 | globlastp |
| 3996 | LYD50 | basilicum\|10v1\|DY337033__P1 | 7331 | 706 | 94.9 | globlastp |
| 3997 | LYD50 | coffea\|10v1\|CF588621__T1 | 7332 | 706 | 80 | globlastp |
| 3998 | LYD52 | solanum_phureja\|09v1\|SPHAW928860__T1 | 7333 | 707 | 91.6 | glotblastn |
| 3999 | LYD52 | tomato\|09v1\|AW928860__T1 | 7334 | 707 | 90.11 | glotblastn |
| 4000 | LYD52 | potato\|gb157.2\|CK276712__T1 | 7335 | 707 | 83.02 | glotblastn |
| 4001 | LYD59 | tobacco\|gb162\|EB441545__P1 | 7336 | 709 | 87.2 | globlastp |
| 4002 | LYD59 | potato\|10v1\|BG599376__T1 | 7337 | 709 | 84.02 | glotblastn |
| 4003 | LYD59 | solanum_phureja\|09v1\|SPHBG131905__T1 | 7338 | 709 | 83.56 | glotblastn |
| 4004 | LYD61 | petunia\|gb171\|CV299685__T1 | 7339 | 710 | 94.17 | glotblastn |
| 4005 | LYD61 | monkeyflower\|10v1\|SRR037227S0029500__T1 | 7340 | 710 | 85.44 | glotblastn |
| 4006 | LYD61 | pepper\|gb171\|GD092607__P1 | 7341 | 710 | 84.9 | globlastp |
| 4007 | LYD61 | citrus\|gb166\|CK665309__T1 | 7342 | 710 | 83.81 | glotblastn |
| 4008 | LYD61 | tobacco\|gb162\|DV162428__T1 | 7343 | 710 | 83.5 | glotblastn |
| 4009 | LYD61 | citrus\|gb166\|DN134814__T1 | 7344 | 710 | 82.86 | glotblastn |
| 4010 | LYD61 | arabidopsis_lyrata\|09v1\|JGIAL026462__T1 | 7345 | 710 | 82.52 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4011 | LYD61 | rhizophora\|10v1\|SRR005792S0003855_T1 | 7346 | 710 | 81.55 | glotblastn |
| 4012 | LYD61 | arabidopsis\|10v1\|AT4G17360_T1 | 7347 | 710 | 81.55 | glotblastn |
| 4013 | LYD61 | arabidopsis\|gb165\|AT4G17360_T1 | 7347 | 710 | 81.55 | glotblastn |
| 4014 | LYD61 | papaya\|gb165\|EX266095_T1 | 7348 | 710 | 81.55 | glotblastn |
| 4015 | LYD61 | thellungiella\|gb167\|DN778520_T1 | 7349 | 710 | 81.55 | glotblastn |
| 4016 | LYD61 | arabidopsis_lyrata\|09v1\|JGIAL028054_T1 | 7350 | 710 | 80.58 | glotblastn |
| 4017 | LYD61 | canola\|10v1\|CD816661_T1 | 7351 | 710 | 80.58 | glotblastn |
| 4018 | LYD61 | tomato\|09v1\|SRR027939S0270689_T1 | 7352 | 710 | 80.58 | glotblastn |
| 4019 | LYD61 | canola\|gb161\|CD816661_T1 | 7351 | 710 | 80.58 | glotblastn |
| 4020 | LYD61 | kiwi\|gb166\|FG526349_T1 | 7353 | 710 | 80.58 | glotblastn |
| 4021 | LYD61 | poplar\|10v1\|BU832393_T1 | 7354 | 710 | 80.58 | glotblastn |
| 4022 | LYD61 | poplar\|gb170\|BU832393_T1 | 7354 | 710 | 80.58 | glotblastn |
| 4023 | LYD61 | radish\|gb164\|EX887273_T1 | 7355 | 710 | 80.58 | glotblastn |
| 4024 | LYD65 | solanum_phureja\|09v1\|SPHCV491883_T1 | 7356 | 712 | 88.24 | glotblastn |
| 4025 | LYD65 | pepper\|gb171\|CA516488_T1 | 7357 | 712 | 85.71 | glotblastn |
| 4026 | LYD65 | tobacco\|gb162\|EB679001_T1 | 7358 | 712 | 81.82 | glotblastn |
| 4027 | LYD74 | petunia\|gb171\|CV296742_T1 | 7359 | 714 | 89.72 | glotblastn |
| 4028 | LYD74 | ipomoea\|gb157.2\|BM878729_T1 | 7360 | 714 | 86.11 | glotblastn |
| 4029 | LYD74 | ipomoea\|gb157.2\|BJ554139_T1 | 7361 | 714 | 85.71 | glotblastn |
| 4030 | LYD74 | cotton\|gb164\|AI727586_T1 | 7362 | 714 | 85.45 | glotblastn |
| 4031 | LYD74 | rose\|10v1\|EC586509_T1 | 7363 | 714 | 85.05 | glotblastn |
| 4032 | LYD74 | salvia\|10v1\|SRR014553S0001681_T1 | 7364 | 714 | 84.65 | glotblastn |
| 4033 | LYD74 | banana\|gb167\|DN238032_T1 | 7365 | 714 | 84.04 | glotblastn |
| 4034 | LYD74 | bruguiera\|gb166\|BP939059_T1 | 7366 | 714 | 83.1 | glotblastn |
| 4035 | LYD74 | cleome_gynandra\|10v1\|SRR015532S0000664_T1 | 7367 | 714 | 83.03 | glotblastn |
| 4036 | LYD74 | banana\|10v1\|DN238553_P1 | 7368 | 714 | 81.7 | globlastp |
| 4037 | LYD74 | chickpea\|09v2\|DY475430_T1 | 7369 | 714 | 80.37 | glotblastn |
| 4038 | LYD74 | onion\|gb162\|CF436119_P1 | 7370 | 714 | 80.1 | globlastp |
| 4039 | LYD74 | curcuma\|10v1\|DY385612_T1 | 7371 | 714 | 80.09 | glotblastn |
| 4040 | LYD74 | ginger\|gb164\|DY346269_T1 | 7371 | 714 | 80.09 | glotblastn |
| 4041 | LYD106 | arabidopsis_lyrata\|09v1\|JGIAL028447_T1 | 7372 | 718 | 86.61 | glotblastn |
| 4042 | LYD118 | canola\|10v1\|CX280679_T1 | 7373 | 720 | 93.94 | glotblastn |
| 4043 | LYD118 | b_oleracea\|gb161\|AM057891_P1 | 7374 | 720 | 92.1 | globlastp |
| 4044 | LYD119 | canola\|10v1\|ES266621_T1 | 7375 | 721 | 98.07 | glotblastn |
| 4045 | LYD119 | canola\|gb161\|CD824955_T1 | 7376 | 721 | 98.07 | glotblastn |
| 4046 | LYD119 | radish\|gb164\|EV548773_T1 | 7377 | 721 | 98.07 | glotblastn |
| 4047 | LYD119 | canola\|10v1\|CD824955_T1 | 7378 | 721 | 98.07 | glotblastn |
| 4048 | LYD119 | thellungiella\|gb167\|DN773015_T1 | 7379 | 721 | 96.62 | glotblastn |
| 4049 | LYD119 | canola\|gb161\|EE490115_P1 | 7380 | 721 | 91.4 | globlastp |
| 4050 | LYD119 | b_rapa\|gb162\|DN966501_P1 | 7381 | 721 | 90.8 | globlastp |
| 4051 | LYD119 | cleome_spinosa\|10v1\|SRR015531S0005496_T1 | 7382 | 721 | 88.1 | glotblastn |
| 4052 | LYD119 | cucumber\|09v1\|AM722352_T1 | 7383 | 721 | 86.96 | glotblastn |
| 4053 | LYD119 | nasturtium\|10v1\|SRR032558S0086509_T1 | 7384 | 721 | 86.96 | glotblastn |
| 4054 | LYD119 | iceplant\|gb164\|AA962851_T1 | 7385 | 721 | 86.96 | glotblastn |
| 4055 | LYD119 | pine\|10v1\|AA556728_T1 | 7386 | 721 | 85.99 | glotblastn |
| 4056 | LYD119 | orobanche\|10v1\|SRR023189S0019360_T1 | 7387 | 721 | 85.71 | glotblastn |
| 4057 | LYD119 | bean\|gb167\|CB542468_T1 | 7388 | 721 | 85.71 | glotblastn |
| 4058 | LYD119 | soybean\|gb168\|BU090151_T1 | 7389 | 721 | 85.71 | glotblastn |
| 4059 | LYD119 | spruce\|gb162\|CO215773_T1 | 7390 | 721 | 85.51 | glotblastn |
| 4060 | LYD119 | spruce\|gb162\|CO217277_T1 | 7391 | 721 | 85.51 | glotblastn |
| 4061 | LYD119 | tragopogon\|10v1\|SRR020205S0067472_T1 | 7392 | 721 | 85.24 | glotblastn |
| 4062 | LYD119 | soybean\|gb168\|BI968126_T1 | 7393 | 721 | 85.24 | glotblastn |
| 4063 | LYD119 | oak\|10v1\|SRR039735S0121091_P1 | 7394 | 721 | 85.2 | globlastp |
| 4064 | LYD119 | tea\|10v1\|GO254991_P1 | 7395 | 721 | 85.2 | globlastp |
| 4065 | LYD119 | tea\|gb171\|GO254991_P1 | 7395 | 721 | 85.2 | globlastp |
| 4066 | LYD119 | brachypodium\|09v1\|GT763470_T1 | 7396 | 721 | 85.02 | glotblastn |
| 4067 | LYD119 | peanut\|10v1\|ES709558_T1 | 7397 | 721 | 84.76 | glotblastn |
| 4068 | LYD119 | cichorium\|gb171\|EH675630_T1 | 7398 | 721 | 84.76 | glotblastn |
| 4069 | LYD119 | cowpea\|gb166\|FF547244_T1 | 7399 | 721 | 84.76 | glotblastn |
| 4070 | LYD119 | sunflower\|10v1\|BQ914563_T1 | 7400 | 721 | 84.76 | glotblastn |
| 4071 | LYD119 | triphysaria\|10v1\|DR174364_T1 | 7401 | 721 | 84.76 | glotblastn |
| 4072 | LYD119 | prunus\|gb167\|AJ823038_T1 | 7402 | 721 | 84.29 | glotblastn |
| 4073 | LYD119 | sunflower\|gb162\|BQ914563_T1 | 7403 | 721 | 84.29 | glotblastn |
| 4074 | LYD119 | triphysaria\|gb164\|DR174364_T1 | 7404 | 721 | 84.29 | glotblastn |
| 4075 | LYD119 | tomato\|09v1\|BG124992_T1 | 7405 | 721 | 84.21 | glotblastn |
| 4076 | LYD119 | switchgrass\|gb167\|DW177336_T1 | 7406 | 721 | 84.06 | glotblastn |
| 4077 | LYD119 | pigeonpea\|10v1\|SRR054580S0026667_T1 | 7407 | 721 | 83.81 | glotblastn |
| 4078 | LYD119 | sunflower\|gb162\|DY908134_T1 | 7408 | 721 | 83.81 | glotblastn |
| 4079 | LYD119 | triphysaria\|10v1\|EX984488_T1 | 7409 | 721 | 83.81 | glotblastn |
| 4080 | LYD119 | triphysaria\|gb164\|EX984488_T1 | 7410 | 721 | 83.81 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4081 | LYD119 | monkeyflower\|09v1\|GO981562_T1 | 7411 | 721 | 83.73 | glotblastn |
| 4082 | LYD119 | monkeyflower\|10v1\|GO946042_T1 | 7412 | 721 | 83.73 | glotblastn |
| 4083 | LYD119 | acacia\|10v1\|FS585672_T1 | 7413 | 721 | 83.57 | glotblastn |
| 4084 | LYD119 | potato\|10v1\|BF154054_T1 | 7414 | 721 | 83.33 | glotblastn |
| 4085 | LYD119 | potato\|gb157.2\|BF154054_T1 | 7415 | 721 | 83.33 | glotblastn |
| 4086 | LYD119 | tomato\|gb164\|BG631453_P1 | 7416 | 721 | 83.3 | globlastp |
| 4087 | LYD119 | senecio\|gb170\|DY664721_P1 | 7417 | 721 | 83.1 | globlastp |
| 4088 | LYD119 | rice\|gb170\|OS12G33080_T1 | 7418 | 721 | 83.09 | glotblastn |
| 4089 | LYD119 | pine\|10v1\|BX251835_T1 | 7419 | 721 | 82.86 | glotblastn |
| 4090 | LYD119 | artemisia\|gb164\|EY036735_T1 | 7420 | 721 | 82.86 | glotblastn |
| 4091 | LYD119 | basilicum\|gb157.3\|DY331424_T1 | 7421 | 721 | 82.86 | glotblastn |
| 4092 | LYD119 | pea\|09v1\|EF488072_T1 | 7422 | 721 | 82.86 | glotblastn |
| 4093 | LYD119 | solanum_phureja\|09v1\|SPHBG124992_T1 | 7423 | 721 | 82.86 | glotblastn |
| 4094 | LYD119 | heritiera\|10v1\|SRR005794S0000721_T1 | 7424 | 721 | 82.63 | glotblastn |
| 4095 | LYD119 | fern\|gb171\|DK949251_T1 | 7425 | 721 | 82.61 | glotblastn |
| 4096 | LYD119 | strawberry\|gb164\|EX661600_P1 | 7426 | 721 | 82.6 | globlastp |
| 4097 | LYD119 | peanut\|10v1\|GO261368_T1 | 7427 | 721 | 82.38 | glotblastn |
| 4098 | LYD119 | peanut\|gb171\|GO261368_T1 | 7428 | 721 | 82.38 | glotblastn |
| 4099 | LYD119 | oat\|10v2\|GO586892_T1 | 7429 | 721 | 81.9 | glotblastn |
| 4100 | LYD119 | millet\|10v1\|EVO454PM004600_T1 | 7430 | 721 | 81.64 | glotblastn |
| 4101 | LYD119 | brachypodium\|gb169\|BE402785_T1 | 7431 | 721 | 81.64 | glotblastn |
| 4102 | LYD119 | ipomoea_nil\|10v1\|CJ765444_P1 | 7432 | 721 | 81.6 | globlastp |
| 4102 | LYD119 | ipomoea\|gb157.2\|CJ765444_T1 | 7432 | 721 | 81.6 | globlastp |
| 4103 | LYD119 | pepper\|gb171\|BM067160_P1 | 7433 | 721 | 81.6 | globlastp |
| 4104 | LYD119 | barley\|10v1\|BE437611_T1 | 7434 | 721 | 81.43 | glotblastn |
| 4105 | LYD119 | barley\|gb157SOLEXA\|BE437611_T1 | 7435 | 721 | 81.43 | glotblastn |
| 4106 | LYD119 | wheat\|gb164\|BE402785_T1 | 7436 | 721 | 81.43 | glotblastn |
| 4107 | LYD119 | spikemoss\|gb165\|FE432753_T1 | 7437 | 721 | 80.95 | glotblastn |
| 4108 | LYD119 | wheat\|gb164\|CA676597_T1 | 7438 | 721 | 80.95 | glotblastn |
| 4109 | LYD119 | physcomitrella\|10v1\|BJ157018_T1 | 7439 | 721 | 80.48 | glotblastn |
| 4110 | LYD119 | cynara\|gb167\|GE593403_P1 | 7440 | 721 | 80.4 | globlastp |
| 4111 | LYD119 | ipomoea_nil\|10v1\|BJ567558_P1 | 7441 | 721 | 80.3 | globlastp |
| 4111 | LYD119 | ipomoea\|gb157.2\|BJ567558_P1 | 7441 | 721 | 80.3 | globlastp |
| 4112 | LYD119 | maize\|10v1\|AW066569_T1 | 7442 | 721 | 80 | glotblastn |
| 4113 | LYD119 | maize\|gb170\|AW066569_T1 | 7442 | 721 | 80 | glotblastn |
| 4114 | LYD119 | sorghum\|09v1\|SB08G016630_T1 | 7443 | 721 | 80 | glotblastn |
| 4115 | LYD120 | radish\|gb164\|EV543892_T1 | 7444 | 722 | 94.35 | glotblastn |
| 4116 | LYD120 | b_juncea\|10v2\|E6ANDIZ01DKBDZ_P1 | 7445 | 722 | 84.1 | globlastp |
| 4117 | LYD120 | arabidopsis_lyrata\|09v1\|JGIAL029406_T1 | 7446 | 722 | 83.06 | glotblastn |
| 4118 | LYD120 | arabidopsis\|10v1\|AT5G50100_T1 | 7447 | 722 | 83.06 | glotblastn |
| 4119 | LYD120 | arabidopsis\|gb165\|AT5G50100_T1 | 7448 | 722 | 83.06 | glotblastn |
| 4120 | LYD123 | canola\|gb161\|EE461239_T1 | 7449 | 723 | 94.33 | glotblastn |
| 4121 | LYD123 | radish\|gb164\|FD539059_T1 | 7450 | 723 | 86.11 | glotblastn |
| 4122 | LYD124 | arabidopsis_lyrata\|09v1\|JGIAL025319_T1 | 7451 | 724 | 83.64 | glotblastn |
| 4123 | LYD124 | canola\|gb161\|EE503725_T1 | 7452 | 724 | 81.82 | glotblastn |
| 4124 | LYD124 | radish\|gb164\|EY911939_T1 | 7453 | 724 | 80 | glotblastn |
| 4125 | LYD124 | thellungiella\|gb167\|BY833371_T1 | 7454 | 724 | 80 | glotblastn |
| 4126 | LYD127 | soybean\|gb168\|FD780693_T1 | 7455 | 725 | 96.84 | glotblastn |
| 4127 | LYD127 | bean\|gb167\|CB540262_T1 | 7456 | 725 | 95.57 | glotblastn |
| 4128 | LYD127 | pigeonpea\|10v1\|SRR054580S0015649_T1 | 7457 | 725 | 93.67 | glotblastn |
| 4129 | LYD127 | sunflower\|10v1\|CF081741_T1 | 7458 | 725 | 89.87 | glotblastn |
| 4130 | LYD127 | sunflower\|gb162\|CF081741_T1 | 7459 | 725 | 89.87 | glotblastn |
| 4131 | LYD127 | sunflower\|10v1\|EE608363_T1 | 7460 | 725 | 89.87 | glotblastn |
| 4132 | LYD127 | artemisia\|10v1\|EY101060_T1 | 7461 | 725 | 89.24 | glotblastn |
| 4133 | LYD127 | tea\|gb171\|EF218618_T1 | 7462 | 725 | 89.24 | glotblastn |
| 4134 | LYD127 | poplar\|gb170\|BI123464_T1 | 7463 | 725 | 88.61 | glotblastn |
| 4135 | LYD127 | cassava\|09v1\|DB951700_T1 | 7464 | 725 | 87.97 | glotblastn |
| 4136 | LYD127 | cassava\|09v1\|JGICASSAVA6286VALIDM1_T1 | 7465 | 725 | 87.97 | glotblastn |
| 4137 | LYD127 | cleome_gynandra\|10v1\|SRR015532S0009046_T1 | 7466 | 725 | 87.97 | glotblastn |
| 4138 | LYD127 | nasturtium\|10v1\|SRR032558S0021243_T1 | 7467 | 725 | 87.97 | glotblastn |
| 4139 | LYD127 | prunus\|10v1\|CB822008_T1 | 7468 | 725 | 87.97 | glotblastn |
| 4140 | LYD127 | poplar\|10v1\|BI123464_T1 | 7469 | 725 | 87.97 | glotblastn |
| 4141 | LYD127 | poplar\|10v1\|CV268483_T1 | 7470 | 725 | 87.97 | glotblastn |
| 4142 | LYD127 | poplar\|gb170\|CV268483_T1 | 7470 | 725 | 87.97 | glotblastn |
| 4143 | LYD127 | sunflower\|gb162\|EL415366_T1 | 7471 | 725 | 87.97 | glotblastn |
| 4144 | LYD127 | tragopogon\|10v1\|SRR020205S0045666_T1 | 7472 | 725 | 87.65 | glotblastn |
| 4145 | LYD127 | cleome_spinosa\|10v1\|GR932411_T1 | 7473 | 725 | 86.71 | glotblastn |
| 4146 | LYD127 | antirrhinum\|gb166\|AJ787831_T1 | 7474 | 725 | 86.71 | glotblastn |
| 4147 | LYD127 | apple\|gb171\|CN864453_T1 | 7475 | 725 | 86.71 | glotblastn |
| 4148 | LYD127 | castorbean\|09v1\|XM002510467_T1 | 7476 | 725 | 86.71 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4149 | LYD127 | oak\|10v1\|FP038114_T1 | 7477 | 725 | 86.08 | glotblastn |
| 4150 | LYD127 | lettuce\|gb157.2\|DW089878_T1 | 7478 | 725 | 85.8 | glotblastn |
| 4151 | LYD127 | cucumber\|09v1\|AM725987_T1 | 7479 | 725 | 85.44 | glotblastn |
| 4152 | LYD127 | spurge\|gb161\|DV123737_T1 | 7480 | 725 | 85.44 | glotblastn |
| 4153 | LYD127 | lettuce\|10v1\|DW089878_T1 | 7481 | 725 | 85.19 | glotblastn |
| 4154 | LYD127 | arabidopsis_lyrata\|09v1\|JGIAL002097_T1 | 7482 | 725 | 84.81 | glotblastn |
| 4155 | LYD127 | aquilegia\|10v1\|DR925552_T1 | 7483 | 725 | 84.81 | glotblastn |
| 4156 | LYD127 | aquilegia\|gb157.3\|DR925552_T1 | 7484 | 725 | 84.81 | glotblastn |
| 4157 | LYD127 | arabidopsis\|10v1\|AT1G19920_T1 | 7485 | 725 | 84.81 | glotblastn |
| 4158 | LYD127 | arabidopsis\|gb165\|AT1G19920_T1 | 7485 | 725 | 84.81 | glotblastn |
| 4159 | LYD127 | canola\|10v1\|DY022321_T1 | 7486 | 725 | 84.18 | glotblastn |
| 4160 | LYD127 | canola\|gb161\|EV195140_T1 | 7487 | 725 | 84.18 | glotblastn |
| 4161 | LYD127 | monkeyflower\|09v1\|DV212228_T1 | 7488 | 725 | 84.18 | glotblastn |
| 4162 | LYD127 | b_oleracea\|gb161\|AF195511_T1 | 7489 | 725 | 83.54 | glotblastn |
| 4163 | LYD127 | b_rapa\|gb162\|ES929820_T1 | 7490 | 725 | 83.54 | glotblastn |
| 4164 | LYD127 | monkeyflower\|10v1\|DV212228_T1 | 7491 | 725 | 83.54 | glotblastn |
| 4165 | LYD127 | centaurea\|gb166\|EL933253_T1 | 7492 | 725 | 83.44 | glotblastn |
| 4166 | LYD127 | dandelion\|10v1\|DQ160054_T1 | 7493 | 725 | 83.33 | glotblastn |
| 4167 | LYD127 | canola\|10v1\|CD825050_T1 | 7494 | 725 | 82.91 | glotblastn |
| 4168 | LYD127 | coffea\|10v1\|DV671705_T1 | 7495 | 725 | 81.65 | glotblastn |
| 4169 | LYD127 | canola\|gb161\|CD812541_T1 | 7496 | 725 | 81.65 | glotblastn |
| 4170 | LYD127 | switchgrass\|gb167\|FL718428_T1 | 7497 | 725 | 81.65 | glotblastn |
| 4171 | LYD127 | rice\|gb170\|OS04G02050_T1 | 7498 | 725 | 80.5 | glotblastn |
| 4172 | LYD127 | brachypodium\|09v1\|GT773509_T1 | 7499 | 725 | 80.38 | glotblastn |
| 4173 | LYD127 | maize\|10v1\|AW927833_T1 | 7500 | 725 | 80.38 | glotblastn |
| 4174 | LYD127 | brachypodium\|gb169\|BE411414_T1 | 7501 | 725 | 80.38 | glotblastn |
| 4175 | LYD127 | radish\|gb164\|EV525366_T1 | 7502 | 725 | 80.38 | glotblastn |
| 4176 | LYD127 | spruce\|gb162\|CO219290_T1 | 7503 | 725 | 80.38 | glotblastn |
| 4177 | LYD142 | eggplant\|10v1\|FS049767_T1 | 7504 | 726 | 80.34 | glotblastn |
| 4178 | LYD185 | b_juncea\|gb164\|EVGN00210423251166_P1 | 7505 | 730 | 84.5 | globlastp |
| 4179 | LYD185 | b_juncea\|gb164\|EVGN03295430561543_P1 | 7506 | 730 | 84.2 | globlastp |
| 4180 | LYD185 | radish\|gb164\|EW713565_T1 | 7507 | 730 | 83.59 | glotblastn |
| 4181 | LYD185 | b_juncea\|gb164\|EVGN01104525990565_T1 | 7508 | 730 | 82.56 | glotblastn |
| 4182 | LYD185 | canola\|gb161\|CX196125_T1 | 7509 | 730 | 82.05 | glotblastn |
| 4183 | LYD185 | b_juncea\|10v2\|E6ANDIZ01C91Z3_P1 | 7510 | 730 | 80.3 | globlastp |
| 4184 | LYD212 | arabidopsis_lyrata\|09v1\|JGIAL028662_P1 | 7511 | 733 | 99.7 | globlastp |
| 4185 | LYD231 | sugarcane\|10v1\|CA081528_T1 | 7512 | 734 | 93.13 | glotblastn |
| 4186 | LYD231 | switchgrass\|gb167\|DN145042_P1 | 7513 | 734 | 86.7 | globlastp |
| 4187 | LYD232 | nicotiana_benthamiana\|gb162\|CK286359_T1 | 7514 | 735 | 85.82 | glotblastn |
| 4188 | LYD235 | potato\|10v1\|AJ487407_P1 | 7515 | 736 | 98.2 | globlastp |
| 4189 | LYD235 | potato\|gb157.2\|AJ487407_P1 | 7515 | 736 | 98.2 | globlastp |
| 4190 | LYD235 | potato\|gb157.2\|BG589356_P1 | 7515 | 736 | 98.2 | globlastp |
| 4191 | LYD235 | solanum_phureja\|09v1\|SPHBG132066_P1 | 7515 | 736 | 98.2 | globlastp |
| 4192 | LYD235 | eggplant\|10v1\|FS034595_P1 | 7516 | 736 | 97 | globlastp |
| 4193 | LYD235 | pepper\|gb171\|BM062225_P1 | 7517 | 736 | 95.9 | globlastp |
| 4194 | LYD235 | tobacco\|gb162\|AB041518_P1 | 7518 | 736 | 92.9 | globlastp |
| 4195 | LYD235 | cotton\|10v1\|AF037051_P1 | 7519 | 736 | 91.8 | globlastp |
| 4196 | LYD235 | petunia\|gb171\|CV295395_P1 | 7520 | 736 | 90.5 | globlastp |
| 4197 | LYD235 | petunia\|gb171\|FN000529_P1 | 7521 | 736 | 87.1 | globlastp |
| 4198 | LYD235 | petunia\|gb171\|DY395977_P1 | 7522 | 736 | 85.2 | globlastp |
| 4199 | LYD235 | flax\|09v1\|CV478944_P1 | 7523 | 736 | 82.8 | globlastp |
| 4200 | LYD235 | rhizophora\|10v1\|SRR005792S0007720_P1 | 7524 | 736 | 81.7 | globlastp |
| 4201 | LYD235 | cassava\|gb164\|DV444983_P1 | 7525 | 736 | 81.7 | globlastp |
| 4202 | LYD235 | coffea\|10v1\|DQ123923_P1 | 7526 | 736 | 81.7 | globlastp |
| 4203 | LYD235 | spurge\|gb161\|DV112714_P1 | 7527 | 736 | 81.7 | globlastp |
| 4204 | LYD235 | prunus\|10v1\|BU039316_P1 | 7528 | 736 | 81.2 | globlastp |
| 4205 | LYD235 | prunus\|gb167\|BU039316_P1 | 7528 | 736 | 81.2 | globlastp |
| 4206 | LYD235 | coffea\|gb157.2\|DQ123923_P1 | 7529 | 736 | 81.1 | globlastp |
| 4207 | LYD235 | kiwi\|gb166\|FG428858_P1 | 7530 | 736 | 81.1 | globlastp |
| 4208 | LYD235 | cotton\|10v1\|AI055041_P1 | 7531 | 736 | 80.5 | globlastp |
| 4209 | LYD235 | foxtail_millet\|09v1\|AY541694_P1 | 7532 | 736 | 80.5 | globlastp |
| 4210 | LYD235 | cassava\|gb164\|CK641649_P1 | 7533 | 736 | 80.5 | globlastp |
| 4211 | LYD235 | castorbean\|09v1\|T15094_P1 | 7534 | 736 | 80.5 | globlastp |
| 4212 | LYD235 | cenchrus\|gb166\|EB654968_P1 | 7535 | 736 | 80.5 | globlastp |
| 4213 | LYD235 | grape\|gb160\|BM436942_P1 | 7536 | 736 | 80.5 | globlastp |
| 4214 | LYD235 | monkeyflower\|09v1\|GR014468_P1 | 7537 | 736 | 80.5 | globlastp |
| 4215 | LYD235 | monkeyflower\|10v1\|GR014468_P1 | 7537 | 736 | 80.5 | globlastp |
| 4216 | LYD235 | poplar\|10v1\|BI072985_P1 | 7538 | 736 | 80.5 | globlastp |
| 4217 | LYD235 | poplar\|gb170\|BI072985_P1 | 7538 | 736 | 80.5 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4218 | LYD235 | poplar\|10v1\|BI125787__P1 | 7539 | 736 | 80.5 | globlastp |
| 4219 | LYD235 | poplar\|gb170\|BI125787__P1 | 7539 | 736 | 80.5 | globlastp |
| 4220 | LYD235 | pseudoroegneria\|gb167\|FF340959__P1 | 7540 | 736 | 80.5 | globlastp |
| 4221 | LYD235 | sorghum\|09v1\|SB06G024920__P1 | 7535 | 736 | 80.5 | globlastp |
| 4222 | LYD235 | sugarcane\|gb157.3\|BQ533812__P1 | 7535 | 736 | 80.5 | globlastp |
| 4223 | LYD235 | sugarcane\|gb157.3\|BQ535903__P1 | 7535 | 736 | 80.5 | globlastp |
| 4224 | LYD235 | switchgrass\|gb167\|DN143025__P1 | 7541 | 736 | 80.5 | globlastp |
| 4225 | LYD235 | switchgrass\|gb167\|DN145059__P1 | 7542 | 736 | 80.5 | globlastp |
| 4226 | LYD235 | sugarcane\|10v1\|BQ533812__P1 | 7535 | 736 | 80.5 | globlastp |
| 4227 | LYD235 | ginseng\|10v1\|CN845955__T1 | 7543 | 736 | 80.47 | glotblastn |
| 4228 | LYD248 | b_juncea\|10v2\|E6ANDIZ01AWPC7__P1 | 7544 | 737 | 97.2 | globlastp |
| 4229 | LYD248 | canola\|10v1\|CX190543__T1 | 7545 | 737 | 96.73 | glotblastn |
| 4230 | LYD248 | b_oleracea\|gb161\|DY014208__T1 | 7546 | 737 | 96.73 | glotblastn |
| 4231 | LYD248 | b_oleracea\|gb161\|AM061136__P1 | 7547 | 737 | 88.3 | globlastp |
| 4232 | LYD248 | b_rapa\|gb162\|EX046027__T1 | 7548 | 737 | 85.12 | glotblastn |
| 4233 | LYD248 | cleome_gynandra\|10v1\|SRR015532S0001842__T1 | 7549 | 737 | 80.84 | glotblastn |
| 4234 | LYD250 | canola\|10v1\|EV168840__T1 | 7550 | 738 | 98.81 | glotblastn |
| 4235 | LYD250 | pigeonpea\|10v1\|SRR054580S0022117__T1 | 7551 | 738 | 82.14 | glotblastn |
| 4236 | LYD250 | cowpea\|gb166\|FF385901__T1 | 7552 | 738 | 82.14 | glotblastn |
| 4237 | LYD250 | b_juncea\|10v2\|BJ1SLX00187033D1__T1 | 7553 | 738 | 80.95 | glotblastn |
| 4238 | LYD250 | cassava\|09v1\|CK646994__T1 | 7554 | 738 | 80.95 | glotblastn |
| 4239 | LYD250 | heritiera\|10v1\|SRR005794S0006421__T1 | 7555 | 738 | 80.95 | glotblastn |
| 4240 | LYD250 | prunus\|10v1\|CN489066__T1 | 7556 | 738 | 80.95 | glotblastn |
| 4241 | LYD250 | bean\|gb167\|CA910825__T1 | 7557 | 738 | 80.95 | glotblastn |
| 4242 | LYD250 | chestnut\|gb170\|SRR006295S0000380__T1 | 7558 | 738 | 80.95 | glotblastn |
| 4243 | LYD250 | grape\|gb160\|CB973883__T1 | 7559 | 738 | 80.95 | glotblastn |
| 4244 | LYD260 | arabidopsis\|10v1\|AT5G64000__T1 | 7560 | 739 | 80.13 | glotblastn |
| 4245 | LYD260 | arabidopsis\|gb165\|AT5G64000__T1 | 7560 | 739 | 80.13 | glotblastn |
| 4246 | LYD261 | b_oleracea\|gb161\|EH415860__T1 | 7561 | 740 | 97.2 | glotblastn |
| 4247 | LYD261 | canola\|10v1\|EE431858__T1 | 7562 | 740 | 94.08 | glotblastn |
| 4248 | LYD261 | canola\|gb161\|DY023542__T1 | 7563 | 740 | 93.77 | glotblastn |
| 4249 | LYD261 | canola\|10v1\|EE551454__P1 | 7564 | 740 | 90.5 | globlastp |
| 4250 | LYD261 | radish\|gb164\|EV567697__P1 | 7565 | 740 | 88.5 | globlastp |
| 4251 | LYD261 | b_rapa\|gb162\|EX040521__T1 | 7566 | 740 | 88.47 | glotblastn |
| 4252 | LYD261 | arabidopsis_lyrata\|09v1\|JGIAL004392__T1 | 7567 | 740 | 87.85 | glotblastn |
| 4253 | LYD261 | cleome_gynandra\|10v1\|SRR015532S0011521__T1 | 7568 | 740 | 81.62 | glotblastn |
| 4254 | LYD268 | canola\|10v1\|EV039640__T1 | 7569 | 742 | 92.68 | glotblastn |
| 4255 | LYD268 | b_juncea\|10v2\|SEQ2714__T1 | 7570 | 742 | 84.15 | glotblastn |
| 4256 | LYD268 | thellungiella\|gb167\|DN775435__T1 | 7571 | 742 | 81.71 | glotblastn |
| 4257 | LYD268 | arabidopsis\|10v1\|AT4G01610__T1 | 7572 | 742 | 80.49 | glotblastn |
| 4258 | LYD268 | arabidopsis\|gb165\|AT4G01610__T1 | 7572 | 742 | 80.49 | glotblastn |
| 4259 | LYD268 | b_oleracea\|gb161\|AM395871__T1 | 7573 | 742 | 80.49 | glotblastn |
| 4260 | LYD268 | b_rapa\|gb162\|CV523184__T1 | 7574 | 742 | 80.49 | glotblastn |
| 4261 | LYD268 | canola\|10v1\|CD811685__T1 | 7575 | 742 | 80.49 | glotblastn |
| 4262 | LYD268 | canola\|gb161\|CD811685__T1 | 7575 | 742 | 80.49 | glotblastn |
| 4263 | LYD268 | canola\|10v1\|CD814272__T1 | 7576 | 742 | 80.49 | glotblastn |
| 4264 | LYD268 | canola\|gb161\|CD814272__T1 | 7576 | 742 | 80.49 | glotblastn |
| 4265 | LYD271 | canola\|10v1\|CX193148__T1 | 7577 | 743 | 95.45 | glotblastn |
| 4266 | LYD271 | canola\|gb161\|CX193148__T1 | 7578 | 743 | 95.45 | glotblastn |
| 4267 | LYD271 | canola\|10v1\|BQ704756__T1 | 7579 | 743 | 93.18 | glotblastn |
| 4268 | LYD271 | radish\|gb164\|EX763829__T1 | 7580 | 743 | 92.05 | glotblastn |
| 4269 | LYD271 | thellungiella\|gb167\|BY815188__T1 | 7581 | 743 | 90.91 | glotblastn |
| 4270 | LYD271 | b_juncea\|10v2\|E6ANDIZ01D350E__T1 | 7582 | 743 | 85.23 | glotblastn |
| 4271 | LYD271 | canola\|10v1\|ES981471__T1 | 7583 | 743 | 82.95 | glotblastn |
| 4272 | LYD271 | b_rapa\|gb162\|EX040706__T1 | 7584 | 743 | 82.95 | glotblastn |
| 4273 | LYD271 | radish\|gb164\|EV537391__T1 | 7585 | 743 | 82.95 | glotblastn |
| 4274 | LYD271 | b_oleracea\|gb161\|EH419147__T1 | 7586 | 743 | 80.68 | glotblastn |
| 4275 | LYD273 | canola\|gb161\|ES950584__T1 | 7587 | 744 | 100 | glotblastn |
| 4276 | LYD273 | radish\|gb164\|EV536786__T1 | 7588 | 744 | 100 | glotblastn |
| 4277 | LYD273 | thellungiella\|gb167\|BY806071__T1 | 7589 | 744 | 100 | glotblastn |
| 4278 | LYD273 | cleome_spinosa\|10v1\|SRR015531S0023838__T1 | 7590 | 744 | 97.96 | glotblastn |
| 4279 | LYD273 | canola\|10v1\|ES950584__T1 | 7591 | 744 | 95.92 | glotblastn |
| 4280 | LYD273 | b_rapa\|gb162\|CV432099__T1 | 7592 | 744 | 93.88 | glotblastn |
| 4281 | LYD273 | pigeonpea\|10v1\|SRR054580S0008538__T1 | 7593 | 744 | 87.76 | glotblastn |
| 4282 | LYD273 | cacao\|gb167\|CU473348__T1 | 7594 | 744 | 87.76 | glotblastn |
| 4283 | LYD273 | citrus\|gb166\|CX674860__T1 | 7595 | 744 | 87.76 | glotblastn |
| 4284 | LYD273 | cowpea\|gb166\|FF395622__T1 | 7596 | 744 | 87.76 | glotblastn |
| 4285 | LYD273 | peanut\|10v1\|EE127736__T1 | 7597 | 744 | 87.76 | glotblastn |
| 4286 | LYD273 | poplar\|gb170\|CA925799__T1 | 7598 | 744 | 87.76 | glotblastn |
| 4287 | LYD273 | soybean\|gb168\|AL369908__T1 | 7599 | 744 | 87.76 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4288 | LYD273 | soybean\|gb168\|BG645822_T1 | 7600 | 744 | 87.76 | glotblastn |
| 4289 | LYD273 | soybean\|gb168\|FF548852_T1 | 7601 | 744 | 86 | glotblastn |
| 4290 | LYD273 | nasturtium\|10v1\|SRR032558S0000459_T1 | 7602 | 744 | 85.71 | glotblastn |
| 4291 | LYD273 | oak\|10v1\|FP036741_T1 | 7603 | 744 | 85.71 | glotblastn |
| 4292 | LYD273 | cassava\|09v1\|DB941340_T1 | 7604 | 744 | 85.71 | glotblastn |
| 4293 | LYD273 | cassava\|gb164\|DB941340_T1 | 7605 | 744 | 85.71 | glotblastn |
| 4294 | LYD273 | castorbean\|09v1\|XM002517856_T1 | 7606 | 744 | 85.71 | glotblastn |
| 4295 | LYD273 | cotton\|10v1\|BQ406810_T1 | 7607 | 744 | 85.71 | glotblastn |
| 4296 | LYD273 | cotton\|gb164\|BQ406810_T1 | 7608 | 744 | 85.71 | glotblastn |
| 4297 | LYD273 | oak\|gb170\|SRR006314S0070548_T1 | 7609 | 744 | 85.71 | glotblastn |
| 4298 | LYD273 | poplar\|10v1\|CA925799_T1 | 7610 | 744 | 85.71 | glotblastn |
| 4299 | LYD273 | apple\|gb171\|CN868818_T1 | 7611 | 744 | 83.67 | glotblastn |
| 4300 | LYD273 | medicago\|09v1\|AW329296_T1 | 7612 | 744 | 83.67 | glotblastn |
| 4301 | LYD273 | pea\|09v1\|FG531832_T1 | 7613 | 744 | 83.67 | glotblastn |
| 4302 | LYD273 | prunus\|10v1\|CB818351_T1 | 7614 | 744 | 83.67 | glotblastn |
| 4303 | LYD273 | prunus\|gb167\|DY636109_T1 | 7615 | 744 | 83.67 | glotblastn |
| 4304 | LYD273 | peanut\|gb171\|EE127736_T1 | 7616 | 744 | 81.63 | glotblastn |
| 4305 | LYD276 | radish\|gb164\|EW725283_T1 | 7617 | 745 | 97.78 | glotblastn |
| 4306 | LYD276 | b_rapa\|gb162\|EX068631_T1 | 7618 | 745 | 88.89 | glotblastn |
| 4307 | LYD276 | b_oleracea\|gb161\|EH422761_T1 | 7619 | 745 | 88.33 | glotblastn |
| 4308 | LYD276 | canola\|10v1\|H07563_T1 | 7620 | 745 | 88.33 | glotblastn |
| 4309 | LYD276 | canola\|gb161\|H07563_T1 | 7621 | 745 | 88.33 | glotblastn |
| 4310 | LYD276 | canola\|10v1\|EV146718_P1 | 7622 | 745 | 81.2 | globlastp |
| 4311 | LYD276 | canola\|gb161\|EV146718_P1 | 7623 | 745 | 81.2 | globlastp |
| 4312 | LYD278 | b_juncea\|10v2\|E6ANDIZ01B10PC_T1 | 7624 | 746 | 90.16 | glotblastn |
| 4313 | LYD278 | b_juncea\|10v2\|E6ANDIZ01A4KLN_T1 | 7625 | 746 | 90.16 | glotblastn |
| 4314 | LYD278 | b_juncea\|gb164\|EVGN02746728071494_T1 | 7626 | 746 | 90.16 | glotblastn |
| 4315 | LYD278 | canola\|gb161\|CD824599_T1 | 7627 | 746 | 90.16 | glotblastn |
| 4316 | LYD278 | canola\|gb161\|EE559671_T1 | 7628 | 746 | 90.16 | glotblastn |
| 4317 | LYD278 | radish\|gb164\|EW721862_T1 | 7629 | 746 | 90.16 | glotblastn |
| 4318 | LYD278 | radish\|gb164\|FD561058_T1 | 7630 | 746 | 89.34 | glotblastn |
| 4319 | LYD278 | canola\|10v1\|CD824599_T1 | 7631 | 746 | 89.34 | glotblastn |
| 4320 | LYD278 | canola\|10v1\|EE474997_T1 | 7632 | 746 | 88.52 | glotblastn |
| 4321 | LYD278 | b_rapa\|gb162\|BQ790727_T1 | 7633 | 746 | 87.7 | glotblastn |
| 4322 | LYD278 | arabidopsis\|10v1\|AT2G20550_T1 | 7634 | 746 | 86.07 | glotblastn |
| 4323 | LYD278 | arabidopsis\|gb165\|AT2G20550_T1 | 7635 | 746 | 86.07 | glotblastn |
| 4324 | LYD278 | chestnut\|gb170\|SRR006296S0031590_T1 | 7636 | 746 | 84.43 | glotblastn |
| 4325 | LYD278 | oak\|gb170\|SRR006307S0037850_T1 | 7637 | 746 | 83.61 | glotblastn |
| 4326 | LYD278 | radish\|gb164\|FD959782_P1 | 7638 | 746 | 83.3 | globlastp |
| 4327 | LYD278 | arabidopsis_lyrata\|09v1\|JGIAL012528_T1 | 7639 | 746 | 81.97 | glotblastn |
| 4328 | LYD278 | heritiera\|10v1\|SRR005794S0001968_T1 | 7640 | 746 | 81.97 | glotblastn |
| 4329 | LYD278 | melon\|10v1\|AM715991_T1 | 7641 | 746 | 81.97 | glotblastn |
| 4330 | LYD278 | oak\|10v1\|FP034091_T1 | 7642 | 746 | 81.97 | glotblastn |
| 4331 | LYD278 | pigeonpea\|10v1\|SRR054580S0010860_T1 | 7643 | 746 | 81.97 | glotblastn |
| 4332 | LYD278 | pigeonpea\|10v1\|SRR054580S0381041_T1 | 7644 | 746 | 81.97 | glotblastn |
| 4333 | LYD278 | bean\|gb167\|CV537680_T1 | 7645 | 746 | 81.97 | glotblastn |
| 4334 | LYD278 | cassava\|09v1\|CK652695_T1 | 7646 | 746 | 81.97 | glotblastn |
| 4335 | LYD278 | cassava\|gb164\|CK652695_T1 | 7647 | 746 | 81.97 | glotblastn |
| 4336 | LYD278 | medicago\|09v1\|BG646294_T1 | 7648 | 746 | 81.97 | glotblastn |
| 4337 | LYD278 | poplar\|gb170\|BI073075_T1 | 7649 | 746 | 81.97 | glotblastn |
| 4338 | LYD278 | poplar\|10v1\|CV240011_T1 | 7650 | 746 | 81.97 | glotblastn |
| 4339 | LYD278 | poplar\|gb170\|CV240011_T1 | 7650 | 746 | 81.97 | glotblastn |
| 4340 | LYD278 | soybean\|gb168\|CD416793_T1 | 7651 | 746 | 81.97 | glotblastn |
| 4341 | LYD278 | artemisia\|10v1\|EY078479_T1 | 7652 | 746 | 81.15 | glotblastn |
| 4342 | LYD278 | cleome_spinosa\|10v1\|SRR015531S0013173_T1 | 7653 | 746 | 81.15 | glotblastn |
| 4343 | LYD278 | cucumber\|09v1\|AM715991_T1 | 7654 | 746 | 81.15 | glotblastn |
| 4344 | LYD278 | cacao\|gb167\|CU476709_T1 | 7655 | 746 | 81.15 | glotblastn |
| 4345 | LYD278 | castorbean\|09v1\|XM002517807_T1 | 7656 | 746 | 81.15 | glotblastn |
| 4346 | LYD278 | cotton\|10v1\|AI727783_T1 | 7657 | 746 | 81.15 | glotblastn |
| 4347 | LYD278 | cotton\|gb164\|AI727783_T1 | 7658 | 746 | 81.15 | glotblastn |
| 4348 | LYD278 | grape\|gb160\|CB001614_T1 | 7659 | 746 | 81.15 | glotblastn |
| 4349 | LYD278 | peanut\|gb171\|EH044472_T1 | 7660 | 746 | 81.15 | glotblastn |
| 4350 | LYD278 | poplar\|10v1\|BU879952_T1 | 7661 | 746 | 81.15 | glotblastn |
| 4351 | LYD278 | poplar\|gb170\|BU879952_T1 | 7661 | 746 | 81.15 | glotblastn |
| 4352 | LYD278 | soybean\|gb168\|BG646294_T1 | 7662 | 746 | 81.15 | glotblastn |
| 4353 | LYD278 | oak\|10v1\|FP073293_T1 | 7663 | 746 | 80.33 | glotblastn |
| 4354 | LYD278 | cotton\|gb164\|AI728181_T1 | 7664 | 746 | 80.33 | glotblastn |
| 4355 | LYD278 | poplar\|10v1\|BI073075_T1 | 7665 | 746 | 80.33 | glotblastn |
| 4356 | LYD283 | canola\|10v1\|H74785_P1 | 7666 | 747 | 98.9 | globlastp |
| 4357 | LYD283 | canola\|gb161\|H74785_P1 | 7666 | 747 | 98.9 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4358 | LYD283 | b_oleracea\|gb161\|AM390066_P1 | 7667 | 747 | 98.5 | globlastp |
| 4359 | LYD283 | canola\|gb161\|CD814370_P1 | 7668 | 747 | 91.4 | globlastp |
| 4360 | LYD283 | melon\|10v1\|AM717128_P1 | 7669 | 747 | 83.6 | globlastp |
| 4361 | LYD283 | melon\|gb165\|AM717128_P1 | 7670 | 747 | 83.3 | globlastp |
| 4362 | LYD283 | cassava\|09v1\|FF380914_P1 | 7671 | 747 | 82.5 | globlastp |
| 4363 | LYD283 | monkeyflower\|10v1\|GR073701_P1 | 7672 | 747 | 81.8 | globlastp |
| 4364 | LYD283 | monkeyflower\|09v1\|GO970219_P1 | 7672 | 747 | 81.8 | globlastp |
| 4365 | LYD283 | cotton\|10v1\|BF275217_P1 | 7673 | 747 | 81.4 | globlastp |
| 4366 | LYD283 | cotton\|gb164\|BF275217_P1 | 7674 | 747 | 81.4 | globlastp |
| 4367 | LYD283 | poplar\|gb170\|AI166581_P1 | 7675 | 747 | 81.4 | globlastp |
| 4368 | LYD283 | solanum_phureja\|09v1\|SPHBG133074_P1 | 7676 | 747 | 81.4 | globlastp |
| 4369 | LYD283 | eggplant\|10v1\|FS013361_P1 | 7677 | 747 | 81 | globlastp |
| 4370 | LYD283 | tomato\|09v1\|BG133074_P1 | 7678 | 747 | 81 | globlastp |
| 4371 | LYD283 | lotus\|09v1\|LLBP051762_P1 | 7679 | 747 | 81 | globlastp |
| 4372 | LYD283 | poplar\|10v1\|AI166581_P1 | 7680 | 747 | 81 | globlastp |
| 4373 | LYD283 | monkeyflower\|10v1\|GR143009_P1 | 7681 | 747 | 80.7 | globlastp |
| 4374 | LYD283 | tragopogon\|10v1\|SRR020205S0053760_P1 | 7682 | 747 | 80.7 | globlastp |
| 4375 | LYD283 | grape\|gb160\|CA814991_P1 | 7683 | 747 | 80.3 | globlastp |
| 4376 | LYD283 | cucumber\|09v1\|AM717128_P1 | 7684 | 747 | 80.1 | globlastp |
| 4377 | LYD286 | b_oleracea\|gb161\|AM062626_P1 | 7685 | 748 | 86.2 | globlastp |
| 4378 | LYD47 | potato\|gb157.2\|BM111944_P1 | 7686 | 758 | 95.7 | globlastp |
| 4379 | LYD63 | solanum_phureja\|09v1\|SPHCN641308_P1 | 7687 | 760 | 87.9 | globlastp |
| 4380 | LYD72 | lotus\|09v1\|BW625831_P1 | 7688 | 763 | 88.8 | globlastp |
| 4381 | LYD72 | soybean\|gb168\|AW696637_P1 | 7689 | 763 | 88.3 | globlastp |
| 4382 | LYD72 | soybean\|gb168\|BE821269_P1 | 7690 | 763 | 86.8 | globlastp |
| 4383 | LYD72 | bean\|gb167\|CA901109_T1 | 7691 | 763 | 86.5 | glotblastn |
| 4384 | LYD72 | peanut\|10v1\|ES724530_P1 | 7692 | 763 | 86 | globlastp |
| 4385 | LYD72 | prunus\|10v1\|CB822898_P1 | 7693 | 763 | 81.3 | globlastp |
| 4386 | LYD72 | aquilegia\|10v1\|DR917620_P1 | 7694 | 763 | 81.2 | globlastp |
| 4387 | LYD72 | aquilegia\|gb157.3\|DR917620_P1 | 7694 | 763 | 81.2 | globlastp |
| 4388 | LYD72 | solanum_phureja\|09v1\|SPHAW031813_P1 | 7695 | 763 | 81.2 | globlastp |
| 4389 | LYD72 | tomato\|09v1\|AW031813_P1 | 7696 | 763 | 81 | globlastp |
| 4390 | LYD72 | pepper\|gb171\|BM063495_T1 | 7697 | 763 | 80.94 | glotblastn |
| 4391 | LYD72 | cotton\|10v1\|AI055312_P1 | 7698 | 763 | 80.8 | globlastp |
| 4392 | LYD72 | cotton\|gb164\|AI055312_P1 | 7699 | 763 | 80.7 | globlastp |
| 4393 | LYD72 | sunflower\|gb162\|CD848269_P1 | 7700 | 763 | 80.7 | globlastp |
| 4394 | LYD72 | monkeyflower\|10v1\|GR032871_P1 | 7701 | 763 | 80.5 | globlastp |
| 4395 | LYD72 | monkeyflower\|09v1\|GR032871_P1 | 7702 | 763 | 80.47 | glotblastn |
| 4396 | LYD72 | tomato\|gb164\|AW031813_P1 | 7703 | 763 | 80.3 | globlastp |
| 4397 | LYD72 | oak\|10v1\|DB997046_P1 | 7704 | 763 | 80.2 | globlastp |
| 4398 | LYD72 | apple\|gb171\|CN579925_P1 | 7705 | 763 | 80.2 | globlastp |
| 4399 | LYD72 | arabidopsis\|10v1\|AT5G54810_P1 | 7706 | 763 | 80.1 | globlastp |
| 4400 | LYD72 | nicotiana_benthamiana\|gb162\|CN655267_P1 | 7707 | 763 | 80.1 | globlastp |
| 4401 | LYD72 | arabidopsis_lyrata\|09v1\|JGIAL025383_P1 | 7708 | 763 | 80 | globlastp |
| 4402 | LYD72 | tragopogon\|10v1\|SRR020205S0029634_P1 | 7709 | 763 | 80 | globlastp |
| 4403 | LYD72 | triphysaria\|10v1\|DR176521_P1 | 7710 | 763 | 80 | globlastp |
| 4404 | LYD72 | potato\|10v1\|BQ513736_P1 | 7711 | 763 | 80 | globlastp |
| 4405 | LYD72 | potato\|gb157.2\|BQ513736_P1 | 7711 | 763 | 80 | globlastp |
| 4406 | LYD81 | oak\|10v1\|SRR006307S0031382_P1 | 7712 | 764 | 83.6 | globlastp |
| 4407 | LYD81 | pigeonpea\|10v1\|SRR054580S0016035_P1 | 7713 | 764 | 82.3 | globlastp |
| 4408 | LYD81 | soybean\|gb168\|BU926188_P1 | 7714 | 764 | 80.8 | globlastp |
| 4409 | LYD88 | arabidopsis\|10v1\|AT1G26130_T1 | 7715 | 765 | 82.94 | glotblastn |
| 4410 | LYD105 | canola\|10v1\|CN727032_P1 | 7716 | 766 | 83.2 | globlastp |
| 4411 | LYD105 | canola\|gb161\|CN727032_P1 | 7717 | 766 | 83.2 | globlastp |
| 4412 | LYD105 | arabidopsis_lyrata\|09v1\|JGIAL016910_P1 | 7718 | 766 | 83 | globlastp |
| 4413 | LYD105 | arabidopsis\|10v1\|AT3G27560_P1 | 7719 | 766 | 82.9 | globlastp |
| 4414 | LYD105 | b_oleracea\|gb161\|AM386429_P1 | 7720 | 766 | 82.6 | globlastp |
| 4415 | LYD105 | radish\|gb164\|EY910860_T1 | 7721 | 766 | 81.18 | glotblastn |
| 4416 | LYD105 | cassava\|09v1\|CK647124_T1 | 7722 | 766 | 80.45 | glotblastn |
| 4417 | LYD105 | tomato\|09v1\|AA824727_T1 | 7723 | 766 | 80.23 | glotblastn |
| 4418 | LYD109 | radish\|gb164\|EV524714_P1 | 7724 | 767 | 95.8 | globlastp |
| 4419 | LYD109 | arabidopsis\|10v1\|AT4G14210_P1 | 7725 | 767 | 92.8 | globlastp |
| 4420 | LYD109 | arabidopsis_lyrata\|09v1\|GFXEF502451X1_P1 | 7726 | 767 | 91.8 | globlastp |
| 4421 | LYD109 | oak\|10v1\|FP069374_P1 | 7727 | 767 | 80.4 | globlastp |
| 4422 | LYD109 | castorbean\|09v1\|EE260095_T1 | 7728 | 767 | 80.14 | glotblastn |
| 4423 | LYD110 | canola\|gb161\|ES911570_P1 | 7729 | 768 | 98.1 | globlastp |
| 4424 | LYD110 | radish\|gb164\|EV568257_T1 | 7730 | 768 | 91.88 | glotblastn |
| 4425 | LYD110 | radish\|gb164\|EV543952_P1 | 7731 | 768 | 84.2 | globlastp |
| 4426 | LYD110 | arabidopsis_lyrata\|09v1\|JGIAL030152_P1 | 7732 | 768 | 84 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4427 | LYD110 | arabidopsis\|10v1\|AT5G56080_P1 | 7733 | 768 | 84 | globlastp |
| 4428 | LYD110 | canola\|10v1\|CD813574_P1 | 7734 | 769 | 98.1 | globlastp |
| 4429 | LYD113 | canola\|gb161\|H07501_P1 | 7734 | 769 | 98.1 | globlastp |
| 4430 | LYD113 | b_oleracea\|gb161\|AY187682_P1 | 7735 | 769 | 97 | globlastp |
| 4431 | LYD113 | radish\|gb164\|EV526673_P1 | 7736 | 769 | 95.3 | globlastp |
| 4432 | LYD113 | thellungiella\|gb167\|DN776190_P1 | 7737 | 769 | 84.7 | globlastp |
| 4433 | LYD114 | b_rapa\|gb162\|DN192298_P1 | 770 | 770 | 100 | globlastp |
| 4434 | LYD114 | canola\|10v1\|CX281513_P1 | 770 | 770 | 100 | globlastp |
| 4435 | LYD114 | canola\|gb161\|CX193733_P1 | 770 | 770 | 100 | globlastp |
| 4436 | LYD114 | radish\|gb164\|EV552277_P1 | 7738 | 770 | 98.5 | globlastp |
| 4437 | LYD114 | radish\|gb164\|EW738039_P1 | 7739 | 770 | 98.5 | globlastp |
| 4438 | LYD114 | b_oleracea\|gb161\|AM385630_P1 | 7740 | 770 | 97 | globlastp |
| 4439 | LYD114 | canola\|10v1\|CD817455_P1 | 7740 | 770 | 97 | globlastp |
| 4440 | LYD114 | canola\|gb161\|CD817455_P1 | 7740 | 770 | 97 | globlastp |
| 4441 | LYD114 | radish\|gb164\|EV547219_T1 | 7741 | 770 | 94.78 | glotblastn |
| 4442 | LYD114 | thellungiella\|gb167\|DN775588_T1 | 7742 | 770 | 91.79 | glotblastn |
| 4443 | LYD114 | b_oleracea\|gb161\|AM059553_P1 | 7743 | 770 | 89.7 | globlastp |
| 4444 | LYD114 | radish\|gb164\|EV539470_P1 | 7744 | 770 | 88.1 | globlastp |
| 4445 | LYD114 | radish\|gb164\|EX756944_T1 | 7745 | 770 | 87.41 | glotblastn |
| 4446 | LYD114 | canola\|10v1\|CD825920_T1 | 7746 | 770 | 87.31 | glotblastn |
| 4447 | LYD114 | canola\|gb161\|CD825920_T1 | 7746 | 770 | 87.31 | glotblastn |
| 4448 | LYD114 | canola\|10v1\|H07623_T1 | 7747 | 770 | 87.31 | glotblastn |
| 4449 | LYD114 | canola\|gb161\|H07623_T1 | 7747 | 770 | 87.31 | glotblastn |
| 4450 | LYD114 | radish\|gb164\|EV546635_T1 | 7748 | 770 | 85.93 | glotblastn |
| 4451 | LYD114 | b_oleracea\|gb161\|AM394291_P1 | 7749 | 770 | 85.8 | globlastp |
| 4452 | LYD114 | b_rapa\|gb162\|CA991446_T1 | 7750 | 770 | 85.07 | glotblastn |
| 4453 | LYD114 | radish\|gb164\|EX754112_T1 | 7751 | 770 | 84.33 | glotblastn |
| 4454 | LYD114 | canola\|10v1\|EV051345_P1 | 7752 | 770 | 84.3 | globlastp |
| 4455 | LYD114 | b_rapa\|gb162\|L38034_T1 | 7753 | 770 | 82.84 | glotblastn |
| 4456 | LYD114 | canola\|10v1\|CD819652_T1 | 7753 | 770 | 82.84 | glotblastn |
| 4457 | LYD114 | cleome_spinosa\|10v1\|SRR015531S0011868_T1 | 7754 | 770 | 82.84 | glotblastn |
| 4458 | LYD114 | arabidopsis\|10v1\|AT1G56220_T1 | 7755 | 770 | 82.73 | glotblastn |
| 4459 | LYD114 | arabidopsis\|gb165\|AT1G56220_T1 | 7755 | 770 | 82.73 | glotblastn |
| 4460 | LYD114 | canola\|10v1\|CX192491_P1 | 7756 | 770 | 82.1 | globlastp |
| 4461 | LYD114 | canola\|10v1\|EV064263_P1 | 7757 | 770 | 82.1 | globlastp |
| 4462 | LYD114 | cleome_gynandra\|10v1\|SRR015532S0009953_T1 | 7758 | 770 | 82.09 | glotblastn |
| 4463 | LYD114 | arabidopsis_lyrata\|09v1\|BQ834263_T1 | 7759 | 770 | 81.38 | glotblastn |
| 4464 | LYD114 | canola\|10v1\|EE564838_P1 | 7760 | 770 | 81.3 | globlastp |
| 4465 | LYD118 | b_juncea\|10v2\|OXBJ1SLX00007355D1T1_P1 | 7761 | 771 | 96.4 | globlastp |
| 4466 | LYD118 | radish\|gb164\|EW716528_P1 | 7762 | 771 | 89.8 | globlastp |
| 4467 | LYD118 | radish\|gb164\|EV569575_P1 | 7763 | 771 | 88.6 | globlastp |
| 4468 | LYD118 | radish\|gb164\|EW732708_P1 | 7764 | 771 | 88.6 | globlastp |
| 4469 | LYD118 | radish\|gb164\|EW717887_P1 | 7765 | 771 | 88 | globlastp |
| 4470 | LYD118 | b_juncea\|gb164\|EVGN00850231400957_T1 | 7766 | 771 | 85.54 | glotblastn |
| 4471 | LYD119 | arabidopsis\|10v1\|AT5G12860_P1 | 7767 | 772 | 93.2 | globlastp |
| 4472 | LYD119 | arabidopsis\|gb165\|AT5G12860_P1 | 7767 | 772 | 93.2 | globlastp |
| 4473 | LYD119 | arabidopsis_lyrata\|09v1\|JGIAL020962_P1 | 7768 | 772 | 92.7 | globlastp |
| 4474 | LYD119 | cleome_gynandra\|10v1\|SRR015532S0002836_P1 | 7769 | 772 | 86.8 | globlastp |
| 4475 | LYD119 | cleome_gynandra\|10v1\|SRR015532S0035815_P1 | 7770 | 772 | 85.5 | globlastp |
| 4476 | LYD119 | poplar\|10v1\|CA928609_P1 | 7771 | 772 | 83.5 | globlastp |
| 4477 | LYD119 | poplar\|gb170\|CA928609_P1 | 7771 | 772 | 83.5 | globlastp |
| 4478 | LYD119 | poplar\|10v1\|BI070860_P1 | 7772 | 772 | 82.7 | globlastp |
| 4479 | LYD119 | poplar\|gb170\|BI070860_P1 | 7772 | 772 | 82.7 | globlastp |
| 4480 | LYD119 | castorbean\|09v1\|EE260186_P1 | 7773 | 772 | 82.2 | globlastp |
| 4481 | LYD119 | prunus\|10v1\|CN929365_P1 | 7774 | 772 | 81.7 | globlastp |
| 4482 | LYD119 | artemisia\|10v1\|EY036735_P1 | 7775 | 772 | 81.6 | globlastp |
| 4483 | LYD119 | sunflower\|10v1\|DY908134_P1 | 7776 | 772 | 81.2 | globlastp |
| 4484 | LYD119 | grape\|gb160\|CB344649_P1 | 7777 | 772 | 80.9 | globlastp |
| 4485 | LYD119 | cotton\|10v1\|BF269907_P1 | 7778 | 772 | 80.8 | globlastp |
| 4486 | LYD119 | cotton\|gb164\|BF269907_P1 | 7778 | 772 | 80.8 | globlastp |
| 4487 | LYD119 | cassava\|09v1\|JGICASSAVA30675VALIDM1_P1 | 7779 | 772 | 80.7 | globlastp |
| 4488 | LYD119 | aquilegia\|10v1\|DR914808_P1 | 7780 | 772 | 80.6 | globlastp |
| 4489 | LYD119 | cassava\|09v1\|DV445590_P1 | 7781 | 772 | 80.2 | globlastp |
| 4490 | LYD119 | antirrhinum\|gb166\|AJ787659_P1 | 7782 | 772 | 80.2 | globlastp |
| 4491 | LYD119 | monkeyflower\|09v1\|GO948454_P1 | 7783 | 772 | 80.2 | globlastp |
| 4492 | LYD119 | monkeyflower\|10v1\|GO948455_P1 | 7783 | 772 | 80.2 | globlastp |
| 4493 | LYD119 | citrus\|gb166\|CF419050_P1 | 7784 | 772 | 80 | globlastp |
| 4494 | LYD123 | canola\|10v1\|CN728688_P1 | 7785 | 773 | 96.6 | globlastp |
| 4495 | LYD123 | radish\|gb164\|EV524917_P1 | 7786 | 773 | 92.9 | globlastp |
| 4496 | LYD123 | arabidopsis_lyrata\|09v1\|CRPALE016296_P1 | 7787 | 773 | 88.4 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4497 | LYD123 | arabidopsis\|10v1\|AT2G37340_P1 | 7788 | 773 | 88.4 | globlastp |
| 4498 | LYD123 | arabidopsis\|gb165\|AT2G37340_P1 | 7788 | 773 | 88.4 | globlastp |
| 4499 | LYD123 | b_oleracea\|gb161\|EH426839_P1 | 7789 | 773 | 82.6 | globlastp |
| 4500 | LYD123 | b_juncea\|10v2\|E6ANDIZ01BH2HE_P1 | 7790 | 773 | 81.7 | globlastp |
| 4501 | LYD125 | pigeonpea\|10v1\|SRR054580S0012872_T1 | 7791 | 774 | 89.01 | glotblastn |
| 4502 | LYD125 | bean\|gb167\|CV544024_P1 | 7792 | 774 | 88.8 | globlastp |
| 4503 | LYD125 | soybean\|gb168\|AW719401_P1 | 7793 | 774 | 88.4 | globlastp |
| 4504 | LYD125 | soybean\|gb168\|BE352657_P1 | 7794 | 774 | 87.6 | globlastp |
| 4505 | LYD125 | lotus\|09v1\|AW428919_P1 | 7795 | 774 | 86.9 | globlastp |
| 4506 | LYD125 | medicago\|09v1\|AW257307_P1 | 7796 | 774 | 83.9 | globlastp |
| 4507 | LYD125 | pigeonpea\|10v1\|SRR054580S0004318_T1 | 7797 | 774 | 81.94 | glotblastn |
| 4508 | LYD125 | soybean\|gb168\|AW171770_P1 | 7798 | 774 | 81.7 | globlastp |
| 4509 | LYD125 | soybean\|gb168\|AW776461_P1 | 7799 | 774 | 81.4 | globlastp |
| 4510 | LYD127 | cowpea\|gb166\|FF538530_P1 | 7800 | 776 | 87.2 | globlastp |
| 4511 | LYD127 | peanut\|10v1\|GO342156_P1 | 7801 | 776 | 82.3 | globlastp |
| 4512 | LYD127 | medicago\|09v1\|BF632820_P1 | 7802 | 776 | 81.9 | globlastp |
| 4513 | LYD127 | cotton\|10v1\|AI726687_P1 | 7803 | 776 | 81.6 | globlastp |
| 4514 | LYD127 | cotton\|gb164\|AI726687_P1 | 7804 | 776 | 80.8 | globlastp |
| 4515 | LYD127 | citrus\|gb166\|DY266151_P1 | 7805 | 776 | 80 | globlastp |
| 4516 | LYD144 | solanum_phureja\|09v1\|SPHBG135622_P1 | 7806 | 777 | 90.7 | globlastp |
| 4517 | LYD149 | radish\|gb164\|EX747638_T1 | 7807 | 778 | 94.9 | glotblastn |
| 4518 | LYD149 | canola\|gb161\|CD814305_P1 | 7808 | 778 | 94 | globlastp |
| 4519 | LYD149 | canola\|10v1\|CD812024_P1 | 7809 | 778 | 93.8 | globlastp |
| 4520 | LYD149 | canola\|10v1\|CD814305_T1 | 7810 | 778 | 93.04 | glotblastn |
| 4521 | LYD149 | papaya\|gb165\|EX248891_P1 | 7811 | 778 | 80.6 | globlastp |
| 4522 | LYD149 | castorbean\|09v1\|EG659975_P1 | 7812 | 778 | 80.4 | globlastp |
| 4523 | LYD159 | radish\|gb164\|EV528645_P1 | 7813 | 780 | 98.8 | globlastp |
| 4524 | LYD159 | radish\|gb164\|EW733261_T1 | 7814 | 780 | 98.77 | glotblastn |
| 4525 | LYD159 | radish\|gb164\|EW713860_P1 | 7815 | 780 | 98.1 | globlastp |
| 4526 | LYD159 | b_oleracea\|gb161\|AF458411_T1 | 7816 | 780 | 97.53 | glotblastn |
| 4527 | LYD159 | canola\|gb161\|CD834630_T1 | 7817 | 780 | 97.53 | glotblastn |
| 4528 | LYD159 | canola\|10v1\|CD834630_P1 | 7818 | 780 | 97.5 | globlastp |
| 4529 | LYD159 | canola\|10v1\|DY005750_P1 | 7819 | 780 | 97.5 | globlastp |
| 4530 | LYD159 | radish\|gb164\|EV538481_P1 | 7820 | 780 | 97.5 | globlastp |
| 4531 | LYD159 | radish\|gb164\|EX894636_P1 | 7821 | 780 | 97.5 | globlastp |
| 4532 | LYD159 | b_rapa\|gb162\|CV546164_P1 | 7822 | 780 | 96.9 | globlastp |
| 4533 | LYD159 | thellungiella\|gb167\|DN775724_P1 | 7823 | 780 | 93.8 | globlastp |
| 4534 | LYD159 | canola\|gb161\|EV166721_T1 | 7824 | 780 | 93.33 | glotblastn |
| 4535 | LYD159 | radish\|gb164\|EW733038_T1 | 7825 | 780 | 87.04 | glotblastn |
| 4536 | LYD159 | b_oleracea\|gb161\|EH420689_P1 | 7826 | 780 | 87 | globlastp |
| 4537 | LYD159 | canola\|10v1\|H07449_P1 | 7827 | 780 | 85.8 | globlastp |
| 4538 | LYD159 | canola\|gb161\|CX192832_P1 | 7827 | 780 | 85.8 | globlastp |
| 4539 | LYD159 | b_rapa\|gb162\|CV544755_P1 | 7828 | 780 | 85.2 | globlastp |
| 4540 | LYD166 | b_rapa\|gb162\|L46543_P1 | 7829 | 781 | 99.7 | globlastp |
| 4541 | LYD166 | canola\|10v1\|CD833070_P1 | 7829 | 781 | 99.7 | globlastp |
| 4542 | LYD166 | canola\|gb161\|CD833070_P1 | 7829 | 781 | 99.7 | globlastp |
| 4543 | LYD172 | canola\|10v1\|CN726866_P1 | 7830 | 782 | 98.2 | globlastp |
| 4544 | LYD172 | canola\|gb161\|CN726866_P1 | 7830 | 782 | 98.2 | globlastp |
| 4545 | LYD172 | radish\|gb164\|EX902387_P1 | 7831 | 782 | 88.6 | globlastp |
| 4546 | LYD172 | canola\|10v1\|ES979818_P1 | 7832 | 782 | 85.3 | globlastp |
| 4547 | LYD172 | canola\|gb161\|ES979818_P1 | 7832 | 782 | 85.3 | globlastp |
| 4548 | LYD172 | b_juncea\|10v2\|E6ANDIZ02H19R1_P1 | 7833 | 782 | 84.7 | globlastp |
| 4549 | LYD172 | radish\|gb164\|EY894739_P1 | 7834 | 782 | 84.4 | globlastp |
| 4550 | LYD176 | arabidopsis_lyrata\|09v1\|JGIAL019524_P1 | 7835 | 782 | 81.8 | globlastp |
| 4551 | LYD176 | arabidopsis\|10v1\|AT3G61890_P1 | 7836 | 782 | 81.3 | globlastp |
| 4552 | LYD176 | radish\|gb164\|AF051129_P1 | 7837 | 783 | 97.4 | globlastp |
| 4553 | LYD176 | radish\|gb164\|EV538606_P1 | 7838 | 783 | 97.4 | globlastp |
| 4554 | LYD176 | radish\|gb164\|EW722794_P1 | 7839 | 783 | 97.4 | globlastp |
| 4555 | LYD176 | radish\|gb164\|EX763616_P1 | 7840 | 783 | 96.9 | globlastp |
| 4556 | LYD176 | radish\|gb164\|EX902662_P1 | 7841 | 783 | 96.9 | globlastp |
| 4557 | LYD176 | radish\|gb164\|EW734604_P1 | 7842 | 783 | 96.4 | globlastp |
| 4558 | LYD186 | canola\|10v1\|DY005919_P1 | 7843 | 784 | 99.5 | globlastp |
| 4559 | LYD186 | canola\|10v1\|EG021056_P1 | 7844 | 784 | 99.5 | globlastp |
| 4560 | LYD186 | canola\|gb161\|DY005919_P1 | 7844 | 784 | 99.5 | globlastp |
| 4561 | LYD186 | b_rapa\|gb162\|L37642_P1 | 7845 | 784 | 98.6 | globlastp |
| 4562 | LYD186 | radish\|gb164\|EV529343_P1 | 7846 | 784 | 97.3 | globlastp |
| 4563 | LYD186 | radish\|gb164\|EW715711_P1 | 7847 | 784 | 95.9 | globlastp |
| 4564 | LYD188 | canola\|10v1\|DY005761_P1 | 785 | 785 | 100 | globlastp |
| 4565 | LYD188 | canola\|gb161\|DY005761_P1 | 785 | 785 | 100 | globlastp |
| 4566 | LYD188 | b_rapa\|gb162\|EE516969_P1 | 7848 | 785 | 99.3 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4567 | LYD188 | canola\|10v1\|CD813443_P1 | 7849 | 785 | 96.5 | globlastp |
| 4567 | LYD188 | canola\|gb161\|CD813443_P1 | 7850 | 785 | 82.1 | globlastp |
| 4568 | LYD190 | b_rapa\|gb162\|BG543253_P1 | 786 | 786 | 100 | globlastp |
| 4569 | LYD190 | canola\|gb161\|CD835187_P1 | 7851 | 786 | 99.6 | globlastp |
| 4570 | LYD190 | canola\|gb161\|CX195771_P1 | 7852 | 786 | 97.3 | globlastp |
| 4571 | LYD190 | radish\|gb164\|EV524986_P1 | 7853 | 786 | 96.9 | globlastp |
| 4572 | LYD190 | radish\|gb164\|EV535594_P1 | 7854 | 786 | 96.4 | globlastp |
| 4573 | LYD190 | canola\|10v1\|CD835187_P1 | 7855 | 786 | 96 | globlastp |
| 4574 | LYD190 | b_oleracea\|gb161\|DY027954_P1 | 7856 | 786 | 96 | globlastp |
| 4575 | LYD190 | b_rapa\|gb162\|DN191759_P1 | 7857 | 786 | 95.1 | globlastp |
| 4576 | LYD190 | canola\|gb161\|EE460907_P1 | 7858 | 786 | 94.2 | globlastp |
| 4577 | LYD190 | canola\|10v1\|CX195771_P1 | 7859 | 786 | 93.8 | globlastp |
| 4578 | LYD190 | radish\|gb164\|EV525191_P1 | 7860 | 786 | 93.4 | globlastp |
| 4579 | LYD190 | radish\|gb164\|EW716790_P1 | 7861 | 786 | 92.9 | globlastp |
| 4580 | LYD190 | canola\|10v1\|DY018174_P1 | 7862 | 786 | 91.1 | globlastp |
| 4581 | LYD190 | canola\|10v1\|EE460907_P1 | 7863 | 786 | 90.2 | globlastp |
| 4582 | LYD190 | radish\|gb164\|EV535846_P1 | 7864 | 786 | 88.9 | globlastp |
| 4583 | LYD190 | canola\|10v1\|EE450783_P1 | 7865 | 786 | 81.8 | globlastp |
| 4584 | LYD193 | canola\|10v1\|CX189856_P1 | 7866 | 787 | 96.8 | globlastp |
| 4585 | LYD193 | b_rapa\|gb162\|BG544260_P1 | 7867 | 787 | 96.4 | globlastp |
| 4586 | LYD193 | radish\|gb164\|EV528689_P1 | 7868 | 787 | 93.6 | globlastp |
| 4587 | LYD193 | radish\|gb164\|EV525108_P1 | 7869 | 787 | 92.9 | globlastp |
| 4588 | LYD193 | thellungiella\|gb167\|DN775498_P1 | 7870 | 787 | 86.9 | globlastp |
| 4589 | LYD193 | b_rapa\|gb162\|EX026337_P1 | 7871 | 787 | 83.3 | globlastp |
| 4590 | LYD196 | sugarcane\|10v1\|CA074696_P1 | 7872 | 788 | 96.8 | globlastp |
| 4591 | LYD196 | sugarcane\|gb157.3\|CA080645_P1 | 7872 | 788 | 96.8 | globlastp |
| 4592 | LYD196 | maize\|gb170\|AI665932_T1 | 7873 | 788 | 93.97 | glotblastn |
| 4593 | LYD196 | millet\|10v1\|EVO454PM033804_P1 | 7874 | 788 | 93.1 | globlastp |
| 4594 | LYD196 | rice\|gb170\|OS03G06940_P1 | 7875 | 788 | 89.1 | globlastp |
| 4595 | LYD196 | maize\|10v1\|AI665932_P1 | 7876 | 788 | 88.9 | globlastp |
| 4596 | LYD196 | brachypodium\|09v1\|GT790565_P1 | 7877 | 788 | 86.6 | globlastp |
| 4597 | LYD196 | brachypodium\|gb169\|BE400891_P1 | 7878 | 788 | 86.4 | globlastp |
| 4598 | LYD196 | fescue\|gb161\|DT686342_P1 | 7879 | 788 | 84.8 | globlastp |
| 4599 | LYD196 | wheat\|gb164\|BE400891_P1 | 7880 | 788 | 80.8 | globlastp |
| 4600 | LYD200 | radish\|gb164\|EL738642_P1 | 7881 | 789 | 94.4 | globlastp |
| 4601 | LYD200 | radish\|gb164\|EW713777_P1 | 7882 | 789 | 93.6 | globlastp |
| 4602 | LYD200 | arabidopsis_lyrata\|09v1\|JGIAL004190_T1 | 7883 | 789 | 80.95 | glotblastn |
| 4603 | LYD200 | b_juncea\|10v2\|E6ANDIZ01EIESA_T1 | 7884 | 789 | 80.49 | glotblastn |
| 4604 | LYD200 | thellungiella\|gb167\|DN773999_T1 | 7885 | 789 | 80.16 | glotblastn |
| 4605 | LYD200 | arabidopsis\|10v1\|AT1G48300_T1 | 7886 | 789 | 80 | glotblastn |
| 4606 | LYD202 | b_rapa\|gb162\|L47957_P1 | 790 | 790 | 100 | globlastp |
| 4607 | LYD202 | radish\|gb164\|EV525903_P1 | 7887 | 790 | 98.8 | globlastp |
| 4608 | LYD202 | b_juncea\|gb164\|EVGN00431513913410_P1 | 7888 | 790 | 98.2 | globlastp |
| 4609 | LYD202 | b_juncea\|10v2\|E7FJ1I304DZD87_P1 | 7889 | 790 | 97.6 | globlastp |
| 4610 | LYD202 | thellungiella\|gb167\|DN774524_P1 | 7890 | 790 | 96.4 | globlastp |
| 4611 | LYD202 | b_juncea\|gb164\|EVGN00297712102885_P1 | 7891 | 790 | 95.8 | globlastp |
| 4612 | LYD202 | canola\|gb161\|CD821415_P1 | 7892 | 790 | 95.8 | globlastp |
| 4613 | LYD202 | b_juncea\|gb164\|EVGN00431908921497_P1 | 7893 | 790 | 95.2 | globlastp |
| 4614 | LYD202 | b_oleracea\|gb161\|AM057048_P1 | 7894 | 790 | 95.2 | globlastp |
| 4615 | LYD202 | canola\|10v1\|CD821415_P1 | 7893 | 790 | 95.2 | globlastp |
| 4616 | LYD202 | maize\|gb170\|LLDQ244973_P1 | 7893 | 790 | 95.2 | globlastp |
| 4617 | LYD202 | arabidopsis\|10v1\|AT1G32470_P1 | 7895 | 790 | 94.6 | globlastp |
| 4618 | LYD202 | arabidopsis\|gb165\|AT1G32470_P1 | 7895 | 790 | 94.6 | globlastp |
| 4619 | LYD202 | b_oleracea\|gb161\|AM394813_P1 | 7896 | 790 | 94.6 | globlastp |
| 4620 | LYD202 | b_rapa\|gb162\|BG543984_P1 | 7897 | 790 | 94.6 | globlastp |
| 4621 | LYD202 | b_rapa\|gb162\|EX031236_P1 | 7898 | 790 | 94.6 | globlastp |
| 4622 | LYD202 | canola\|10v1\|CD819721_P1 | 7899 | 790 | 94.6 | globlastp |
| 4623 | LYD202 | canola\|gb161\|CD819721_P1 | 7899 | 790 | 94.6 | globlastp |
| 4624 | LYD202 | canola\|10v1\|CX189579_P1 | 7897 | 790 | 94.6 | globlastp |
| 4625 | LYD202 | canola\|gb161\|CX190884_P1 | 7897 | 790 | 94.6 | globlastp |
| 4626 | LYD202 | radish\|gb164\|EV524455_P1 | 7900 | 790 | 94.6 | globlastp |
| 4627 | LYD202 | radish\|gb164\|EV527420_P1 | 7901 | 790 | 94.6 | globlastp |
| 4628 | LYD202 | radish\|gb164\|EV538447_P1 | 7901 | 790 | 94.6 | globlastp |
| 4629 | LYD202 | radish\|gb164\|EX755703_P1 | 7900 | 790 | 94.6 | globlastp |
| 4630 | LYD202 | arabidopsis_lyrata\|09v1\|JGIAL003380_P1 | 7902 | 790 | 94 | globlastp |
| 4631 | LYD202 | radish\|gb164\|EV535156_P1 | 7903 | 790 | 94 | globlastp |
| 4632 | LYD202 | radish\|gb164\|EX754318_P1 | 7904 | 790 | 93.4 | globlastp |
| 4633 | LYD202 | b_juncea\|10v2\|E6ANDIZ01A4HQK1_P1 | 7905 | 790 | 90.4 | globlastp |
| 4634 | LYD202 | canola\|10v1\|ES913100_P1 | 7906 | 790 | 90.4 | globlastp |
| 4635 | LYD202 | canola\|gb161\|ES913100_P1 | 7906 | 790 | 90.4 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4636 | LYD202 | b_juncea\|10v2\|E6ANDIZ01A0ZNS_P1 | 7907 | 790 | 89.8 | globlastp |
| 4637 | LYD202 | arabidopsis_lyrata\|09v1\|JGIAL014677_P1 | 7908 | 790 | 89.2 | globlastp |
| 4638 | LYD202 | b_juncea\|10v2\|E6ANDIZ01A24DX_P1 | 7909 | 790 | 89.2 | globlastp |
| 4639 | LYD202 | arabidopsis\|10v1\|AT2G35370_P1 | 7910 | 790 | 89.2 | globlastp |
| 4640 | LYD202 | thellungiella\|gb167\|BY824972_P1 | 7911 | 790 | 89.2 | globlastp |
| 4641 | LYD202 | canola\|gb161\|EV100595_T1 | 7912 | 790 | 86.14 | glotblastn |
| 4642 | LYD202 | cleome_spinosa\|10v1\|GR932738_P1 | 7913 | 790 | 86.1 | globlastp |
| 4643 | LYD202 | cleome_spinosa\|10v1\|GR934792_P1 | 7914 | 790 | 86.1 | globlastp |
| 4644 | LYD202 | radish\|gb164\|EY902757_P1 | 7915 | 790 | 83.8 | globlastp |
| 4645 | LYD202 | oak\|10v1\|CU657264_P1 | 7916 | 790 | 83.7 | globlastp |
| 4646 | LYD202 | oak\|gb170\|CU657264_P1 | 7916 | 790 | 83.7 | globlastp |
| 4647 | LYD202 | prunus\|10v1\|CN494213_P1 | 7917 | 790 | 83.7 | globlastp |
| 4648 | LYD202 | antirrhinum\|gb166\|AJ559224_P1 | 7918 | 790 | 83.2 | globlastp |
| 4649 | LYD202 | grape\|gb160\|BM437053_P1 | 7919 | 790 | 83.1 | globlastp |
| 4650 | LYD202 | pea\|09v1\|X53656_P1 | 7920 | 790 | 83.1 | globlastp |
| 4651 | LYD202 | radish\|gb164\|EV535424_P1 | 7921 | 790 | 83.1 | globlastp |
| 4652 | LYD202 | triphysaria\|10v1\|EY127211_P1 | 7922 | 790 | 82.5 | globlastp |
| 4653 | LYD202 | monkeyflower\|09v1\|GO982522_P1 | 7923 | 790 | 82.5 | globlastp |
| 4654 | LYD202 | cucumber\|09v1\|AM724523_P1 | 7924 | 790 | 81.9 | globlastp |
| 4655 | LYD202 | apple\|gb171\|CN494213_P1 | 7925 | 790 | 81.9 | globlastp |
| 4656 | LYD202 | bean\|gb167\|CB280501_P1 | 7926 | 790 | 81.9 | globlastp |
| 4657 | LYD202 | chestnut\|gb170\|SRR006296S0063923_P1 | 7927 | 790 | 81.9 | globlastp |
| 4658 | LYD202 | clover\|gb162\|BB909867_P1 | 7928 | 790 | 81.9 | globlastp |
| 4659 | LYD202 | lotus\|09v1\|BW599691_P1 | 7929 | 790 | 81.9 | globlastp |
| 4660 | LYD202 | medicago\|09v1\|BE249702_P1 | 7930 | 790 | 81.9 | globlastp |
| 4661 | LYD202 | monkeyflower\|09v1\|DV205865_P1 | 7931 | 790 | 81.9 | globlastp |
| 4662 | LYD202 | monkeyflower\|09v1\|GO946263_P1 | 7932 | 790 | 81.9 | globlastp |
| 4663 | LYD202 | monkeyflower\|10v1\|DV205865_P1 | 7931 | 790 | 81.9 | globlastp |
| 4664 | LYD202 | prunus\|gb167\|DN554204_T1 | — | 790 | 81.33 | glotblastn |
| 4665 | LYD202 | melon\|10v1\|AM724523_P1 | 7933 | 790 | 81.3 | globlastp |
| 4666 | LYD202 | triphysaria\|gb164\|EY127211_P1 | 7934 | 790 | 81.3 | globlastp |
| 4667 | LYD202 | triphysaria\|10v1\|SRR023500S0007248_P1 | 7935 | 790 | 80.7 | globlastp |
| 4668 | LYD202 | apple\|gb171\|CN861717_P1 | 7936 | 790 | 80.7 | globlastp |
| 4669 | LYD202 | melon\|gb165\|AM724523_P1 | 7937 | 790 | 80.7 | globlastp |
| 4670 | LYD202 | soybean\|gb168\|AW776659_P1 | 7938 | 790 | 80.7 | globlastp |
| 4671 | LYD202 | walnuts\|gb166\|EL891328_P1 | 7939 | 790 | 80.7 | globlastp |
| 4672 | LYD202 | catharanthus\|gb166\|EG554374_P1 | 7940 | 790 | 80.2 | globlastp |
| 4673 | LYD202 | papaya\|gb165\|EX260182_P1 | 7941 | 790 | 80.2 | globlastp |
| 4674 | LYD202 | b_juncea\|10v2\|E6ANDIZ01A19IR_P1 | 7942 | 790 | 80.1 | globlastp |
| 4675 | LYD202 | castorbean\|09v1\|EE253855_P1 | 7943 | 790 | 80.1 | globlastp |
| 4676 | LYD202 | eucalyptus\|gb166\|CU394339_P1 | 7944 | 790 | 80.1 | globlastp |
| 4677 | LYD202 | pigeonpea\|10v1\|GW347341_P1 | 7945 | 790 | 80.1 | globlastp |
| 4678 | LYD202 | salvia\|10v1\|SRR014553S0000470_P1 | 7946 | 790 | 80.1 | globlastp |
| 4679 | LYD202 | strawberry\|gb164\|DY676038_P1 | 7947 | 790 | 80.1 | globlastp |
| 4680 | LYD202 | walnuts\|gb166\|EL892979_P1 | 7948 | 790 | 80.1 | globlastp |
| 4681 | LYD202 | cotton\|10v1\|CO075367_P1 | 7949 | 790 | 80.1 | globlastp |
| 4682 | LYD202 | cotton\|gb164\|CO075367_P1 | 7949 | 790 | 80.1 | globlastp |
| 4683 | LYD204 | b_juncea\|gb164\|EVGN00239816741209_P1 | 7950 | 791 | 96.3 | globlastp |
| 4684 | LYD204 | arabidopsis\|10v1\|AT1G02205_P1 | 7951 | 791 | 89.5 | globlastp |
| 4685 | LYD204 | arabidopsis\|gb165\|AT1G02205_P1 | 7951 | 791 | 89.5 | globlastp |
| 4686 | LYD204 | b_rapa\|gb162\|DN964044_P1 | 7952 | 791 | 84.3 | globlastp |
| 4687 | LYD208 | radish\|gb164\|EV545099_P1 | 7953 | 792 | 98.8 | globlastp |
| 4688 | LYD208 | radish\|gb164\|EX748567_P1 | 7954 | 792 | 84.9 | globlastp |
| 4689 | LYD208 | arabidopsis\|10v1\|AT5G15350_P1 | 7955 | 792 | 84.3 | globlastp |
| 4690 | LYD208 | arabidopsis_lyrata\|09v1\|JGIAL021233_P1 | 7956 | 792 | 83.7 | globlastp |
| 4691 | LYD225 | barley\|10v1\|BM373769_P1 | 7957 | 795 | 89 | globlastp |
| 4692 | LYD225 | wheat\|gb164\|CA728493_T1 | 7958 | 795 | 84.27 | glotblastn |
| 4693 | LYD225 | wheat\|gb164\|BG605058_T1 | 7959 | 795 | 82.52 | glotblastn |
| 4694 | LYD225 | wheat\|gb164\|CA497779_P1 | 7960 | 795 | 82 | globlastp |
| 4695 | LYD238 | oat\|10v2\|CN815277_P1 | 7961 | 796 | 85.5 | globlastp |
| 4696 | LYD238 | sugarcane\|gb157.3\|CA065337_T1 | 7962 | 796 | 83.91 | glotblastn |
| 4697 | LYD238 | cenchrus\|gb166\|EB661947_P1 | 7963 | 796 | 83.5 | globlastp |
| 4698 | LYD238 | rice\|gb170\|OS11G26910_P1 | 7964 | 796 | 83.5 | globlastp |
| 4699 | LYD238 | maize\|10v1\|AI372340_P1 | 7965 | 796 | 82.1 | globlastp |
| 4700 | LYD238 | maize\|gb170\|AI372340_P1 | 7965 | 796 | 82.1 | globlastp |
| 4701 | LYD238 | sorghum\|09v1\|SB05G012740_P1 | 7966 | 796 | 82.1 | globlastp |
| 4702 | LYD238 | sugarcane\|gb157.3\|BQ531360_P1 | 7966 | 796 | 82.1 | globlastp |
| 4703 | LYD238 | sugarcane\|10v1\|BQ531360_P1 | 7966 | 796 | 82.1 | globlastp |
| 4704 | LYD238 | brachypodium\|09v1\|DV473097_P1 | 7967 | 796 | 80.7 | globlastp |
| 4705 | LYD245 | arabidopsis_lyrata\|09v1\|JGIAL014790_P1 | 7968 | 797 | 97.4 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4706 | LYD245 | b_rapa|gb162|BQ790805_P1 | 7969 | 797 | 85.9 | globlastp |
| 4707 | LYD245 | canola|10v1|EE477076_P1 | 7970 | 797 | 85.4 | globlastp |
| 4708 | LYD245 | b_rapa|gb162|BG544887_P1 | 7971 | 797 | 84.6 | globlastp |
| 4709 | LYD245 | b_oleracea|gb161|AM386372_P1 | 7972 | 797 | 83.1 | globlastp |
| 4710 | LYD252 | b_juncea|10v2|E6ANDIZ01AUIRT_P1 | 7973 | 798 | 99.2 | globlastp |
| 4711 | LYD252 | b_juncea|10v2|E6ANDIZ02H583V_P1 | 7974 | 798 | 99.2 | globlastp |
| 4712 | LYD252 | cacao|gb167|CU473087_P1 | 7975 | 798 | 86.4 | globlastp |
| 4713 | LYD252 | catharanthus|gb166|EG554394_P1 | 7976 | 798 | 80.8 | globlastp |
| 4714 | LYD253 | canola|10v1|CX192470_P1 | 7977 | 799 | 99.7 | globlastp |
| 4715 | LYD253 | radish|gb164|EW722602_P1 | 7978 | 799 | 98.5 | globlastp |
| 4716 | LYD253 | canola|gb161|CD825725_P1 | 7979 | 799 | 96.7 | globlastp |
| 4717 | LYD253 | arabidopsis|10v1|AT2G27860_P1 | 7980 | 799 | 96.4 | globlastp |
| 4718 | LYD253 | arabidopsis|gb165|AT2G27860_P1 | 7980 | 799 | 96.4 | globlastp |
| 4719 | LYD253 | canola|10v1|CD813026_P1 | 7981 | 799 | 96.4 | globlastp |
| 4720 | LYD253 | canola|gb161|CD812999_P1 | 7982 | 799 | 96.4 | globlastp |
| 4721 | LYD253 | canola|10v1|EE456512_P1 | 7983 | 799 | 96.2 | globlastp |
| 4722 | LYD253 | b_rapa|gb162|BG544186_P1 | 7984 | 799 | 96.2 | globlastp |
| 4723 | LYD253 | canola|10v1|CD812999_P1 | 7984 | 799 | 96.2 | globlastp |
| 4724 | LYD253 | b_rapa|gb162|L38125_P1 | 7985 | 799 | 96.1 | globlastp |
| 4725 | LYD253 | radish|gb164|EX753989_P1 | 7986 | 799 | 96.1 | globlastp |
| 4726 | LYD253 | b_juncea|10v2|E6ANDIZ01AN10H_P1 | 7987 | 799 | 95.9 | globlastp |
| 4727 | LYD253 | b_oleracea|gb161|DY026282_P1 | 7988 | 799 | 95.9 | globlastp |
| 4728 | LYD253 | canola|gb161|CD813089_P1 | 7989 | 799 | 95.9 | globlastp |
| 4729 | LYD253 | canola|10v1|CD825725_P1 | 7990 | 799 | 95.9 | globlastp |
| 4730 | LYD253 | radish|gb164|EV570226_P1 | 7991 | 799 | 95.9 | globlastp |
| 4731 | LYD253 | canola|10v1|CD817550_P1 | 7992 | 799 | 95.6 | globlastp |
| 4732 | LYD253 | arabidopsis|10v1|AT1G08200_P1 | 7993 | 799 | 95.6 | globlastp |
| 4733 | LYD253 | arabidopsis|gb165|AT1G08200_P1 | 7993 | 799 | 95.6 | globlastp |
| 4734 | LYD253 | radish|gb164|EV527383_P1 | 7994 | 799 | 95.6 | globlastp |
| 4735 | LYD253 | canola|10v1|CN827904_P1 | 7995 | 799 | 95.4 | globlastp |
| 4736 | LYD253 | canola|gb161|CD827902_P1 | 7995 | 799 | 95.4 | globlastp |
| 4737 | LYD253 | b_rapa|gb162|CV544710_P1 | 7996 | 799 | 94.9 | globlastp |
| 4738 | LYD253 | cleome_gynandra|10v1|SRR015532S0002773_P1 | 7997 | 799 | 92.8 | globlastp |
| 4739 | LYD253 | cotton|gb164|AI726495_P1 | 7998 | 799 | 91.3 | globlastp |
| 4740 | LYD253 | monkeyflower|09v1|DV211316_P1 | 7999 | 799 | 91.3 | globlastp |
| 4741 | LYD253 | monkeyflower|10v1|DV211316_P1 | 7999 | 799 | 91.3 | globlastp |
| 4742 | LYD253 | cotton|10v1|AI725749_P1 | 7998 | 799 | 91.3 | globlastp |
| 4743 | LYD253 | cotton|gb164|AI725749_P1 | 8000 | 799 | 91 | globlastp |
| 4744 | LYD253 | tomato|09v1|BG125028_P1 | 8001 | 799 | 91 | globlastp |
| 4745 | LYD253 | tomato|gb164|AI485740_P1 | 8001 | 799 | 91 | globlastp |
| 4746 | LYD253 | potato|10v1|BG592065_P1 | 8002 | 799 | 90.7 | globlastp |
| 4747 | LYD253 | potato|gb157.2|BG592065_P1 | 8002 | 799 | 90.7 | globlastp |
| 4748 | LYD253 | solanum_phureja|09v1|SPHBG125028_P1 | 8003 | 799 | 90.5 | globlastp |
| 4749 | LYD253 | citrus|gb166|CB292463_P1 | 8004 | 799 | 90.3 | globlastp |
| 4750 | LYD253 | cotton|10v1|BF272340_P1 | 8005 | 799 | 90 | globlastp |
| 4751 | LYD253 | pigeonpea|10v1|SRR054580S0001142_P1 | 8006 | 799 | 89.7 | globlastp |
| 4752 | LYD253 | kiwi|gb166|FG461367_P1 | 8007 | 799 | 89.7 | globlastp |
| 4753 | LYD253 | grape|gb160|BQ792561_P1 | 8008 | 799 | 89.5 | globlastp |
| 4754 | LYD253 | lotus|09v1|LLAW720540_P1 | 8009 | 799 | 89.5 | globlastp |
| 4755 | LYD253 | grape|gb160|BQ794638_P1 | 8010 | 799 | 89.2 | globlastp |
| 4756 | LYD253 | poplar|10v1|AI166408_P1 | 8011 | 799 | 89.2 | globlastp |
| 4757 | LYD253 | poplar|gb170|AI166408_P1 | 8011 | 799 | 89.2 | globlastp |
| 4758 | LYD253 | sunflower|10v1|CD850731_P1 | 8012 | 799 | 89.2 | globlastp |
| 4759 | LYD253 | sunflower|gb162|CD850731_P1 | 8012 | 799 | 89.2 | globlastp |
| 4760 | LYD253 | kiwi|gb166|FG459805_P1 | 8013 | 799 | 89 | globlastp |
| 4761 | LYD253 | pigeonpea|10v1|GR464281_T1 | 8014 | 799 | 88.95 | glotblastn |
| 4762 | LYD253 | cotton|10v1|BE055021_P1 | 8015 | 799 | 88.9 | globlastp |
| 4763 | LYD253 | cassava|09v1|BM259762_P1 | 8016 | 799 | 88.7 | globlastp |
| 4764 | LYD253 | cichorium|gb171|DT212570_P1 | 8017 | 799 | 88.7 | globlastp |
| 4765 | LYD253 | poplar|10v1|BI127760_P1 | 8018 | 799 | 88.7 | globlastp |
| 4766 | LYD253 | poplar|gb170|BI127760_P1 | 8018 | 799 | 88.7 | globlastp |
| 4767 | LYD253 | cassava|09v1|CK644296_P1 | 8019 | 799 | 88.5 | globlastp |
| 4768 | LYD253 | coffea|10v1|DV663820_P1 | 8020 | 799 | 88.4 | globlastp |
| 4769 | LYD253 | monkeyflower|10v1|GR192346_P1 | 8021 | 799 | 88.2 | globlastp |
| 4770 | LYD253 | artemisia|10v1|EY074319_P1 | 8022 | 799 | 88.2 | globlastp |
| 4771 | LYD253 | coffea|gb157.2|DV663820_P1 | 8023 | 799 | 88.2 | globlastp |
| 4772 | LYD253 | cotton|gb164|BE055021_P1 | 8024 | 799 | 88.2 | globlastp |
| 4773 | LYD253 | lettuce|10v1|DW045608_P1 | 8025 | 799 | 88.2 | globlastp |
| 4774 | LYD253 | lettuce|gb157.2|DW047530_P1 | 8025 | 799 | 88.2 | globlastp |
| 4775 | LYD253 | tragopogon|10v1|SRR020205S0003248_P1 | 8026 | 799 | 87.9 | globlastp |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4776 | LYD253 | tragopogon\|10v1\|SRR020205S0000323_P1 | 8027 | 799 | 87.7 | globlastp |
| 4777 | LYD253 | cichorium\|gb171\|EH675611_P1 | 8028 | 799 | 87.7 | globlastp |
| 4778 | LYD253 | lettuce\|10v1\|CV700237_P1 | 8029 | 799 | 87.7 | globlastp |
| 4779 | LYD253 | lettuce\|gb157.2\|CV700063_P1 | 8029 | 799 | 87.7 | globlastp |
| 4780 | LYD253 | sunflower\|10v1\|CD850541_P1 | 8030 | 799 | 87.7 | globlastp |
| 4781 | LYD253 | sunflower\|gb162\|CD850541_P1 | 8030 | 799 | 87.7 | globlastp |
| 4782 | LYD253 | solanum_phureja\|09v1\|SPHBG133066_P1 | 8031 | 799 | 87.4 | globlastp |
| 4783 | LYD253 | potato\|10v1\|BF153387_P1 | 8031 | 799 | 87.4 | globlastp |
| 4784 | LYD253 | b_juncea\|gb164\|EVGN00836916260185_P1 | 8032 | 799 | 87.1 | globlastp |
| 4785 | LYD253 | potato\|gb157.2\|BF153387_P1 | 8033 | 799 | 87.1 | globlastp |
| 4786 | LYD253 | chestnut\|gb170\|SRR006295S0010680_P1 | 8034 | 799 | 86.9 | globlastp |
| 4787 | LYD253 | oak\|gb170\|DB996885_P1 | 8035 | 799 | 86.9 | globlastp |
| 4788 | LYD253 | oak\|10v1\|DB996885_P1 | 8036 | 799 | 86.7 | globlastp |
| 4789 | LYD253 | oak\|10v1\|FP027803_P1 | 8036 | 799 | 86.7 | globlastp |
| 4790 | LYD253 | tomato\|09v1\|BG133066_P1 | 8037 | 799 | 86.6 | globlastp |
| 4791 | LYD253 | potato\|gb157.2\|BF460135_P1 | 8038 | 799 | 86.6 | globlastp |
| 4792 | LYD253 | tomato\|gb164\|BG133066_P1 | 8037 | 799 | 86.6 | globlastp |
| 4793 | LYD253 | liriodendron\|gb166\|CK760215_P1 | 8039 | 799 | 85.8 | globlastp |
| 4794 | LYD253 | castorbean\|09v1\|EE255427_P1 | 8040 | 799 | 85.3 | globlastp |
| 4795 | LYD253 | ginger\|gb164\|DY352282_T1 | 8041 | 799 | 84.91 | glotblastn |
| 4796 | LYD253 | cynara\|gb167\|GE604483_P1 | 8042 | 799 | 84.9 | globlastp |
| 4797 | LYD253 | ginger\|gb164\|DY345055_T1 | 8043 | 799 | 84.89 | glotblastn |
| 4798 | LYD253 | ginger\|gb164\|DY345770_P1 | 8044 | 799 | 84.6 | globlastp |
| 4799 | LYD253 | cycas\|gb166\|CB088377_P1 | 8045 | 799 | 82.6 | globlastp |
| 4800 | LYD253 | spurge\|gb161\|BI946376_P1 | 8046 | 799 | 82.5 | globlastp |
| 4801 | LYD253 | zamia\|gb166\|CB095392_P1 | 8047 | 799 | 82.3 | globlastp |
| 4802 | LYD253 | dandelion\|10v1\|DR402520_T1 | 8048 | 799 | 82.26 | glotblastn |
| 4803 | LYD253 | papaya\|gb165\|EX229544_P1 | 8049 | 799 | 80.7 | globlastp |
| 4804 | LYD256 | canola\|10v1\|ES909931_P1 | 8050 | 800 | 99.5 | globlastp |
| 4805 | LYD256 | canola\|gb161\|ES909931_P1 | 8050 | 800 | 99.5 | globlastp |
| 4806 | LYD256 | radish\|gb164\|EW717326_T1 | 8051 | 800 | 95.66 | glotblastn |
| 4807 | LYD256 | canola\|10v1\|H74771_P1 | 8052 | 800 | 94.9 | globlastp |
| 4808 | LYD256 | canola\|gb161\|H74771_P1 | 8052 | 800 | 94.9 | globlastp |
| 4809 | LYD256 | b_rapa\|gb162\|EX018862_P1 | 8053 | 800 | 94.6 | globlastp |
| 4810 | LYD256 | radish\|gb164\|EX754811_T1 | 8054 | 800 | 93.11 | glotblastn |
| 4811 | LYD257 | canola\|gb161\|EG020033_P1 | 8055 | 801 | 98.2 | globlastp |
| 4812 | LYD257 | canola\|10v1\|EG020033_P1 | 8056 | 801 | 88.9 | globlastp |
| 4813 | LYD257 | arabidopsis_lyrata\|09v1\|JGIAL005370_P1 | 8057 | 801 | 81.4 | globlastp |
| 4814 | LYD260 | b_oleracea\|gb161\|EH413919_P1 | 8058 | 802 | 96.3 | globlastp |
| 4815 | LYD260 | b_rapa\|gb162\|EX030883_P1 | 8059 | 802 | 96.3 | globlastp |
| 4816 | LYD260 | canola\|10v1\|CX193902_P1 | 8060 | 802 | 94.8 | globlastp |
| 4817 | LYD260 | canola\|gb161\|CX193902_P1 | 8061 | 802 | 91.4 | globlastp |
| 4818 | LYD260 | canola\|10v1\|EE404267_T1 | 8062 | 802 | 81.43 | glotblastn |
| 4819 | LYD260 | canola\|gb161\|EV102306_T1 | 8062 | 802 | 81.43 | glotblastn |
| 4820 | LYD260 | arabidopsis_lyrata\|09v1\|JGIAL031069_P1 | 8063 | 802 | 80.2 | globlastp |
| 4821 | LYD261 | arabidopsis_lyrata\|09v1\|JGIAL010456_P1 | 8064 | 803 | 92.1 | globlastp |
| 4822 | LYD261 | arabidopsis\|10v1\|AT3G19170_P1 | 8065 | 803 | 91.7 | globlastp |
| 4823 | LYD261 | arabidopsis\|10v1\|AT1G49630_P1 | 8066 | 803 | 85.9 | globlastp |
| 4824 | LYD266 | radish\|gb164\|EV548537_T1 | 8067 | 805 | 87.8 | glotblastn |
| 4825 | LYD268 | b_rapa\|gb162\|BG543031_P1 | 8068 | 806 | 99.4 | globlastp |
| 4826 | LYD268 | canola\|10v1\|CD813357_P1 | 8069 | 806 | 98.6 | globlastp |
| 4827 | LYD268 | canola\|gb161\|CD813357_P1 | 8069 | 806 | 98.6 | globlastp |
| 4828 | LYD268 | radish\|gb164\|EV525074_P1 | 8070 | 806 | 91.8 | globlastp |
| 4829 | LYD268 | arabidopsis_lyrata\|09v1\|JGIAL000148_T1 | 8071 | 806 | 87.91 | glotblastn |
| 4830 | LYD268 | arabidopsis\|10v1\|AT1G02305_P1 | 8072 | 806 | 87.9 | globlastp |
| 4831 | LYD268 | thellungiella\|gb167\|DN778418_T1 | 8073 | 806 | 87.36 | glotblastn |
| 4832 | LYD268 | radish\|gb164\|EV540094_P1 | 8074 | 806 | 86.6 | globlastp |
| 4833 | LYD273 | arabidopsis_lyrata\|09v1\|JGIAL022080_P1 | 8075 | 807 | 93.9 | globlastp |
| 4834 | LYD273 | arabidopsis\|10v1\|AT5G23880_P1 | 8076 | 807 | 93.2 | globlastp |
| 4835 | LYD276 | arabidopsis_lyrata\|09v1\|JGIAL028325_T1 | 8077 | 808 | 92.77 | glotblastn |
| 4836 | LYD276 | arabidopsis\|10v1\|AT5G45380_P1 | 8078 | 808 | 90.9 | globlastp |
| 4837 | LYD276 | arabidopsis\|gb165\|AT5G45380_P1 | 8078 | 808 | 90.9 | globlastp |
| 4838 | LYD278 | b_rapa\|gb162\|AT000673_P1 | 8079 | 809 | 96.2 | globlastp |
| 4839 | LYD278 | canola\|10v1\|CD834587_P1 | 8080 | 809 | 96.2 | globlastp |
| 4840 | LYD278 | radish\|gb164\|EW716277_P1 | 8081 | 809 | 95.3 | globlastp |
| 4841 | LYD278 | arabidopsis\|10v1\|AT2G20560_P1 | 8082 | 809 | 94.4 | globlastp |
| 4842 | LYD278 | arabidopsis_lyrata\|09v1\|JGIAL012530_P1 | 8083 | 809 | 93.8 | globlastp |
| 4843 | LYD278 | arabidopsis_lyrata\|09v1\|JGIAL025225_P1 | 8084 | 809 | 84.9 | globlastp |
| 4844 | LYD278 | peanut\|10v1\|GO324054_P1 | 8085 | 809 | 80.5 | globlastp |
| 4845 | LYD279 | radish\|gb164\|EW723965_T1 | 8086 | 810 | 92.79 | glotblastn |

TABLE 28-continued

Homologous polynucleotides and polypeptides which can increase plant yield, seed yield, oil yield, oil content, growth rate, fiber yield, fiber quality, biomass, vigor, ABST and/or NUE of a plant

| Polynucl. SEQ ID NO: | Homolog to Gene Name | cluster name | Polypep. SEQ ID NO: | Homolog. To polypep. SEQ ID NO: | % global identity | Algor. |
|---|---|---|---|---|---|---|
| 4846 | LYD282 | canola\|10v1\|CD837360_P1 | 8087 | 811 | 98.7 | globlastp |
| 4847 | LYD282 | canola\|gb161\|CD837360_P1 | 8088 | 811 | 98.5 | globlastp |
| 4848 | LYD282 | arabidopsis\|10v1\|AT1G34060_P1 | 8089 | 811 | 81.5 | globlastp |
| 4849 | LYD288 | canola\|10v1\|CD824838_P1 | 8090 | 812 | 99.2 | globlastp |
| 4850 | LYD288 | canola\|gb161\|H74985_P1 | 8090 | 812 | 99.2 | globlastp |
| 4851 | LYD288 | b_rapa\|gb162\|AT001818_P1 | 8091 | 812 | 97.6 | globlastp |

Table 28: Provided are polynucleotides (Polynuc.) and polypeptides (Polypep.) which are homologous to the identified polynucleotides or polypeptides of Table 27.
Homol. = homologue;
Algor. = Algorithm;

Example 12

Gene Cloning and Generation of Binary Vectors for Plant Expression

To validate their role in improving oil content, plant yield, seed yield, oil to content, biomass, growth rate, fiber yield, fiber quality, ABST, NUE and/or vigor, selected genes are over-expressed in plants, as follows.

Cloning Strategy

Selected genes from those listed in Examples 10 and 11 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal conditions. Total RNA was extracted as described in "GENERAL EXPERIMENTAL AND BIOINFORMATICS METHODS" above. Production of cDNA and PCR amplification is performed using standard protocols described elsewhere (Sambrook J., E. F. Fritsch, and T. Maniatis. 1989. Molecular Cloning. A to Laboratory Manual., 2nd Ed. Cold Spring Harbor Laboratory Press, New York.) which are well known to those skilled in the art. PCR products are purified using PCR purification kit (Qiagen). In case where the entire coding sequence was not found, RACE kit from Invitrogen (RACE=R apid A ccess to cDNA E nds) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA was cloned, the genes were amplified by direct PCR on genomic DNA extracted from leaf tissue using the DNAeasy kit (Qiagen Cat. No. 69104).

Usually, 2 sets of primers are synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers were used.

To facilitate cloning of the cDNAs/genomic sequences, a 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers were designed such that the digested cDNA was inserted in the sense formation into the binary vector utilized for transformation.

Each digested PCR product was inserted into a high copy vector pBlue-script KS plasmid vector [pBlue-script KS plasmid vector, Hypertext Transfer Protocol://World Wide Web (dot) stratagene (dot) com/manuals/212205 (dot) pdf] or pUC19 (New England BioLabs Inc], or into plasmids originating from these vectors. In some cases the undigested PCR product was inserted into pCR-Blunt II-TOPO (Invitrogen). In case of the high copy vector originated from pBlue-script KS plasmid vector (pGXN), the PCR product was inserted in the high copy plasmid upstream to the NOS terminator (SEQ ID NO:8092) originated from pBI 101.3 binary vector (GenBank Accession No. U12640, nucleotides 4356 to 4693) and downstream to the 35S promoter.

Sequencing of the amplified PCR products was performed, using ABI 377 sequencer (Amersham Biosciences Inc). In some cases, after confirming the sequences of the cloned genes, the cloned cDNA accompanied/or not with the NOS terminator was introduced into a modified pGI binary vector containing the At6669 promoter or 35S promoter (SEQ ID NO:8094) via digestion with appropriate restriction endonucleases. In any case the insert was followed by single copy of the NOS terminator (SEQ ID NO:8092). The digested products and the linearized plasmid vector are ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors as shown in Table 29, below.

Figure 2:
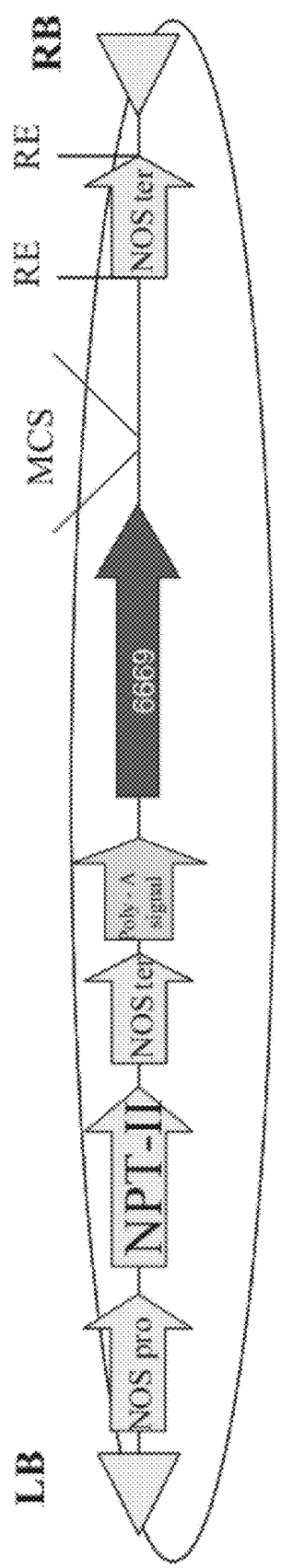
FIG. 2 is a schematic illustration of the modified pGI binary plasmid containing the new At6669 promoter (SEQ ID NO:8096) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.
Figure 3A:
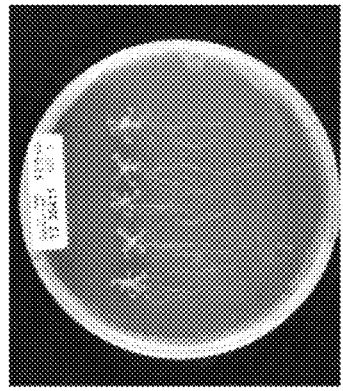
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
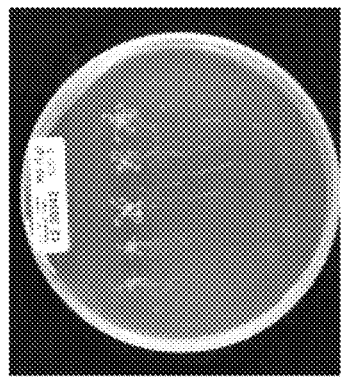
Figure 3E:
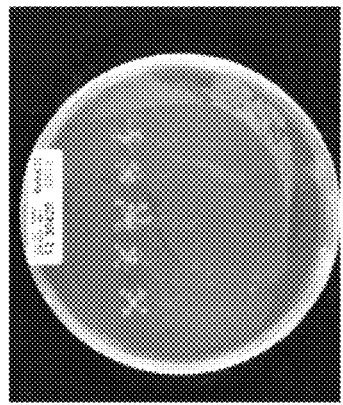
Figure 3B:
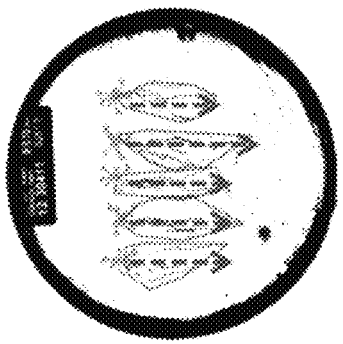
Figure 3D:
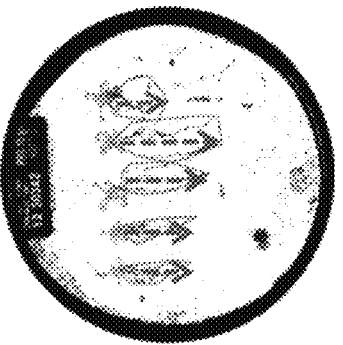
Figure 3F:
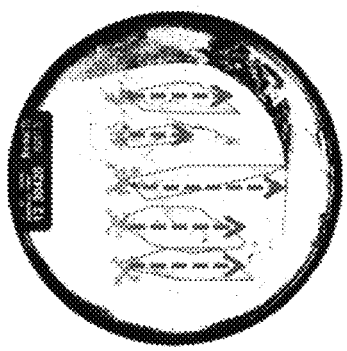
Figure 4:
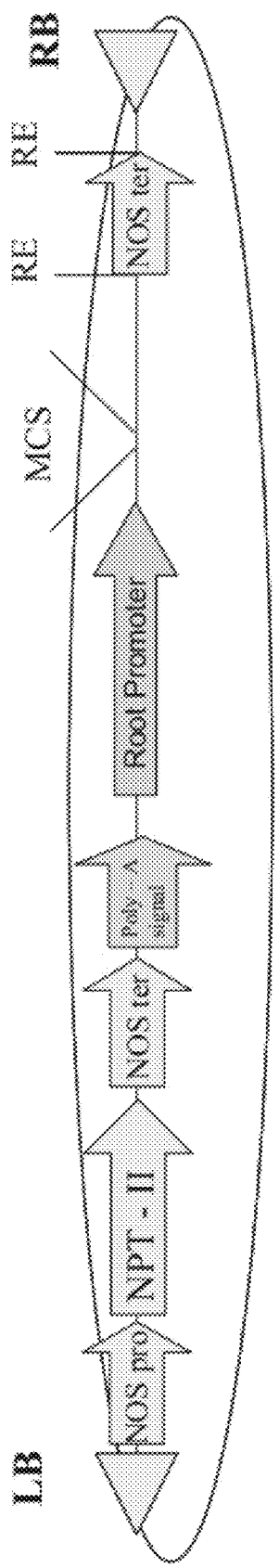
FIG. 4 is a schematic illustration of the modified pGI binary plasmid containing the Root Promoter (pQNa_RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS of the vector.

Several DNA sequences of the selected genes were synthesized by a commercial supplier GeneArt [Hypertext Transfer Protocol://World Wide Web (dot) geneart (dot) com/]. Synthetic DNA was designed in silico. Suitable restriction enzymes sites were added to the cloned sequences at the 5' end and at the 3' end to enable later cloning into the pQFNc (FIG. 2) binary vector downstream of the At6669 promoter (SEQ ID NOs: 8093 and 8096).

Binary vectors used for cloning: The plasmid pPI is constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) is similar to pPI, but the original gene in the backbone, the GUS gene, is replaced by the GUS-Intron gene followed by the NOS terminator (SEQ ID NO:8092) (Vancanneyt. G, et al MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO:8094].

Figure 12:
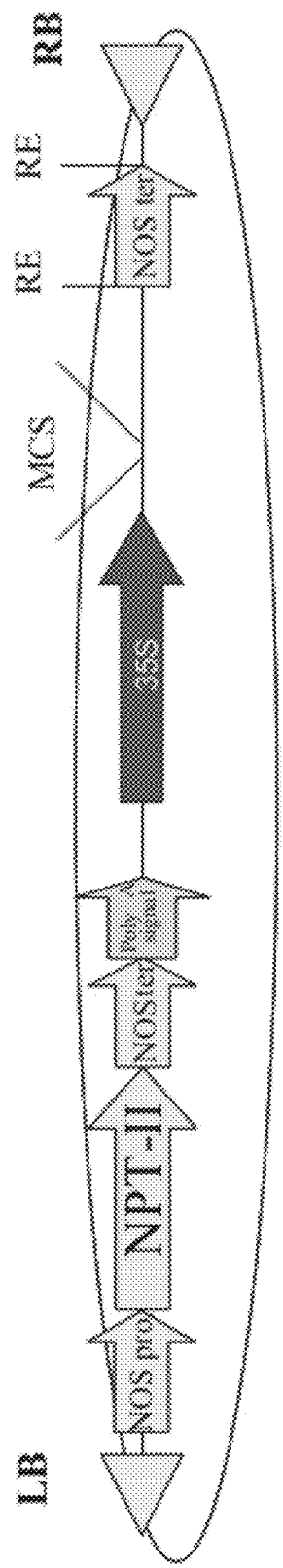
FIG. 12 is a schematic illustration of the modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO:8094). The isolated polynucleotide sequences of some embodiments of the invention were cloned into the MCS (Multiple cloning site) of the vector.

The modified pGI vector (pQXNc in FIG. 12; or pQFN and pQFNc in FIG. 2; or pQYN_6669 in FIG. 1) are modified versions of the pGI vector in which the cassette is inverted between the left and right borders so the gene and its corresponding promoter are close to the right border and the NPTII gene is close to the left border.

At6669, the *Arabidopsis thaliana* promoter sequence (SEQ ID NO:8096) is inserted in the modified pGI binary vector, upstream to the cloned genes, followed by DNA ligation and binary plasmid extraction from positive *E. coli* colonies, as described above.

Colonies are analyzed by PCR using the primers covering the insert which are designed to span the introduced promoter and gene. Positive plasmids are identified, isolated and sequenced.

Genes were cloned by the present inventors are provided in Table 29 below.

TABLE 29

Genes cloned in High copy number plasmids

| Gene name | High copy plasmid | Organism | Primers used SEQ ID Nos: | Polynuc. SEQ ID NO: | Polypep. SEQ ID NO: |
|---|---|---|---|---|---|
| LYD1 | pUC19c | ARABIDOPSIS *Arabidopsis thaliana* Columbia wt | 8100, 8100, 8390, 8534 | 285 | 488 |
| LYD10 | Topo B | ARABIDOPSIS *Arabidopsis thaliana* Columbia wt | 8101, 8245, 8391, 8535 | 293 | 496 |
| LYD101 | pUC19c | ARABIDOPSIS *Arabidopsis thaliana* Columbia wt | 8102, 8246, 8392, 8536 | 362 | 568 |
| LYD102 | pUC19c | ARABIDOPSIS *Arabidopsis thaliana* Columbia wt | 8103, 8247, 8393, 8537 | 363 | 569 |
| LYD103 | Topo B | ARABIDOPSIS *Arabidopsis thaliana* Columbia wt | 8104, 8248, 8394, 8538 | 364 | 570 |
| LYD104 | pUC19c | ARABIDOPSIS *Arabidopsis thaliana* Columbia wt | 8105, 8249, 8395, 8395 | 365 | 571 |
| LYD105 | pUC19c | ARABIDOPSIS *Arabidopsis thaliana* Columbia wt | 8106, 8250, 8396, 8539 | 366 | 766 |
| LYD106 | pUC19c | ARABIDOPSIS *Arabidopsis thaliana* Columbia wt | 8107, 8107, 8397, 8540 | 367 | 573 |
| LYD107 | Topo B | ARABIDOPSIS *Arabidopsis thaliana* Columbia wt | 8108, 8251, 8398, 8541 | 368 | 574 |
| LYD108 | Topo B | CANOLA *Brassica napus* ND | 8109,, 8399 | 369 | 575 |
| LYD109 | Topo B | MUSTARD *Brassica juncea* ND | 8252, 8542 | 370 | 767 |
| LYD11 | pUC19c | ARABIDOPSIS *Arabidopsis thaliana* Columbia wt | 8110, 8253, 8400, 8543 | 294 | 497 |
| LYD110 | pUC19c | MUSTARD *Brassica juncea* ND | 8254, 8544 | 371 | 768 |
| LYD112 | Topo B | MUSTARD *Brassica juncea* ND | 8255, 8545 | 486 | — |

TABLE 29-continued

| Genes cloned in High copy number plasmids | | | | | |
|---|---|---|---|---|---|
| Gene name | High copy plasmid | Organism | Primers used SEQ ID Nos: | Polynuc. SEQ ID NO: | Polypep. SEQ ID NO: |
| LYD113 | pUC19c | MUSTARD *Brassica juncea* ND | 8111, 8256, 8401, 8546 | 372 | 769 |
| LYD114 | Topo B | MUSTARD *Brassica juncea* ND | 8257, 8402 | 373 | 770 |
| LYD115 | | | | 212 | — |
| LYD117 | pUC19c | MUSTARD *Brassica juncea* ND | 8258, 8547 | 374 | 580 |
| LYD118 | pUC19c | MUSTARD *Brassica juncea* ND | 8112, 8112, 8403, 8548 | 375 | 771 |
| LYD119 | Topo B | MUSTARD *Brassica juncea* ND | 8113, 8259, 8404, 8549 | 376 | 772 |
| LYD12 | Topo B | ARABIDOPSIS *Arabidopsis thaliana* Columbia wt | 8114, 8260, 8405, 8550 | 295 | 498 |
| LYD120 | Topo B | MUSTARD *Brassica juncea* ND | 8115, 8115, 8406, 8551 | 377 | 583 |
| LYD122 | Topo B | MUSTARD *Brassica juncea* ND | 8261, 8552 | 378 | 584 |
| LYD123 | pUC19c | MUSTARD *Brassica juncea* ND | 8262, 8553 | 379 | 773 |
| LYD124_H7 | | | | 479 | 691 |
| LYD125 | pUC19c | MEDICAGO *Medicago truncatula* ND | 8116, 8263, 8407, 8554 | 380 | 774 |
| LYD126 | Topo B | MEDICAGO *Medicago truncatula* ND | 8117, 8408 | 381 | 775 |
| LYD127 | pUC19c | SOYBEAN *Glycine max* 40-219 | 8118, 8264, 8409, 8555 | 382 | 776 |
| LYD128_H1 | | | | 480 | 692 |
| LYD129 | Topo B | SOYBEAN *Glycine max* 40-219 | 8119, 8265, 8119, 8556 | 383 | 591 |
| LYD13 | Topo B | ARABIDOPSIS *Arabidopsis thaliana* Columbia wt | 8120, 8266, 8410, 8410 | 296 | 499 |
| LYD132 | pUC19c | SOYBEAN *Glycine max* ND | 8121, 8267, 8411, 8557 | 384 | 592 |
| LYD133 | Topo B | SOYBEAN *Glycine max* 40-219 | 8268, 8558 | 385 | 593 |
| LYD134 | pUC19c | SOYBEAN *Glycine max* 40-219 | 8269, 8559 | 386 | 594 |
| LYD136 | pUC19c | SOYBEAN *Glycine max* 40-219 | 8122, 8270, 8412, 8560 | 387 | 595 |
| LYD139 | Topo B | SOYBEAN *Glycine max* 40-219 | 8123, 8123, 8413, 8561 | 388 | 596 |
| LYD14 | Topo B | ARABIDOPSIS *Arabidopsis thaliana* Columbia wt | 8124, 8271, 8414, 8562 | 297 | 500 |
| LYD140 | pUC19c | SOYBEAN *Glycine max* 40-219 | 8125, 8272, 8415, 8415 | 389 | 597 |
| LYD142 | pUC19c | TOMATO *Lycopersicum esculentum* M82 | 8126, 8126, 8416, 8416 | 390 | 598 |

TABLE 29-continued

| | | Genes cloned in High copy number plasmids | | | |
|---|---|---|---|---|---|
| Gene name | High copy plasmid | Organism | Primers used SEQ ID Nos: | Polynuc. SEQ ID NO: | Polypep. SEQ ID NO: |
| LYD144 | Topo B | TOMATO *Lycopersicum esculentum* M82 | 8127, 8273, 8417, 8417 | 391 | 777 |
| LYD146 | pUC19c | TOMATO *Lycopersicum esculentum* M82 | 8128, 8274, 8418, 8563 | 392 | 600 |
| LYD148 | pUC19c | SORGHUM *Sorghum bicolor* ND | 8129, 8419 | 393 | 601 |
| LYD149 | Topo B | ARABIDOPSIS *Arabidopsis thaliana* Columbia wt | 8130, 8275, 8420, 8564 | 394 | 778 |
| LYD150 | Topo B | ARABIDOPSIS *Arabidopsis thaliana* Columbia wt | 8131, 8276, 8131, 8565 | 395 | 603 |
| LYD152 | | | | 396 | 604 |
| LYD153 | pUC19c | ARABIDOPSIS *Arabidopsis thaliana* Columbia wt | 8132, 8277, 8421, 8566 | 397 | 779 |
| LYD156 | Topo B | TOMATO *Lycopersicum esculentum* M82 | 8133, 8278, 8422, 8567 | 398 | 606 |
| LYD157 | pUC19c | TOMATO *Lycopersicum esculentum* M82 | 8279, 8568 | 399 | 607 |
| LYD158 | pUC19c | TOMATO *Lycopersicum esculentum* M82 | 8134, 8280, 8423, 8569 | 400 | 608 |
| LYD159 | pUC19c | MUSTARD *Brassica juncea* ND | 8135, 8135, 8424, 8570 | 401 | 780 |
| LYD176 | pUC19c | MUSTARD *Brassica juncea* ND | 8136,, 8425 | 407 | 783 |
| LYD177 | pUC19c | MUSTARD *Brassica juncea* ND | 8281, 8571 | 408 | 616 |
| LYD178 | pUC19c | MUSTARD *Brassica juncea* ND | 8282, 8572 | 409 | 617 |
| LYD18 | pUC19c | ARABIDOPSIS *Arabidopsis thaliana* Columbia wt | 8137, 8283, 8426, 8573 | 299 | 751 |
| LYD180 | Topo B | MUSTARD *Brassica juncea* ND | 8284, 8574 | 410 | 618 |
| LYD184 | Topo B | MUSTARD *Brassica juncea* ND | 8138, 8285, 8427, 8575 | 411 | 619 |
| LYD185 | | | | 412 | 620 |
| LYD186 | Topo B | MUSTARD *Brassica juncea* ND | 8139, 8286, 8428, 8576 | 413 | 784 |
| LYD187 | | | | 414 | 622 |
| LYD188 | Topo B | MUSTARD *Brassica juncea* ND | 8140, 8429 | 415 | 785 |
| LYD190 | pUC19c | MUSTARD *Brassica juncea* ND | 8287, 8577 | 416 | 786 |
| LYD192 | | | | 138 | 625 |
| LYD193 | Topo B | MUSTARD *Brassica juncea* ND | 8288, 8578 | 417 | 787 |
| LYD194 | pUC19c | MUSTARD *Brassica juncea* ND | 8141, 8289, 8430, 8430 | 418 | 627 |
| LYD195 | Topo B | TOMATO *Lycopersicum esculentum* M82 | 8142, 8142, 8431, 8579 | 419 | 628 |

TABLE 29-continued

| Genes cloned in High copy number plasmids | | | | | |
|---|---|---|---|---|---|
| Gene name | High copy plasmid | Organism | Primers used SEQ ID Nos: | Polynuc. SEQ ID NO: | Polypep. SEQ ID NO: |
| LYD196 | Topo B | MAIZE Zea mays L. Pioneer 30G54 | 8290, 8580 | 420 | 788 |
| LYD197 | Topo B | ARABIDOPSIS Arabidopsis thaliana Columbia wt | 8291, 8581 | 421 | 630 |
| LYD2 | pUC19c | ARABIDOPSIS Arabidopsis thaliana Columbia wt | 8143, 8292, 8432, 8582 | 286 | 489 |
| LYD20 | pUC19c | ARABIDOPSIS Arabidopsis thaliana Columbia wt | 8144, 8293, 8433, 8433 | 300 | 503 |
| LYD200 | Topo B | MUSTARD Brassica juncea ND | 8145, 8294, 8434, 8583 | 422 | 789 |
| LYD201 | pUC19c | MUSTARD Brassica juncea ND | 8146, 8295, 8435, 8584 | 423 | 632 |
| LYD202 | pUC19c | MUSTARD Brassica juncea ND | 8147, 8147, 8436, 8436 | 424 | 790 |
| LYD204 | pUC19c | MUSTARD Brassica juncea ND | 8296, 8585 | 425 | 791 |
| LYD206 | Topo B | MUSTARD Brassica juncea ND | 8148, 8148, 8437, 8586 | 426 | 635 |
| LYD208 | pUC19c | MUSTARD Brassica juncea ND | 8149, 8149, 8438, 8587 | 427 | 792 |
| LYD209 | Topo B | MUSTARD Brassica juncea ND | 8150, 8150, 8439, 8588 | 428 | 637 |
| LYD21 | Topo B | ARABIDOPSIS Arabidopsis thaliana Columbia wt | 8151, 8297, 8440, 8589 | 301 | 504 |
| LYD211 | Topo B | SORGHUM Sorghum bicolor ND | 8152,, 8441 | 429 | 638 |
| LYD212 | Topo B | ARABIDOPSIS Arabidopsis thaliana Columbia wt | 8153, 8298, 8442, 8590 | 430 | 639 |
| LYD213 | pUC19c | ARABIDOPSIS Arabidopsis thaliana Columbia wt | 8154, 8299, 8443, 8591 | 431 | 640 |
| LYD214 | Topo B | ARABIDOPSIS Arabidopsis thaliana Columbia wt | 8155, 8155, 8444, 8592 | 432 | 641 |
| LYD215 | pUC19c | ARABIDOPSIS Arabidopsis thaliana Columbia wt | 8156, 8300, 8445, 8593 | 433 | 642 |
| LYD216 | Topo B | ARABIDOPSIS Arabidopsis thaliana Columbia wt | 8301, 8594 | 434 | 793 |
| LYD217 | pUC19c | ARABIDOPSIS Arabidopsis thaliana Columbia wt | 8157, 8302, 8446, 8446 | 435 | 644 |
| LYD219 | Topo B | ARABIDOPSIS Arabidopsis thaliana Columbia wt | 8303, 8595 | 436 | 794 |

TABLE 29-continued

| Genes cloned in High copy number plasmids | | | | | |
|---|---|---|---|---|---|
| Gene name | High copy plasmid | Organism | Primers used SEQ ID Nos: | Polynuc. SEQ ID NO: | Polypep. SEQ ID NO: |
| LYD22 | pUC19c | ARABIDOPSIS *Arabidopsis thaliana* Columbia wt | 8158, 8158, 8447, 8596 | 302 | 505 |
| LYD220 | Topo B | ARABIDOPSIS *Arabidopsis thaliana* Columbia wt | 8159, 8159, 8448, 8597 | 437 | 646 |
| LYD221 | pUC19c | ARABIDOPSIS *Arabidopsis thaliana* Columbia wt | 8304, 8598 | 438 | 647 |
| LYD222 | Topo B | ARABIDOPSIS *Arabidopsis thaliana* Columbia wt | 8160, 8449 | 439 | 648 |
| LYD223 | pUC19c | ARABIDOPSIS *Arabidopsis thaliana* Columbia wt | 8161, 8305, 8450, 8599 | 440 | 649 |
| LYD224 | pUC19c | ARABIDOPSIS *Arabidopsis thaliana* Columbia wt | 8162, 8162, 8451, 8600 | 441 | 650 |
| LYD225 | pUC19c | BARLEY *Hordeum vulgare* L. Manit | 8306, 8601 | 442 | 795 |
| LYD227 | Topo B | SORGHUM *Sorghum bicolor* ND | 8163, 8163, 8452, 8602 | 443 | 652 |
| LYD228 | pUC19c | SORGHUM *Sorghum bicolor* ND | 8164, 8453 | 444 | 653 |
| LYD229 | Topo B | SORGHUM *Sorghum bicolor* ND | 8165, 8454 | 445 | 654 |
| LYD23 | Topo B | ARABIDOPSIS *Arabidopsis thaliana* Columbia wt | 8166, 8307, 8455, 8603 | 303 | 506 |
| LYD230 | Topo B | SORGHUM *Sorghum bicolor* ND | 8167, 8456 | 446 | 655 |
| LYD231 | pUC19c | SORGHUM *Sorghum bicolor* ND | 8168, 8457 | 447 | 656 |
| LYD232 | pUC19c | TOMATO *Lycopersicum esculentum* M82 | 8169, 8308, 8458, 8604 | 448 | 657 |
| LYD233 | Topo B | TOMATO *Lycopersicum esculentum* M82 | 8170, 8309, 8459, 8605 | 449 | 658 |
| LYD234 | pUC19c | TOMATO *Lycopersicum esculentum* M82 | 8171, 8310, 8460, 8606 | 450 | 659 |
| LYD235 | Topo B | TOMATO *Lycopersicum esculentum* M82 | 8172, 8172, 8461, 8607 | 451 | 660 |
| LYD236 | pUC19c | TOMATO *Lycopersicum esculentum* M82 | 8173, 8311, 8462, 8608 | 452 | 661 |
| LYD238 | pUC19c | BARLEY *Hordeum vulgare* L. Manit | 8174,, 8463 | 453 | 796 |
| LYD240 | pUC19c | BARLEY *Hordeum vulgare* L. ND | 8175,, 8464 | 454 | 663 |
| LYD244 | pUC19c | TOMATO *Lycopersicum* ND ND | 8176, 8312, 8465, 8609 | 455 | 664 |
| LYD245 | pUC19c | ARABIDOPSIS *Arabidopsis thaliana* Columbia wt | 8177, 8313, 8466, 8610 | 456 | 797 |

TABLE 29-continued

| Genes cloned in High copy number plasmids | | | | | |
|---|---|---|---|---|---|
| Gene name | High copy plasmid | Organism | Primers used SEQ ID Nos: | Polynuc. SEQ ID NO: | Polypep. SEQ ID NO: |
| LYD246 | Topo B | ARABIDOPSIS *Arabidopsis thaliana* Columbia wt | 8314, 8611 | 457 | 666 |
| LYD248 | Topo B | MEDICAGO *Medicago truncatula* ND | 8178, 8467 | 264 | 737 |
| LYD25 | pUC19c | CANOLA *Brassica napus* ND | 8179, 8315, 8468, 8612 | 304 | 752 |
| LYD250 | pUC19c | MUSTARD *Brassica juncea* ND | 8316, 8613 | 458 | 668 |
| LYD252 | pUC19c | MUSTARD *Brassica juncea* ND | 8180, 8317, 8469, 8614 | 459 | 798 |
| LYD253 | Topo B | MUSTARD *Brassica juncea* ND | 8181, 8470 | 460 | 799 |
| LYD256 | Topo B | MUSTARD *Brassica juncea* ND | 8318, 8615 | 461 | 800 |
| LYD257 | Topo B | MUSTARD *Brassica juncea* ND | 8319, 8616 | 462 | 801 |
| LYD259 | | | | 213 | — |
| LYD26 | pUC19c | MEDICAGO *Medicago truncatula* ND | 8182, 8320, 8471, 8617 | 305 | 753 |
| LYD260 | Topo B | MUSTARD *Brassica juncea* ND | 8183, 8321, 8472, 8618 | 463 | 802 |
| LYD261 | Topo B | MUSTARD *Brassica juncea* ND | 8322, 8619 | 464 | 803 |
| LYD262 | | | | 214 | — |
| LYD264 | Topo B | MUSTARD *Brassica juncea* ND | 8323, 8620 | 465 | 804 |
| LYD265 | | | | 215 | — |
| LYD266 | Topo B | MUSTARD *Brassica juncea* ND | 8184, 8324, 8473, 8621 | 466 | 805 |
| LYD267_H0 | Topo B | ARABIDOPSIS *Arabidopsis thaliana* Columbia wt | 8185, 8325, 8474, 8622 | 481 | 813 |
| LYD268 | Topo B | MUSTARD *Brassica juncea* ND | 8326, 8623 | 467 | 806 |
| LYD269 | | | | 216 | — |
| LYD27 | pUC19c | MEDICAGO *Medicago truncatula* ND | 8186, 8327, 8475, 8475 | 306 | 754 |
| LYD270 | Topo B | MUSTARD *Brassica juncea* | 8328, 8624 | 487 | — |
| LYD271_H0 | | | | 482 | 694 |
| LYD273 | pUC19c | MUSTARD *Brassica juncea* ND | 8187, 8329, 8476, 8476 | 468 | 807 |
| LYD275 | pUC19c | MUSTARD *Brassica juncea* ND | 8188, 8330, 8477, 8625 | 469 | 681 |
| LYD276 | pUC19c | MUSTARD *Brassica juncea* ND | 8189, 8478 | 470 | 808 |
| LYD278 | pUC19c | MUSTARD *Brassica juncea* ND | 8190, 8331, 8479, 8626 | 471 | 809 |
| LYD279 | pUC19c | MUSTARD *Brassica juncea* ND | 8191, 8191, 8480, 8627 | 472 | 810 |

TABLE 29-continued

| Genes cloned in High copy number plasmids |||||||
|---|---|---|---|---|---|
| Gene name | High copy plasmid | Organism | Primers used SEQ ID Nos: | Polynuc. SEQ ID NO: | Polypep. SEQ ID NO: |
| LYD28 | pUC19c | MEDICAGO *Medicago truncatula* ND | 8192, 8332, 8481, 8628 | 307 | 755 |
| LYD282 | Topo B | MUSTARD *Brassica juncea* ND | 8193, 8333, 8482, 8629 | 473 | 811 |
| LYD283 | | | | 474 | 686 |
| LYD285 | pUC19c | MUSTARD *Brassica juncea* ND | 8194, 8334, 8483, 8483 | 475 | 687 |
| LYD286 | | | | 476 | 688 |
| LYD287 | pUC19c | ARABIDOPSIS *Arabidopsis thaliana* Columbia wt | 8195, 8335, 8484, 8630 | 477 | 689 |
| LYD288 | pUC19c | MUSTARD *Brassica juncea* ND | 8336, 8631 | 478 | 812 |
| LYD29 | | | | 230 | 707 |
| LYD3 | Topo B | ARABIDOPSIS *Arabidopsis thaliana* Columbia wt | 8196, 8196, 8485, 8632 | 287 | 490 |
| LYD33 | pUC19c | TOMATO *Lycopersicum esculentum* M82 | 8197, 8337, 8486, 8633 | 308 | 512 |
| LYD34 | Topo B | TOMATO *Lycopersicum esculentum* M82 | 8198, 8338, 8487, 8634 | 309 | 513 |
| LYD35 | pUC19c | TOMATO *Lycopersicum esculentum* M82 | 8339, 8635 | 310 | 756 |
| LYD36 | Topo B | TOMATO *Lycopersicum esculentum* M82 | 8199, 8340, 8488, 8636 | 311 | 515 |
| LYD37 | pUC19c | TOMATO *Lycopersicum esculentum* M82 | 8200, 8341, 8489, 8489 | 312 | 516 |
| LYD38 | pUC19c | TOMATO *Lycopersicum esculentum* M82 | 8201, 8342, 8490, 8637 | 313 | 517 |
| LYD4 | pUC19c | ARABIDOPSIS *Arabidopsis thaliana* Columbia wt | 8202, 8343, 8491, 8638 | 288 | 491 |
| LYD40 | pUC19c | TOMATO *Lycopersicum esculentum* M82 | 8203, 8344, 8492, 8639 | 314 | 757 |
| LYD41 | pUC19c | TOMATO *Lycopersicum esculentum* M82 | 8345, 8640 | 315 | 519 |
| LYD42 | pUC19c | TOMATO *Lycopersicum esculentum* M82 | 8204, 8204, 8493, 8641 | 316 | 520 |
| LYD43 | pUC19c | TOMATO *Lycopersicum esculentum* M82 | 8346, 8642 | 317 | 521 |
| LYD44 | Topo B | TOMATO *Lycopersicum esculentum* M82 | 8205, 8347, 8494, 8643 | 318 | 522 |
| LYD45 | pUC19c | TOMATO *Lycopersicum esculentum* M82 | 8206, 8348, 8495, 8644 | 319 | 523 |
| LYD47 | Topo B | TOMATO *Lycopersicum esculentum* M82 | 8349, 8645 | 320 | 758 |
| LYD48 | Topo B | TOMATO *Lycopersicum esculentum* M82 | 8207, 8350, 8496, 8646 | 321 | 759 |
| LYD49 | pUC19c | TOMATO *Lycopersicum esculentum* M82 | 8208, 8351, 8497, 8647 | 322 | 526 |

TABLE 29-continued

| | Genes cloned in High copy number plasmids | | | | |
|---|---|---|---|---|---|
| Gene name | High copy plasmid | Organism | Primers used SEQ ID Nos: | Polynuc. SEQ ID NO: | Polypep. SEQ ID NO: |
| LYD5 | Topo B | ARABIDOPSIS *Arabidopsis thaliana* Columbia wt | 8352, 8648 | 289 | 492 |
| LYD50 | pUC19c | TOMATO *Lycopersicum esculentum* M82 | 8353, 8649 | 323 | 527 |
| LYD51 | Topo B | TOMATO *Lycopersicum esculentum* M82 | 8209, 8354, 8498, 8650 | 324 | 528 |
| LYD52 | | | | 42 | 529 |
| LYD53 | Topo B | TOMATO *Lycopersicum esculentum* M82 | 8210, 8355, 8499, 8651 | 325 | 530 |
| LYD55 | pUC19c | TOMATO *Lycopersicum esculentum* M82 | 8356, 8652 | 326 | 531 |
| LYD57 | pUC19c | TOMATO *Lycopersicum esculentum* M82 | 8357, 8653 | 327 | 532 |
| LYD58 | Topo B | TOMATO *Lycopersicum esculentum* M82 | 8358, 8654 | 328 | 533 |
| LYD58_GA | | | | #N/A | #N/A |
| LYD59 | pUC19c | TOMATO *Lycopersicum esculentum* M82 | 8211, 8359, 8500, 8655 | 329 | 534 |
| LYD6 | pUC19c | ARABIDOPSIS *Arabidopsis thaliana* Columbia wt | 8212, 8360, 8501, 8656 | 290 | 493 |
| LYD61 | pUC19c | TOMATO *Lycopersicum esculentum* M82 | 8213, 8213, 8502, 8657 | 330 | 535 |
| LYD62 | pUC19c | TOMATO *Lycopersicum esculentum* M82 | 8214, 8214, 8503, 8658 | 331 | 536 |
| LYD63 | Topo B | TOMATO *Lycopersicum esculentum* M82 | 8361, 8659 | 332 | 760 |
| LYD65 | Topo B | TOMATO *Lycopersicum esculentum* M82 | 8215, 8215, 8504, 8660 | 333 | 761 |
| LYD66 | pUC19c | TOMATO *Lycopersicum esculentum* M82 | 8216, 8362, 8505, 8661 | 334 | 539 |
| LYD67 | Topo B | TOMATO *Lycopersicum esculentum* M82 | 8217, 8363, 8506, 8662 | 335 | 540 |
| LYD69 | pUC19c | ARABIDOPSIS *Arabidopsis thaliana* Columbia wt | 8364, 8663 | 336 | 541 |
| LYD7 | pUC19c | ARABIDOPSIS *Arabidopsis thaliana* Columbia wt | 8365, 8664 | 291 | 494 |
| LYD70 | Topo B | CANOLA *Brassica napus* ND | 8218, 8507 | 337 | 542 |
| LYD71 | pUC19c | CANOLA *Brassica napus* Westar | 8366, 8665 | 338 | 762 |
| LYD72 | Topo B | MEDICAGO *Medicago truncatula* ND | 8219, 8508 | 339 | 763 |
| LYD73 | Topo B | TOMATO *Lycopersicum esculentum* M82 | 8220, 8220, 8509, 8666 | 340 | 545 |
| LYD74 | pUC19c | TOMATO *Lycopersicum esculentum* M82 | 8367, 8667 | 341 | 546 |

TABLE 29-continued

Genes cloned in High copy number plasmids

| Gene name | High copy plasmid | Organism | Primers used SEQ ID Nos: | Polynuc. SEQ ID NO: | Polypep. SEQ ID NO: |
|---|---|---|---|---|---|
| LYD75 | pUC19c | TOMATO *Lycopersicum esculentum* M82 | 8221, 8368, 8510, 8668 | 342 | 547 |
| LYD76 | pUC19c | TOMATO *Lycopersicum esculentum* M82 | 8222, 8222, 8511, 8669 | 343 | 548 |
| LYD78 | pUC19d | SOYBEAN *Glycine max* 40-219 | 8223, 8369, 8512, 8670 | 344 | 549 |
| LYD79 | pUC19c | SOYBEAN *Glycine max* 40-219 | 8370, 8671 | 345 | 550 |
| LYD80 | Topo B | ARABIDOPSIS *Arabidopsis thaliana* Columbia wt | 8371, 8672 | 346 | 551 |
| LYD81 | pUC19c | MEDICAGO *Medicago truncatula* ND | 8224, 8372, 8513, 8673 | 347 | 764 |
| LYD82 | Topo B | TOMATO *Lycopersicum esculentum* M82 | 8225, 8514 | 348 | 553 |
| LYD84 | not available | ARABIDOPSIS *Arabidopsis thaliana* | 8226, 8373, 8515, 8674 | 349 | 554 |
| LYD85 | pUC19c | ARABIDOPSIS *Arabidopsis thaliana* Columbia wt | 8374, 8675 | 350 | 555 |
| LYD86 | pUC19c | ARABIDOPSIS *Arabidopsis thaliana* Columbia wt | 8227, 8516 | 351 | 556 |
| LYD87 | pUC19c | TOMATO *Lycopersicum esculentum* M82 | 8228, 8375, 8517, 8676 | 352 | 557 |
| LYD88 | Topo B | ARABIDOPSIS *Arabidopsis thaliana* Columbia wt | 8229, 8376, 8518, 8677 | 353 | 765 |
| LYD89 | | | | 72 | 559 |
| LYD9 | Topo B | ARABIDOPSIS *Arabidopsis thaliana* Columbia wt | 8230, 8377, 8519, 8678 | 292 | 495 |
| LYD90 | Topo B | ARABIDOPSIS *Arabidopsis thaliana* Columbia wt | 8231, 8378, 8520, 8520 | 354 | 560 |
| LYD91 | pUC19c | TOMATO *Lycopersicum esculentum* M82 | 8379, 8679 | 355 | 561 |
| LYD92 | pUC19c | ARABIDOPSIS *Arabidopsis thaliana* Columbia wt | 8232, 8380, 8521, 8680 | 356 | 562 |
| LYD94 | pUC19c | ARABIDOPSIS *Arabidopsis thaliana* Columbia wt | 8233, 8381, 8522, 8681 | 357 | 563 |
| LYD95 | pUC19c | ARABIDOPSIS *Arabidopsis thaliana* Columbia wt | 8234, 8234, 8523, 8682 | 358 | 564 |
| LYD96 | pUC19c | ARABIDOPSIS *Arabidopsis thaliana* Columbia wt | 8235, 8382, 8524, 8683 | 359 | 565 |
| LYD97 | pUC19c | ARABIDOPSIS *Arabidopsis thaliana* Columbia wt | 8236, 8383, 8525, 8525 | 360 | 566 |

TABLE 29-continued

Genes cloned in High copy number plasmids

| Gene name | High copy plasmid | Organism | Primers used SEQ ID Nos: | Polynuc. SEQ ID NO: | Polypep. SEQ ID NO: |
|---|---|---|---|---|---|
| LYD99 | Topo B | ARABIDOPSIS Arabidopsis thaliana Columbia wt | 8237, 8384, 8526, 8684 | 361 | 567 |
| LYM104 | pKS(Pks_J) | RICE Oryza sativa L. ND | 8238, 8385, 8527, 8685 | 484 | 696 |
| LYM275 | pGXN (pKG + Nos + 35S) | BARLEY Hordeum vulgare L. Manit | 8239, 8528 | 210 | 697 |
| LYD16 | Topo B | ARABIDOPSIS Arabidopsis thaliana Columbia wt | 8240, 8386, 8529, 8686 | 298 | 501 |
| LYD166 | Topo B | MUSTARD Brassica juncea ND | 8241, 8387, 8530, 8687 | 402 | 781 |
| LYD167 | Topo B | MUSTARD Brassica juncea ND | 8242, 8242, 8531, 8688 | 403 | 611 |
| LYD172 | pUC19c | MUSTARD Brassica juncea ND | 8243, 8388, 8532, 8532 | 404 | 782 |
| LYD173 | pUC19c | MUSTARD Brassica juncea ND | 8244, 8244, 8533, 8689 | 405 | 613 |
| LYD174 | pUC19c | MUSTARD Brassica juncea ND | 8389, 8389 | 406 | 614 |

Table 29.

Example 13

Production of Transgenic Arabidopsis Plants Expressing the Identified Polynucleotides of Some Embodiments of the Invention Experimental Methods Production of *agrobacterium tumefaciens* cells harbouring the binary vectors according to some embodiments of the invention—Each of the binary vectors described in Example 12 above were used to transform *Agrobacterium* cells. Two additional binary constructs, having only the At6669 or the 35S promoter or no additional promoter were used as negative controls.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Abrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention were properly introduced to the *Agrobacterium* cells.

Preparation of *Arabidopsis* plants for transformation—*Arabidopsis thaliana* var *Columbia* ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues are the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Preparation of the *agrobacterium* carrying the binary vectors to transformation into *Arabidopsis* plants—Single colonies of *Agrobacterium* carrying the binary vectors harboring the genes of some embodiments of the invention were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contains half-strength (2.15 g/L) Murashige-Skoog (Duchefa); 0.044 04 benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of *Arabidopsis* plants with the *agrobacterium*—Transformation of $T_0$ plants was performed by inverting each plant into an *Agrobacterium* suspension such that the above ground plant tissue is submerged for 3-5 seconds. Each inoculated $T_0$ plant was immediately placed in a plastic tray, then covered with clear plastic dome to maintain humidity and is kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

Generation of T1 and T2 transgenic plants—For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ Arabidopsis plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 14

Evaluating Transgenic Arabidopsis NUE Under Low or Normal Nitrogen Conditions Using In Vitro Assays (Tissue Culture, T2 and T1 plants)

Assay 1: Plant Growth Under Low and Favorable Nitrogen Concentration Levels

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XIV, V (described above) and XV.

Relative growth rate of leaf area=Regression coefficient of leaf area along time course.    Formula XIV Relative growth rate of root length=Regression coefficient of root length along time course.    Formula XV At the end of the experiment, plantlets were removed from the media and weighed for the determination of plant fresh weight. Plantlets were then dried for 24 hours at 60° C., and weighed again to measure plant dry weight for later statistical to analysis. The fresh and dry weights are provided for each Arabidopsis plant. Growth rate was determined by comparing the leaf area coverage, root coverage and root length, between each couple of sequential photographs, and results are used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events are examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

The genes presented in Table 30 showed a significant improvement in plant NUE since they produced larger plant biomass (plant fresh and dry weight) in T2 generation when grown under limiting nitrogen growth conditions, compared to control plants. The genes were cloned under the regulation of a constitutive promoter (At6669, SEQ ID NO:8096) or Ca35S (SEQ ID NO:8094). The evaluation of each gene was carried out by testing the performance of different number of events. Some of the genes were evaluated in more than one tissue culture assay. The results obtained in these second experiments were significantly positive as well.

TABLE 30

Genes showing improved plant performance at Low Nitrogen growth conditions under regulation of 6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYD78 | 60360.4 | 8.1 | 0.19 | 44 | — | — | — |
| LYD73 | 60367.2 | 7.3 | 0.13 | 31 | 154.2 | 0.19 | 24 |
| LYD47 | 60301.1 | 7.3 | 0.30 | 31 | — | — | — |
| LYD37 | 60165.1 | — | — | — | 163.5 | 0.23 | 31 |
| LYD229 | 60338.4 | 6.9 | 0.08 | 23 | 157.1 | 0.10 | 26 |
| LYD221 | 60350.2 | — | — | — | 146.8 | 0.27 | 18 |
| LYD156 | 60278.2 | 7.7 | 0.16 | 37 | — | — | — |
| LYD156 | 60280.1 | 7.9 | 0.25 | 40 | — | — | — |
| LYD132 | 60356.2 | 8.3 | 0.28 | 47 | 178.5 | 0.18 | 43 |
| LYD132 | 60357.2 | 8.4 | 0.04 | 49 | 172.4 | 0.07 | 39 |
| LYD132 | 60357.3 | 6.7 | 0.24 | 19 | — | — | — |
| LYD132 | 60357.4 | 10.0 | 0.03 | 77 | 190.2 | 0.06 | 53 |
| LYD107 | 60342.3 | 9.4 | 0.09 | 66 | 171.1 | 0.16 | 37 |
| LYD107 | 60342.4 | 8.9 | 0.19 | 59 | 161.5 | 0.28 | 30 |
| LYD107 | 60343.3 | 11.7 | L | 108 | 216.3 | 0.03 | 74 |
| CONT. | — | 5.6 | — | — | 124.4 | — | — |
| LYD85 | 60014.4 | 12.0 | 0.21 | 36 | 213.0 | 0.10 | 26 |
| LYD55 | 60174.1 | 10.4 | 0.12 | 19 | — | — | — |
| LYD55 | 60177.2 | 11.8 | 0.02 | 33 | 233.0 | L | 37 |
| LYD33 | 60159.3 | 11.4 | 0.11 | 29 | 215.1 | 0.21 | 27 |
| LYD33 | 60160.2 | 14.0 | 0.04 | 58 | 251.0 | L | 48 |
| LYD20 | 60066.2 | 10.3 | 0.19 | 17 | 203.2 | 0.03 | 20 |
| LYD20 | 60069.4 | 9.5 | 0.14 | 8 | — | — | — |
| LYD102 | 60960.1 | 10.1 | 0.28 | 15 | — | — | — |
| CONT. | — | 8.8 | — | — | 169.7 | — | — |
| LYD200 | 60481.2 | 10.1 | L | 107 | 190.9 | 0.03 | 107 |
| LYD200 | 60482.1 | 9.1 | 0.02 | 86 | 182.0 | L | 97 |
| LYD200 | 60485.2 | 7.8 | L | 59 | 169.1 | 0.02 | 83 |
| LYD158 | 60581.4 | 9.2 | 0.07 | 87 | 206.3 | 0.03 | 124 |
| LYD153 | 60697.3 | 9.5 | L | 95 | 212.7 | L | 131 |
| LYD153 | 60698.3 | 10.0 | L | 105 | 182.3 | L | 98 |
| LYD153 | 60698.6 | 7.0 | 0.08 | 43 | 134.2 | 0.03 | 46 |
| LYD153 | 60698.7 | — | — | — | 103.7 | 0.17 | 13 |
| LYD153 | 60700.3 | 8.3 | 0.15 | 69 | 160.0 | 0.07 | 74 |
| LYD148 | 60431.3 | — | — | — | 122.5 | 0.18 | 33 |
| LYD148 | 60432.4 | 7.0 | 0.10 | 44 | 131.5 | 0.19 | 43 |
| LYD148 | 60434.3 | 5.7 | 0.20 | 17 | 133.0 | L | 44 |
| LYD144 | 60864.2 | 7.8 | L | 60 | 167.7 | L | 82 |
| LYD144 | 60866.1 | — | — | — | 137.2 | 0.14 | 49 |
| LYD144 | 60866.4 | 7.6 | 0.01 | 55 | 160.8 | 0.02 | 74 |
| LYD129 | 60792.1 | 7.2 | 0.04 | 46 | 128.2 | 0.07 | 39 |
| LYD129 | 60793.2 | 6.0 | L | 22 | 156.8 | L | 70 |
| LYD127 | 60681.1 | 8.9 | L | 82 | 189.1 | L | 105 |
| LYD127 | 60682.3 | 9.6 | L | 97 | 183.5 | L | 99 |
| LYD127 | 60683.4 | — | — | — | 106.4 | 0.27 | 15 |
| LYD101 | 60072.4 | 9.3 | 0.02 | 90 | 178.9 | L | 94 |
| LYD101 | 60072.8 | 8.5 | 0.04 | 73 | 169.8 | 0.03 | 84 |
| LYD101 | 60075.3 | 10.3 | 0.03 | 110 | 204.3 | 0.05 | 122 |
| LYD101 | 60076.4 | 11.1 | L | 126 | 199.6 | 0.03 | 117 |
| CONT. | — | 4.9 | — | — | 92.2 | — | — |

Table 30.
"CONT."—Control;
"Ave."—Average;
"% Incr." = % increment;
"p-val."—p-value, L-p < 0.01.
Values are provided per plant.

The genes presented in Tables 31 and 32 showed a significant improvement in plant NUE since they produced a larger leaf biomass (leaf area) and root biomass (root length and root coverage) (Table 31) and a higher relative growth rate of leaf area, root coverage and root length (Table 32) when grown under limiting nitrogen growth conditions, compared to control plants. Plants producing larger root biomass have better possibilities to absorb larger amount of nitrogen from soil. Plants producing larger leaf to biomass have better ability to produce assimilates). The genes were cloned under the regulation of a constitutive promoter (At6669) or root preferred promoter (RootP). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant

TABLE 31

Genes showing improved plant performance at Low Nitrogen growth conditions under regulation of 6669 promoter

| Gene Name | Event # | Leaf Area [cm2] Ave. | P-Val. | % Incr. | Roots Coverage [cm2] Ave. | P-Val. | % Incr. | Roots Length [cm] Ave. | P-Val. | % Incr. |
|---|---|---|---|---|---|---|---|---|---|---|
| LYD78 | 60360.4 | 0.8 | 0.12 | 48 | — | — | — | — | — | — |
| LYD73 | 60367.2 | 0.8 | 0.07 | 36 | 13.6 | 0.21 | 19 | 7.6 | 0.28 | 5 |
| LYD66 | 60117.3 | 0.6 | 0.18 | 16 | — | — | — | — | — | — |
| LYD47 | 60301.1 | 0.6 | 0.25 | 16 | 15.0 | L | 32 | 8.0 | 0.07 | 10 |
| LYD37 | 60163.1 | 0.7 | 0.14 | 25 | — | — | — | — | — | — |
| LYD37 | 60165.1 | 0.7 | 0.16 | 21 | — | — | — | 7.7 | 0.12 | 7 |
| LYD3 | 60374.3 | — | — | — | 13.5 | 0.08 | 18 | 7.9 | 0.05 | 10 |
| LYD3 | 60375.3 | — | — | — | 12.7 | 0.29 | 11 | — | — | — |
| LYD236 | 60187.6 | 0.7 | 0.11 | 26 | — | — | — | — | — | — |
| LYD229 | 60337.2 | 0.7 | 0.24 | 28 | 14.5 | 0.24 | 27 | 8.1 | 0.03 | 13 |
| LYD229 | 60338.4 | 0.7 | 0.02 | 35 | 13.9 | 0.04 | 21 | — | — | — |
| LYD221 | 60350.2 | 0.7 | 0.23 | 25 | — | — | — | — | — | — |
| LYD156 | 60278.2 | 0.7 | 0.29 | 18 | 14.4 | 0.16 | 26 | 7.8 | 0.16 | 8 |
| LYD156 | 60280.1 | 1.0 | 0.03 | 74 | 16.6 | 0.13 | 45 | 8.3 | 0.02 | 15 |
| LYD156 | 60280.2 | 0.7 | 0.14 | 25 | 15.7 | 0.14 | 39 | 8.0 | 0.05 | 11 |
| LYD132 | 60356.2 | 0.9 | L | 59 | 15.8 | 0.12 | 39 | — | — | — |
| LYD132 | 60357.2 | 0.8 | 0.11 | 52 | 17.9 | L | 57 | 8.6 | L | 20 |
| LYD132 | 60357.3 | 0.7 | 0.02 | 25 | — | — | — | 7.7 | 0.24 | 7 |
| LYD132 | 60357.4 | 0.8 | 0.07 | 50 | — | — | — | — | — | — |
| LYD107 | 60341.2 | 0.6 | 0.29 | 16 | 13.2 | 0.28 | 16 | 7.7 | 0.15 | 7 |
| LYD107 | 60342.3 | 0.9 | 0.15 | 60 | 15.7 | 0.23 | 38 | 7.8 | 0.10 | 8 |

TABLE 31-continued

Genes showing improved plant performance at Low Nitrogen growth conditions under regulation of 6669 promoter

| Gene Name | Event # | Leaf Area [cm2] Ave. | P-Val. | % Incr. | Roots Coverage [cm2] Ave. | P-Val. | % Incr. | Roots Length [cm] Ave. | P-Val. | % Incr. |
|---|---|---|---|---|---|---|---|---|---|---|
| LYD107 | 60342.4 | 0.8 | 0.12 | 45 | — | — | — | — | — | — |
| LYD107 | 60343.3 | 1.1 | L | 92 | 19.1 | L | 68 | 8.2 | L | 14 |
| CONT. | — | 0.6 | — | — | 11.4 | — | — | 7.2 | — | — |
| LYD85 | 60014.2 | — | — | — | 14.8 | 0.15 | 29 | 7.7 | 0.16 | 10 |
| LYD85 | 60014.4 | — | — | — | 18.6 | 0.04 | 61 | 8.3 | L | 18 |
| LYD79 | 60018.2 | — | — | — | 12.9 | 0.19 | 12 | 7.6 | 0.12 | 9 |
| LYD79 | 60018.3 | — | — | — | — | — | — | 7.6 | 0.08 | 8 |
| LYD79 | 60020.4 | — | — | — | 16.5 | L | 43 | 8.1 | L | 16 |
| LYD55 | 60174.1 | — | — | — | 13.9 | 0.04 | 21 | 7.6 | 0.02 | 8 |
| LYD55 | 60175.4 | 0.8 | 0.04 | 26 | 13.5 | 0.27 | 17 | 7.8 | 0.02 | 12 |
| LYD55 | 60177.2 | 0.9 | 0.08 | 36 | 18.9 | L | 64 | 8.4 | L | 19 |
| LYD43 | 60610.4 | 0.8 | 0.08 | 19 | 15.0 | 0.02 | 31 | 8.0 | 0.01 | 14 |
| LYD33 | 60159.3 | 0.7 | 0.26 | 14 | 17.3 | 0.01 | 50 | 7.9 | 0.07 | 13 |
| LYD33 | 60159.5 | — | — | — | — | — | — | 7.8 | L | 12 |
| LYD33 | 60160.2 | — | — | — | 15.2 | 0.19 | 32 | 7.9 | 0.02 | 13 |
| LYD235 | 60929.3 | — | — | — | — | — | — | 7.7 | 0.12 | 9 |
| LYD235 | 60930.2 | — | — | — | — | — | — | 7.4 | 0.18 | 5 |
| LYD235 | 60930.3 | — | — | — | — | — | — | 7.8 | 0.04 | 12 |
| LYD204 | 60704.1 | — | — | — | 12.6 | 0.27 | 9 | 8.0 | 0.01 | 14 |
| LYD20 | 60066.2 | 0.8 | 0.12 | 26 | 13.7 | 0.29 | 19 | 8.1 | L | 16 |
| LYD20 | 60069.4 | 0.8 | 0.09 | 26 | 16.7 | 0.04 | 45 | 8.1 | L | 16 |
| LYD102 | 60960.1 | — | — | — | — | — | — | 7.4 | 0.11 | 6 |
| LYD102 | 60961.2 | — | — | — | — | — | — | 7.6 | 0.07 | 9 |
| CONT. | — | 0.6 | — | — | 11.5 | — | — | 7.0 | — | — |
| LYD200 | 60481.2 | 0.5 | L | 45 | 12.2 | 0.06 | 40 | — | — | — |
| LYD200 | 60482.1 | 0.7 | L | 96 | 15.2 | L | 75 | 7.9 | L | 13 |
| LYD200 | 60485.2 | 0.6 | L | 78 | 14.3 | L | 64 | 7.4 | 0.20 | 6 |
| LYD158 | 60581.4 | 0.6 | L | 72 | 14.2 | L | 63 | 7.8 | L | 12 |
| LYD158 | 60582.1 | — | — | — | 9.8 | 0.22 | 12 | 7.4 | 0.10 | 7 |
| LYD158 | 60582.2 | — | — | — | — | — | — | 7.6 | 0.27 | 9 |
| LYD153 | 60697.3 | 0.6 | 0.03 | 68 | 13.3 | 0.02 | 53 | 7.6 | 0.02 | 9 |
| LYD153 | 60698.3 | 0.7 | 0.03 | 90 | 15.1 | 0.02 | 73 | 7.6 | 0.09 | 9 |
| LYD153 | 60698.6 | 0.6 | 0.01 | 79 | 14.2 | 0.01 | 63 | 8.2 | L | 17 |
| LYD153 | 60700.3 | 0.6 | 0.18 | 60 | 12.3 | 0.23 | 41 | 7.7 | 0.12 | 10 |
| LYD148 | 60431.3 | — | — | — | 11.1 | 0.21 | 27 | — | — | — |
| LYD148 | 60432.1 | — | — | — | 10.4 | 0.21 | 19 | 7.7 | 0.03 | 11 |
| LYD148 | 60432.4 | 0.4 | 0.05 | 25 | 11.8 | 0.07 | 35 | 7.5 | 0.13 | 8 |
| LYD148 | 60434.3 | 0.5 | 0.02 | 45 | 11.9 | 0.02 | 37 | 7.5 | 0.10 | 8 |
| LYD144 | 60864.2 | 0.7 | L | 99 | 12.6 | L | 45 | 7.7 | L | 11 |
| LYD144 | 60866.4 | 0.7 | L | 82 | 11.8 | 0.10 | 35 | 7.7 | 0.05 | 11 |
| LYD144 | 60866.5 | — | — | — | — | — | — | 7.2 | 0.16 | 4 |
| LYD144 | 60868.4 | 0.4 | 0.09 | 26 | — | — | — | — | — | — |
| LYD129 | 60792.1 | 0.6 | 0.05 | 69 | 11.4 | 0.13 | 31 | — | — | — |
| LYD129 | 60793.2 | 0.6 | 0.10 | 55 | 11.0 | 0.19 | 27 | 7.6 | L | 10 |
| LYD127 | 60681.1 | 0.5 | 0.12 | 50 | 16.7 | L | 92 | 7.9 | L | 14 |
| LYD127 | 60682.2 | — | — | — | — | — | — | 7.3 | 0.22 | 4 |
| LYD127 | 60682.3 | 0.6 | 0.07 | 55 | 12.8 | L | 47 | 7.6 | L | 9 |
| LYD127 | 60683.1 | — | — | — | 10.4 | 0.28 | 20 | — | — | — |
| LYD127 | 60683.4 | — | — | — | 10.6 | 0.19 | 22 | — | — | — |
| LYD101 | 60072.4 | 0.6 | 0.04 | 77 | 13.2 | 0.10 | 51 | — | — | — |
| LYD101 | 60072.8 | 0.6 | 0.01 | 71 | — | — | — | — | — | — |
| LYD101 | 60075.3 | 0.6 | L | 80 | 13.0 | L | 49 | 7.9 | L | 14 |
| LYD101 | 60075.4 | 0.4 | 0.25 | 40 | 9.8 | 0.09 | 13 | 7.4 | 0.09 | 6 |
| LYD101 | 60076.4 | 0.5 | 0.09 | 41 | 12.6 | 0.10 | 45 | — | — | — |
| CONT. | — | 0.4 | — | — | 8.7 | — | — | 6.9 | — | — |

Table 31.
"CONT."—Control;
"Ave."—Average;
"% Incr." = % increment;
"p-val."—p-value, L-p < 0.01.
Values are provided per plant.

TABLE 32

Genes showing improved plant performance at Low Nitrogen growth conditions under regulation of 6669 promoter

| Gene Name | Event # | RGR Of Leaf Area Ave. | P-Val. | % Incr. | RGR Of Root Coverage Ave. | P-Val. | % Incr. | RGR Of Roots Length Ave. | P-Val. | % Incr. |
|---|---|---|---|---|---|---|---|---|---|---|
| LYD78 | 60359.1 | 0.1 | 0.20 | 21 | — | — | — | — | — | — |
| LYD78 | 60360.4 | 0.1 | 0.02 | 59 | — | — | — | — | — | — |
| LYD73 | 60367.2 | 0.1 | L | 58 | 1.6 | 0.24 | 17 | — | — | — |
| LYD66 | 60117.3 | 0.1 | 0.26 | 20 | — | — | — | — | — | — |
| LYD47 | 60300.1 | 0.1 | 0.17 | 25 | — | — | — | — | — | — |
| LYD47 | 60301.1 | 0.1 | 0.09 | 32 | 1.8 | 0.03 | 29 | — | — | — |
| LYD37 | 60162.1 | 0.1 | 0.13 | 25 | — | — | — | — | — | — |
| LYD37 | 60163.1 | 0.1 | 0.10 | 30 | — | — | — | — | — | — |
| LYD37 | 60165.1 | 0.1 | 0.07 | 31 | — | — | — | — | — | — |
| LYD3 | 60374.3 | — | — | — | 1.6 | 0.21 | 18 | — | — | — |
| LYD3 | 60375.3 | 0.1 | 0.05 | 34 | — | — | — | — | — | — |
| LYD236 | 60187.6 | 0.1 | 0.02 | 48 | — | — | — | — | — | — |
| LYD229 | 60337.2 | 0.1 | 0.03 | 52 | 1.8 | 0.11 | 28 | 0.8 | 0.23 | 11 |
| LYD229 | 60338.1 | 0.1 | 0.29 | 22 | — | — | — | — | — | — |
| LYD229 | 60338.4 | 0.1 | L | 55 | 1.6 | 0.18 | 17 | — | — | — |
| LYD221 | 60349.3 | 0.1 | 0.10 | 35 | — | — | — | — | — | — |
| LYD221 | 60350.2 | 0.1 | 0.07 | 40 | — | — | — | — | — | — |
| LYD156 | 60278.2 | 0.1 | 0.03 | 45 | 1.7 | 0.17 | 24 | — | — | — |
| LYD156 | 60280.1 | 0.1 | L | 90 | 2.0 | 0.02 | 44 | — | — | — |
| LYD156 | 60280.2 | 0.1 | 0.05 | 36 | 1.9 | 0.05 | 36 | — | — | — |
| LYD132 | 60353.3 | 0.1 | 0.21 | 20 | — | — | — | — | — | — |
| LYD132 | 60356.2 | 0.1 | L | 76 | 1.9 | 0.03 | 39 | — | — | — |
| LYD132 | 60357.2 | 0.1 | 0.01 | 69 | 2.2 | L | 56 | — | — | — |
| LYD132 | 60357.3 | 0.1 | 0.03 | 36 | — | — | — | — | — | — |
| LYD132 | 60357.4 | 0.1 | L | 63 | — | — | — | — | — | — |
| LYD107 | 60341.2 | 0.1 | 0.06 | 36 | — | — | — | — | — | — |
| LYD107 | 60342.3 | 0.1 | L | 85 | 1.9 | 0.03 | 37 | — | — | — |
| LYD107 | 60342.4 | 0.1 | 0.03 | 54 | — | — | — | — | — | — |
| LYD107 | 60343.3 | 0.1 | L | 115 | 2.2 | L | 63 | — | — | — |
| CONT. | — | 0.0 | — | — | 1.4 | — | — | 0.7 | — | — |
| LYD85 | 60014.2 | — | — | — | 1.8 | 0.02 | 30 | — | — | — |
| LYD85 | 60014.4 | — | — | — | 2.3 | L | 63 | 0.8 | 0.05 | 18 |
| LYD79 | 60018.2 | — | — | — | 1.5 | 0.29 | 11 | 0.7 | 0.28 | 9 |
| LYD79 | 60018.3 | — | — | — | — | — | — | 0.8 | 0.11 | 14 |
| LYD79 | 60020.4 | — | — | — | 2.0 | L | 44 | 0.8 | 0.08 | 15 |
| LYD55 | 60174.1 | — | — | — | 1.7 | 0.04 | 23 | 0.8 | 0.01 | 22 |
| LYD55 | 60175.4 | 0.1 | 0.07 | 37 | 1.6 | 0.13 | 18 | 0.7 | 0.20 | 11 |
| LYD55 | 60177.2 | 0.1 | 0.06 | 42 | 2.2 | L | 62 | 0.7 | 0.29 | 9 |
| LYD43 | 60610.4 | 0.1 | 0.20 | 26 | 1.8 | L | 32 | 0.8 | 0.03 | 19 |
| LYD33 | 60159.3 | — | — | — | 2.1 | L | 52 | 0.7 | 0.20 | 12 |
| LYD33 | 60159.5 | — | — | — | — | — | — | 0.8 | 0.04 | 17 |
| LYD33 | 60160.2 | 0.1 | 0.09 | 45 | 1.8 | 0.01 | 33 | 0.8 | 0.06 | 16 |
| LYD204 | 60703.1 | — | — | — | — | — | — | 0.8 | 0.02 | 19 |
| LYD204 | 60704.1 | — | — | — | — | — | — | 0.8 | 0.03 | 18 |
| LYD20 | 60066.2 | 0.1 | 0.07 | 39 | 1.6 | 0.18 | 16 | — | — | — |
| LYD20 | 60069.3 | — | — | — | — | — | — | 0.8 | 0.09 | 16 |
| LYD20 | 60069.4 | 0.1 | 0.06 | 40 | 2.0 | L | 44 | 0.7 | 0.20 | 12 |
| LYD102 | 60960.1 | — | — | — | 1.6 | 0.25 | 15 | — | — | — |
| CONT. | — | 0.1 | — | — | 1.4 | — | — | 0.7 | — | — |
| LYD200 | 60481.2 | 0.0 | 0.05 | 30 | 1.5 | L | 43 | — | — | — |
| LYD200 | 60482.1 | 0.1 | L | 97 | 1.9 | L | 75 | — | — | — |
| LYD200 | 60485.2 | 0.1 | L | 94 | 1.8 | L | 67 | 0.8 | 0.02 | 19 |
| LYD158 | 60581.4 | 0.1 | L | 68 | 1.8 | L | 63 | — | — | — |
| LYD158 | 60582.1 | — | — | — | 1.2 | 0.27 | 14 | 0.7 | 0.19 | 9 |
| LYD158 | 60582.2 | — | — | — | — | — | — | 0.7 | 0.28 | 8 |
| LYD153 | 60697.3 | 0.1 | L | 62 | 1.7 | L | 53 | — | — | — |
| LYD153 | 60698.3 | 0.1 | L | 96 | 1.9 | L | 76 | 0.7 | 0.17 | 10 |
| LYD153 | 60698.6 | 0.1 | L | 77 | 1.8 | L | 63 | 0.8 | L | 21 |
| LYD153 | 60700.3 | 0.1 | 0.01 | 57 | 1.5 | 0.01 | 40 | — | — | — |
| LYD148 | 60431.3 | — | — | — | 1.4 | 0.05 | 27 | — | — | — |
| LYD148 | 60432.1 | — | — | — | 1.3 | 0.15 | 18 | 0.7 | 0.13 | 12 |
| LYD148 | 60432.4 | — | — | — | 1.5 | L | 36 | — | — | — |
| LYD148 | 60434.3 | 0.1 | L | 54 | 1.5 | L | 37 | — | — | — |
| LYD144 | 60864.2 | 0.1 | L | 82 | 1.6 | L | 45 | — | — | — |
| LYD144 | 60866.4 | 0.1 | L | 76 | 1.5 | L | 36 | 0.7 | 0.21 | 9 |
| LYD144 | 60868.4 | 0.0 | 0.05 | 32 | — | — | — | — | — | — |
| LYD129 | 60792.1 | 0.1 | L | 63 | 1.4 | 0.02 | 32 | — | — | — |
| LYD129 | 60793.2 | 0.1 | L | 55 | 1.4 | 0.04 | 29 | 0.7 | 0.03 | 16 |
| LYD127 | 60681.1 | 0.1 | 0.06 | 36 | 2.1 | L | 93 | — | — | — |
| LYD127 | 60682.3 | 0.1 | 0.02 | 47 | 1.6 | L | 48 | 0.7 | 0.06 | 14 |
| LYD127 | 60683.1 | — | — | — | 1.3 | 0.13 | 20 | — | — | — |
| LYD127 | 60683.4 | 0.0 | 0.14 | 29 | 1.3 | 0.07 | 24 | 0.7 | 0.26 | 8 |
| LYD101 | 60072.4 | 0.1 | L | 86 | 1.7 | L | 55 | 0.7 | 0.06 | 15 |

TABLE 32-continued

Genes showing improved plant performance at Low Nitrogen growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD101 | 60072.8 | 0.1 | L | 66 | — | — | — | — | — | — |
| LYD101 | 60075.3 | 0.1 | L | 85 | 1.6 | L | 50 | 0.7 | 0.05 | 14 |
| LYD101 | 60075.4 | 0.0 | 0.20 | 19 | 1.2 | 0.27 | 13 | 0.7 | 0.13 | 11 |
| LYD101 | 60076.4 | 0.0 | 0.07 | 33 | 1.6 | L | 47 | 0.7 | 0.29 | 8 |
| CONT. | — | 0.0 | — | — | 1.1 | — | — | 0.6 | — | — |

Table 32.
"CONT."—Control;
"Ave."—Average;
"% Incr." = % increment;
"p-val."—p-value, L-p < 0.01.
Values are provided per plant.

The genes presented in Table 33 showed a significant improvement in plant performance since they produced larger plant biomass (plant fresh and dry weight) in T2 generation when grown under normal nitrogen growth conditions, compared to control plants. The genes were cloned under the regulation of a constitutive promoter (At6669, SEQ ID NO:8096) or 35S (SEQ ID NO:8094). The evaluation of each gene was carried out by testing the performance of different number of events. Some of the genes were evaluated in more than one tissue culture assay. The results obtained in these second experiments were significantly positive as well.

TABLE 33

Genes showing improved plant performance at Normal growth conditions under regulation of 6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD58 | 61306.2 | 6.0 | 0.16 | 67 | 98.8 | 0.09 | 65 |
| LYD58 | 61307.3 | 5.7 | 0.17 | 58 | 92.8 | 0.13 | 55 |
| LYD58 | 61308.2 | 6.4 | 0.08 | 79 | 103.8 | 0.04 | 73 |
| LYD283 | 61317.4 | 4.6 | 0.08 | 30 | 77.7 | 0.03 | 30 |
| LYD283 | 61319.3 | 6.0 | L | 66 | 95.3 | L | 59 |
| LYD283 | 61320.1 | 5.5 | L | 53 | 86.5 | 0.01 | 44 |
| LYD283 | 61320.2 | 3.8 | 0.28 | 6 | — | — | — |
| LYD283 | 61320.4 | 5.9 | 0.04 | 64 | 88.2 | 0.03 | 47 |
| LYD270 | 61370.4 | 6.2 | L | 72 | 108.2 | L | 80 |
| LYD260 | 61364.4 | 6.9 | 0.02 | 92 | 105.5 | 0.03 | 76 |
| LYD260 | 61365.3 | 6.6 | L | 83 | 109.8 | L | 83 |
| LYD260 | 61365.4 | 6.9 | L | 93 | 111.2 | L | 85 |
| LYD260 | 61365.6 | 4.6 | 0.11 | 28 | 80.1 | 0.03 | 34 |
| LYD260 | 61368.1 | — | — | — | 67.4 | 0.26 | 12 |
| LYD259 | 61301.2 | 4.1 | 0.29 | 14 | 73.6 | 0.03 | 23 |
| LYD259 | 61302.3 | 5.2 | 0.08 | 45 | 85.5 | 0.04 | 43 |
| LYD259 | 61302.6 | 5.0 | 0.07 | 41 | 80.1 | 0.01 | 34 |
| LYD230 | 61333.4 | — | — | — | 69.2 | L | 15 |
| LYD230 | 61334.5 | 6.5 | L | 82 | 93.9 | 0.02 | 57 |
| LYD230 | 61335.2 | — | — | — | 73.4 | 0.04 | 22 |
| LYD222 | 61327.3 | 5.0 | 0.04 | 39 | 82.7 | L | 38 |
| LYD222 | 61327.4 | 4.4 | 0.17 | 22 | — | — | — |
| LYD222 | 61329.2 | 5.0 | 0.17 | 38 | 79.8 | 0.10 | 33 |
| LYD222 | 61329.3 | 5.0 | 0.11 | 39 | 85.6 | 0.06 | 43 |
| LYD21 | 61358.1 | 5.9 | L | 64 | 106.3 | L | 77 |
| LYD21 | 61360.1 | 7.3 | L | 103 | 110.2 | L | 84 |
| LYD21 | 61362.1 | 9.0 | 0.02 | 151 | 136.8 | 0.09 | 128 |
| LYD21 | 61362.3 | 6.1 | L | 70 | 104.2 | L | 74 |
| LYD21 | 61362.4 | 4.6 | 0.15 | 28 | 90.0 | L | 50 |
| LYD187 | 61313.2 | 4.6 | 0.25 | 29 | 81.3 | 0.03 | 36 |
| LYD187 | 61314.2 | 4.5 | 0.13 | 26 | 78.9 | 0.07 | 32 |
| LYD152 | 61352.1 | 4.0 | 0.22 | 13 | 72.7 | 0.07 | 21 |
| LYD152 | 61352.4 | 6.4 | L | 79 | 92.7 | L | 55 |
| LYD152 | 61352.5 | 4.5 | 0.21 | 27 | 71.8 | 0.03 | 20 |
| LYD152 | 61352.7 | 4.6 | 0.04 | 28 | 72.3 | 0.09 | 21 |
| LYD152 | 61355.3 | 7.2 | 0.02 | 102 | 115.2 | L | 92 |
| LYD150 | 61323.2 | 5.2 | 0.16 | 44 | 95.6 | L | 59 |
| LYD150 | 61324.1 | — | — | — | 72.3 | 0.05 | 21 |
| LYD150 | 61324.2 | 6.5 | L | 80 | 111.8 | 0.01 | 86 |
| LYD150 | 61325.4 | — | — | — | 67.2 | 0.02 | 12 |
| LYD150 | 61326.1 | 4.8 | 0.09 | 33 | 88.5 | L | 48 |

TABLE 33-continued

Genes showing improved plant performance at Normal growth conditions under regulation of 6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYD126 | 61376.1 | 5.8 | 0.08 | 61 | 98.3 | 0.01 | 64 |
| LYD126 | 61377.3 | 5.2 | 0.04 | 44 | 82.2 | 0.04 | 37 |
| LYD126 | 61380.2 | — | — | — | 77.2 | 0.23 | 29 |
| LYD115 | 61346.2 | 6.4 | 0.04 | 79 | 104.6 | 0.02 | 74 |
| LYD115 | 61348.2 | — | — | — | 67.0 | L | 12 |
| LYD115 | 61349.1 | 4.2 | 0.09 | 18 | 66.8 | L | 11 |
| LYD115 | 61349.2 | 5.7 | L | 58 | 91.3 | L | 52 |
| LYD115 | 61350.3 | 4.9 | L | 36 | 81.4 | 0.02 | 36 |
| LYD114 | 61383.3 | 4.3 | 0.22 | 21 | 71.1 | 0.06 | 19 |
| LYD114 | 61383.6 | 5.0 | 0.02 | 39 | 79.6 | 0.15 | 33 |
| LYD108 | 61294.1 | 4.9 | 0.08 | 37 | 85.7 | 0.11 | 43 |
| LYD108 | 61294.4 | 8.8 | L | 144 | 136.2 | L | 127 |
| LYD108 | 61295.1 | 7.6 | 0.01 | 110 | 112.6 | 0.02 | 88 |
| LYD108 | 61296.1 | 6.8 | 0.01 | 88 | 110.4 | 0.11 | 84 |
| LYD108 | 61297.2 | 5.1 | 0.28 | 41 | 90.5 | 0.20 | 51 |
| CONT. | — | 3.6 | — | — | 60.0 | — | — |
| LYD95 | 61199.1 | 5.8 | 0.07 | 44 | — | — | — |
| LYD95 | 61199.2 | 7.0 | 0.24 | 73 | 160.9 | 0.19 | 47 |
| LYD95 | 61201.3 | 6.0 | L | 50 | 156.2 | 0.27 | 43 |
| LYD95 | 61202.2 | 7.5 | L | 87 | 158.3 | 0.02 | 45 |
| LYD61 | 61659.4 | 6.0 | 0.03 | 49 | — | — | — |
| LYD61 | 61660.1 | 7.2 | L | 78 | 172.9 | 0.07 | 58 |
| LYD61 | 61660.3 | 5.6 | 0.18 | 39 | 129.4 | 0.17 | 18 |
| LYD61 | 61661.1 | 10.4 | 0.02 | 160 | 200.2 | 0.04 | 83 |
| LYD286 | 61703.2 | 5.9 | 0.06 | 46 | — | — | — |
| LYD286 | 61703.3 | 4.9 | 0.26 | 21 | — | — | — |
| LYD282 | 61664.2 | 5.0 | 0.10 | 24 | — | — | — |
| LYD282 | 61664.3 | 7.2 | L | 80 | 178.4 | 0.10 | 63 |
| LYD282 | 61665.3 | 7.5 | 0.11 | 86 | 149.2 | 0.20 | 36 |
| LYD282 | 61665.4 | 10.2 | 0.06 | 155 | 190.6 | 0.07 | 74 |
| LYD282 | 61666.1 | 8.3 | 0.02 | 107 | 167.0 | 0.05 | 53 |
| LYD271_H0 | 61876.4 | 5.9 | 0.03 | 45 | 124.8 | 0.28 | 14 |
| LYD271_H0 | 61876.5 | 7.1 | 0.03 | 76 | 126.5 | 0.21 | 16 |
| LYD271_H0 | 61877.1 | 6.0 | 0.27 | 50 | — | — | — |
| LYD271_H0 | 61878.2 | 4.6 | 0.26 | 14 | — | — | — |
| LYD271_H0 | 61879.3 | 7.2 | 0.03 | 80 | 147.2 | 0.07 | 35 |
| LYD270 | 61373.1 | 5.4 | 0.24 | 34 | — | — | — |
| LYD270 | 61374.2 | 8.1 | 0.06 | 101 | 157.0 | 0.17 | 44 |
| LYD261 | 61521.2 | 7.5 | 0.05 | 86 | 156.8 | 0.20 | 43 |
| LYD261 | 61521.4 | 4.7 | 0.07 | 16 | 133.6 | 0.15 | 22 |
| LYD261 | 61524.2 | 5.0 | 0.22 | 24 | — | — | — |
| LYD260 | 61365.3 | 8.2 | 0.10 | 104 | 203.2 | 0.08 | 86 |
| LYD260 | 61368.1 | 7.9 | 0.04 | 97 | 189.9 | L | 74 |
| LYD231 | 60717.2 | 6.6 | 0.06 | 63 | — | — | — |
| LYD231 | 60718.1 | 9.4 | 0.01 | 133 | 215.6 | 0.02 | 97 |
| LYD231 | 60719.1 | 8.0 | 0.02 | 99 | 154.3 | 0.02 | 41 |
| LYD223 | 61194.2 | 7.0 | 0.09 | 75 | 133.6 | 0.20 | 22 |
| LYD223 | 61195.3 | 6.9 | 0.16 | 71 | 163.9 | L | 50 |
| LYD223 | 61196.3 | 8.8 | L | 117 | 180.4 | L | 65 |
| LYD21 | 61358.1 | 5.3 | 0.15 | 32 | — | — | — |
| LYD21 | 61362.1 | 7.0 | 0.22 | 73 | — | — | — |
| LYD126 | 61376.1 | 8.4 | L | 110 | 167.1 | L | 53 |
| LYD126 | 61380.1 | 5.1 | 0.26 | 26 | — | — | — |
| LYD126 | 61380.2 | 7.3 | L | 83 | 145.7 | 0.09 | 33 |
| LYD124_H7 | 61871.2 | 8.0 | 0.08 | 99 | 160.1 | 0.07 | 46 |
| LYD124_H7 | 61871.4 | 4.9 | 0.28 | 22 | — | — | — |
| LYD114 | 61383.1 | 10.3 | 0.10 | 157 | 203.1 | 0.13 | 86 |
| LYD114 | 61383.3 | 6.8 | 0.02 | 70 | 131.6 | 0.22 | 20 |
| LYD114 | 61383.6 | 7.8 | L | 93 | 151.2 | 0.01 | 38 |
| LYD114 | 61384.2 | 6.6 | 0.03 | 63 | 165.1 | 0.05 | 51 |
| LYD114 | 61385.2 | 7.6 | 0.15 | 88 | — | — | — |
| CONT. | — | 4.0 | — | — | 109.4 | — | — |
| LYD92 | 60583.3 | 4.9 | 0.25 | 19 | 97.2 | 0.16 | 14 |
| LYD92 | 60586.4 | 5.0 | 0.05 | 20 | 100.5 | 0.12 | 18 |
| LYD92 | 60587.3 | 5.2 | 0.29 | 25 | 105.4 | 0.23 | 23 |
| LYD66 | 60114.1 | 5.9 | 0.10 | 41 | 104.6 | 0.18 | 23 |
| LYD57 | 61655.2 | 5.3 | 0.15 | 28 | — | — | — |
| LYD266 | 60616.2 | — | — | — | 104.0 | 0.30 | 22 |
| LYD25 | 60589.4 | 5.9 | 0.01 | 42 | 107.9 | 0.01 | 26 |
| CONT. | — | 4.2 | — | — | 85.4 | — | — |
| LYM104 | 12912.17 | 6.2 | 0.06 | 55 | 111.1 | 0.03 | 64 |
| LYM104 | 12913.21 | 6.7 | L | 69 | 126.2 | 0.01 | 87 |
| LYM104 | 12914.1 | 10.6 | L | 165 | 186.7 | L | 176 |

TABLE 33-continued

Genes showing improved plant performance at Normal growth conditions under regulation of 6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM104 | 12914.14 | 8.6 | L | 114 | 156.0 | 0.01 | 131 |
| LYD88 | 61706.3 | 5.7 | L | 42 | 94.8 | L | 40 |
| LYD88 | 61707.3 | — | — | — | 77.3 | 0.07 | 14 |
| LYD88 | 61709.1 | 5.5 | 0.03 | 39 | 110.4 | L | 63 |
| LYD88 | 61709.2 | — | — | — | 82.7 | 0.04 | 22 |
| LYD84 | 61133.4 | 6.7 | 0.02 | 67 | 116.8 | 0.01 | 73 |
| LYD84 | 61134.1 | 7.5 | 0.09 | 88 | 128.8 | 0.08 | 90 |
| LYD84 | 61134.3 | 9.1 | L | 127 | 170.7 | L | 152 |
| LYD84 | 61134.4 | 9.2 | 0.05 | 131 | 181.3 | 0.05 | 168 |
| LYD84 | 61135.2 | 6.8 | L | 70 | 120.0 | L | 77 |
| LYD72 | 61163.3 | 7.4 | 0.06 | 86 | 135.3 | 0.04 | 100 |
| LYD72 | 61164.1 | 6.6 | 0.07 | 64 | 102.3 | L | 51 |
| LYD72 | 61164.3 | 5.4 | 0.13 | 36 | 99.0 | 0.10 | 46 |
| LYD72 | 61165.4 | 7.8 | 0.10 | 95 | 112.3 | 0.07 | 66 |
| LYD72 | 61166.4 | — | — | — | 85.0 | 0.16 | 26 |
| LYD63 | 61228.2 | 5.5 | 0.05 | 37 | 108.0 | 0.05 | 60 |
| LYD63 | 61229.4 | — | — | — | 77.0 | 0.17 | 14 |
| LYD63 | 61229.8 | 5.7 | 0.17 | 42 | — | — | — |
| LYD63 | 61231.1 | 6.5 | L | 64 | 106.8 | 0.01 | 58 |
| LYD286 | 61700.2 | 5.5 | 0.08 | 37 | 96.3 | 0.01 | 42 |
| LYD286 | 61701.2 | — | — | — | 90.1 | 0.04 | 33 |
| LYD286 | 61701.4 | 5.3 | 0.01 | 34 | 102.9 | 0.02 | 52 |
| LYD286 | 61703.2 | 6.6 | 0.13 | 65 | 118.2 | 0.11 | 75 |
| LYD28 | 61712.1 | 5.3 | 0.21 | 32 | 88.8 | 0.10 | 31 |
| LYD28 | 61713.2 | 5.3 | 0.07 | 33 | 93.0 | 0.10 | 37 |
| LYD28 | 61714.6 | — | — | — | 87.5 | 0.22 | 29 |
| LYD28 | 61716.2 | 7.0 | 0.02 | 76 | 115.3 | 0.05 | 71 |
| LYD268 | 61152.3 | 6.6 | 0.05 | 64 | 117.5 | 0.04 | 74 |
| LYD268 | 61153.3 | 6.5 | 0.04 | 64 | 117.7 | 0.05 | 74 |
| LYD268 | 61153.6 | 6.3 | L | 59 | 100.4 | L | 48 |
| LYD268 | 61154.2 | 4.7 | 0.12 | 18 | 90.7 | L | 34 |
| LYD26 | 61168.1 | 5.9 | L | 48 | 98.4 | 0.04 | 45 |
| LYD26 | 61169.3 | 5.5 | 0.08 | 37 | 108.7 | L | 61 |
| LYD26 | 61171.1 | — | — | — | 80.9 | 0.03 | 20 |
| LYD157 | 61156.1 | 4.6 | 0.27 | 16 | 84.3 | 0.04 | 25 |
| LYD157 | 61156.3 | 4.9 | 0.16 | 24 | 84.0 | 0.16 | 24 |
| LYD157 | 61158.1 | 5.8 | 0.08 | 46 | 105.6 | 0.05 | 56 |
| LYD157 | 61158.5 | 7.3 | 0.07 | 83 | 137.8 | L | 104 |
| LYD157 | 61159.3 | — | — | — | 80.4 | 0.02 | 19 |
| LYD115 | 61348.2 | 5.6 | 0.16 | 42 | 101.1 | 0.04 | 49 |
| LYD115 | 61349.1 | 4.9 | 0.05 | 22 | 88.7 | 0.07 | 31 |
| LYD115 | 61350.3 | 8.0 | 0.10 | 99 | 144.8 | 0.08 | 114 |
| LYD112 | 61144.1 | 6.3 | L | 59 | 106.8 | 0.01 | 58 |
| LYD112 | 61146.5 | 5.8 | L | 46 | 103.4 | 0.03 | 53 |
| LYD112 | 61148.1 | — | — | — | 85.4 | 0.07 | 26 |
| LYD109 | 61175.3 | 5.9 | 0.10 | 48 | 102.1 | 0.07 | 51 |
| LYD109 | 61177.4 | 5.6 | L | 41 | 102.0 | 0.01 | 51 |
| LYD109 | 61178.2 | 5.3 | 0.02 | 34 | 95.7 | 0.01 | 41 |
| LYD106 | 61140.2 | 5.7 | L | 42 | 96.0 | L | 42 |
| LYD106 | 61140.4 | 6.9 | 0.01 | 72 | 128.3 | L | 90 |
| LYD106 | 61141.1 | 5.6 | 0.15 | 40 | 93.9 | 0.08 | 39 |
| LYD106 | 61141.3 | — | — | — | 77.3 | 0.08 | 14 |
| CONT. | — | 4.0 | — | — | 67.6 | — | — |
| LYD96 | 60283.4 | 7.7 | 0.11 | 100 | 169.5 | 0.04 | 86 |
| LYD96 | 60285.1 | 8.3 | 0.03 | 116 | 153.7 | 0.05 | 69 |
| LYD96 | 60286.2 | 6.2 | L | 61 | 122.4 | 0.14 | 35 |
| LYD96 | 60286.3 | 9.1 | 0.02 | 136 | 184.9 | 0.02 | 103 |
| LYD91 | 60685.6 | 11.4 | L | 197 | 205.5 | 0.02 | 126 |
| LYD91 | 60689.4 | 9.2 | 0.15 | 138 | 176.1 | 0.17 | 94 |
| LYD91 | 60690.1 | 6.0 | 0.05 | 57 | 109.4 | 0.28 | 20 |
| LYD71 | 60637.3 | 5.8 | 0.11 | 49 | 137.5 | 0.02 | 51 |
| LYD71 | 60638.1 | 10.0 | L | 160 | 189.4 | L | 108 |
| LYD71 | 60641.3 | 6.1 | 0.03 | 59 | 125.0 | 0.03 | 38 |
| LYD65 | 60625.3 | 5.3 | 0.12 | 38 | 122.1 | 0.08 | 34 |
| LYD65 | 60625.4 | 6.9 | L | 78 | 140.9 | 0.08 | 55 |
| LYD65 | 60626.2 | 7.6 | 0.03 | 99 | 146.2 | 0.09 | 61 |
| LYD65 | 60629.1 | 7.4 | 0.04 | 92 | 135.0 | 0.05 | 48 |
| LYD65 | 60629.2 | 8.3 | 0.03 | 116 | 154.5 | L | 70 |
| LYD287 | 60145.1 | 10.0 | 0.08 | 158 | 175.7 | 0.10 | 93 |
| LYD287 | 60145.2 | 7.5 | 0.01 | 95 | 165.9 | 0.04 | 83 |
| LYD287 | 60145.3 | 7.6 | L | 97 | 135.8 | L | 49 |
| LYD287 | 60146.1 | 6.9 | 0.01 | 81 | 140.3 | 0.03 | 54 |
| LYD287 | 60148.1 | 8.0 | 0.01 | 106 | 173.1 | L | 90 |

TABLE 33-continued

Genes showing improved plant performance at Normal growth conditions under regulation of 6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD232 | 61640.2 | 9.0 | L | 134 | 183.7 | L | 102 |
| LYD232 | 61640.3 | 6.3 | 0.02 | 63 | 113.2 | 0.12 | 24 |
| LYD232 | 61641.1 | 10.3 | 0.06 | 168 | 204.1 | 0.02 | 124 |
| LYD232 | 61642.4 | 8.0 | 0.01 | 107 | 156.9 | L | 73 |
| LYD232 | 61643.4 | 7.3 | L | 91 | 209.9 | 0.02 | 131 |
| LYD227 | 60547.3 | 5.5 | 0.04 | 42 | 119.1 | 0.04 | 31 |
| LYD227 | 60548.3 | 6.0 | 0.02 | 55 | 116.8 | 0.10 | 28 |
| LYD227 | 60549.3 | 7.2 | 0.02 | 86 | 159.6 | 0.03 | 76 |
| LYD227 | 60551.1 | 6.9 | 0.07 | 78 | 142.1 | 0.05 | 56 |
| LYD227 | 60551.4 | 6.1 | L | 58 | 112.5 | 0.04 | 24 |
| LYD193 | 60506.1 | 4.9 | L | 27 | — | — | — |
| LYD193 | 60506.4 | 5.2 | 0.10 | 35 | — | — | — |
| LYD178 | 61689.2 | 4.9 | 0.08 | 27 | — | — | — |
| LYD178 | 61690.3 | 5.5 | L | 43 | 104.0 | 0.29 | 14 |
| LYD178 | 61691.2 | — | — | — | 105.3 | 0.25 | 16 |
| LYD178 | 61691.4 | 5.0 | 0.06 | 30 | — | — | — |
| LYD156 | 60277.4 | 6.6 | 0.07 | 72 | 127.5 | 0.19 | 40 |
| LYD156 | 60280.4 | 4.8 | 0.26 | 25 | 105.0 | 0.23 | 16 |
| LYD140 | 60383.3 | 5.0 | 0.25 | 29 | 128.5 | 0.11 | 41 |
| LYD136 | 60441.3 | 4.8 | 0.12 | 23 | — | — | — |
| LYD136 | 60444.1 | 4.9 | 0.11 | 27 | 104.2 | 0.16 | 15 |
| LYD136 | 60444.3 | 4.3 | 0.30 | 12 | — | — | — |
| LYD136 | 60445.1 | 4.8 | 0.09 | 25 | 110.0 | 0.12 | 21 |
| LYD110 | 60391.3 | 6.2 | L | 60 | 118.3 | 0.01 | 30 |
| LYD110 | 60391.4 | 7.6 | L | 96 | 162.6 | L | 79 |
| LYD110 | 60392.1 | 8.2 | L | 112 | 165.7 | L | 82 |
| LYD110 | 60394.4 | 5.4 | 0.04 | 40 | 107.3 | 0.19 | 18 |
| LYD103 | 60258.2 | — | — | — | 105.8 | 0.20 | 16 |
| LYD103 | 60261.6 | — | — | — | 120.9 | 0.03 | 33 |
| CONT. | — | 3.9 | — | — | 90.9 | — | — |
| LYD78 | 60359.1 | 7.2 | 0.10 | 36 | 143.9 | 0.13 | 26 |
| LYD73 | 60368.4 | 7.2 | 0.16 | 36 | — | — | — |
| LYD66 | 60117.3 | 6.9 | 0.29 | 30 | — | — | — |
| LYD47 | 60301.1 | 6.3 | 0.27 | 19 | — | — | — |
| LYD236 | 60187.6 | 7.1 | 0.15 | 34 | — | — | — |
| LYD229 | 60338.4 | 6.8 | 0.21 | 28 | 136.5 | 0.29 | 19 |
| LYD156 | 60280.1 | 11.3 | 0.04 | 113 | 250.4 | 0.01 | 119 |
| LYD132 | 60356.2 | 10.3 | 0.01 | 94 | 212.8 | 0.08 | 86 |
| LYD132 | 60357.3 | 7.0 | 0.22 | 32 | 148.4 | 0.23 | 30 |
| LYD132 | 60357.4 | 8.4 | 0.12 | 59 | 166.0 | 0.09 | 45 |
| LYD107 | 60341.2 | 6.9 | 0.15 | 30 | — | — | — |
| LYD107 | 60342.3 | 8.2 | 0.04 | 55 | 172.8 | 0.05 | 51 |
| LYD107 | 60343.3 | 7.3 | 0.02 | 37 | 151.8 | 0.04 | 33 |
| CONT. | — | 5.3 | — | — | 114.4 | — | — |
| LYD7 | 60670.2 | 6.2 | 0.02 | 20 | — | — | — |
| LYD228 | 60403.4 | 8.4 | 0.08 | 64 | 158.2 | 0.06 | 55 |
| LYD174 | 60816.3 | 6.2 | 0.05 | 20 | — | — | — |
| LYD174 | 60816.4 | 11.2 | 0.04 | 118 | 230.2 | L | 126 |
| LYD174 | 60817.3 | 6.9 | L | 35 | 130.3 | 0.13 | 28 |
| LYD174 | 60818.3 | 8.4 | L | 63 | 136.2 | L | 33 |
| LYD16 | 60313.2 | — | — | — | 142.7 | 0.06 | 40 |
| LYD16 | 60314.1 | — | — | — | 142.3 | 0.14 | 39 |
| LYD16 | 60315.3 | 6.0 | 0.05 | 18 | — | — | — |
| LYD159 | 60662.3 | 7.3 | L | 42 | 167.2 | 0.13 | 64 |
| LYD159 | 60665.1 | 8.0 | 0.05 | 55 | 129.3 | 0.11 | 27 |
| LYD159 | 60665.5 | 5.7 | 0.17 | 11 | — | — | — |
| LYD125 | 60826.2 | 6.3 | 0.03 | 23 | 128.6 | 0.16 | 26 |
| CONT. | — | 5.1 | — | — | 102.1 | — | — |
| LYD96 | 60285.2 | 9.3 | 0.08 | 69 | 173.5 | 0.19 | 52 |
| LYD96 | 60285.3 | 8.8 | 0.13 | 58 | — | — | — |
| LYD96 | 60286.2 | 9.2 | L | 67 | 165.8 | 0.02 | 45 |
| LYD96 | 60286.3 | 11.3 | 0.12 | 105 | 216.7 | 0.09 | 89 |
| LYD91 | 60685.6 | 13.8 | 0.06 | 150 | 236.1 | 0.05 | 106 |
| LYD91 | 60689.3 | 6.6 | 0.08 | 20 | — | — | — |
| LYD91 | 60690.2 | 6.3 | 0.27 | 14 | — | — | — |
| LYD71 | 60641.2 | 11.8 | 0.09 | 114 | 208.3 | 0.05 | 82 |
| LYD71 | 60641.3 | 13.4 | L | 142 | 218.6 | L | 91 |
| LYD65 | 60625.4 | 10.3 | 0.03 | 87 | 191.9 | 0.16 | 68 |
| LYD65 | 60626.2 | 9.9 | 0.08 | 79 | 178.2 | 0.07 | 56 |
| LYD287 | 60145.1 | 10.8 | 0.08 | 95 | 207.5 | 0.08 | 81 |
| LYD287 | 60145.3 | 9.5 | 0.05 | 71 | 173.5 | 0.06 | 52 |
| LYD287 | 60146.1 | 8.3 | L | 50 | 172.8 | L | 51 |
| LYD287 | 60146.3 | 7.4 | 0.10 | 34 | 141.8 | 0.11 | 24 |

TABLE 33-continued

Genes showing improved plant performance at Normal growth conditions under regulation of 6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD232 | 61640.2 | 6.5 | 0.29 | 17 | — | — | — |
| LYD232 | 61641.4 | 8.4 | 0.26 | 52 | — | — | — |
| LYD232 | 61642.4 | 7.2 | 0.01 | 31 | 157.2 | 0.07 | 37 |
| LYD232 | 61643.4 | 10.2 | 0.08 | 85 | 164.6 | 0.14 | 44 |
| LYD227 | 60548.3 | 10.1 | 0.07 | 82 | 170.8 | 0.10 | 49 |
| LYD227 | 60549.3 | 7.0 | 0.16 | 27 | 139.1 | 0.19 | 22 |
| LYD227 | 60551.1 | 9.0 | L | 62 | 192.3 | 0.06 | 68 |
| LYD227 | 60551.4 | 7.0 | 0.08 | 26 | 138.9 | 0.12 | 21 |
| LYD214 | 60127.5 | 11.1 | L | 101 | 225.2 | 0.01 | 97 |
| LYD214 | 60129.1 | 7.9 | 0.11 | 42 | 162.8 | 0.05 | 42 |
| LYD214 | 60130.3 | 7.9 | L | 42 | 156.7 | L | 37 |
| LYD193 | 60504.2 | 8.7 | 0.09 | 57 | 174.9 | 0.17 | 53 |
| LYD193 | 60505.3 | 7.8 | 0.23 | 41 | — | — | — |
| LYD193 | 60506.1 | 7.5 | L | 36 | 150.2 | L | 31 |
| LYD178 | 61689.2 | 8.4 | 0.23 | 51 | 176.1 | 0.09 | 54 |
| LYD178 | 61690.1 | 8.0 | 0.11 | 44 | 144.7 | 0.22 | 26 |
| LYD178 | 61690.3 | 11.4 | 0.02 | 105 | 205.9 | 0.03 | 80 |
| LYD178 | 61691.2 | 10.2 | 0.13 | 84 | 170.2 | 0.21 | 49 |
| LYD148 | 60431.3 | 7.2 | 0.23 | 31 | — | — | — |
| LYD148 | 60433.2 | 7.8 | 0.03 | 41 | 162.6 | L | 42 |
| LYD148 | 60434.3 | 8.5 | L | 53 | 162.8 | 0.05 | 42 |
| LYD148 | 60434.4 | — | — | — | 127.1 | 0.21 | 11 |
| LYD140 | 60382.3 | 9.3 | 0.12 | 68 | 175.0 | 0.06 | 53 |
| LYD140 | 60383.3 | 12.9 | 0.04 | 133 | 272.4 | 0.05 | 138 |
| LYD140 | 60384.2 | 10.2 | 0.10 | 84 | 206.3 | 0.11 | 80 |
| LYD136 | 60441.3 | 7.2 | 0.27 | 29 | 167.1 | 0.07 | 46 |
| LYD136 | 60443.1 | 8.2 | 0.30 | 49 | — | — | — |
| LYD136 | 60444.1 | 9.5 | 0.13 | 72 | 179.4 | 0.07 | 57 |
| LYD110 | 60391.2 | 11.7 | 0.05 | 111 | 228.2 | 0.02 | 100 |
| LYD110 | 60392.1 | 12.4 | 0.08 | 124 | 219.5 | 0.15 | 92 |
| LYD110 | 60393.3 | 7.8 | 0.09 | 41 | 165.1 | 0.02 | 44 |
| LYD110 | 60393.4 | 12.6 | 0.04 | 127 | 231.5 | 0.01 | 102 |
| CONT. | — | 5.5 | — | — | 114.4 | — | — |
| LYD99 | 60328.5 | 7.4 | 0.06 | 37 | 123.6 | 0.11 | 40 |
| LYD88 | 61707.4 | 6.3 | 0.22 | 17 | 103.8 | 0.14 | 17 |
| LYD88 | 61709.1 | 8.1 | L | 50 | 139.5 | L | 58 |
| LYD88 | 61709.2 | 5.9 | 0.25 | 9 | — | — | — |
| LYD58 | 61307.3 | 7.0 | 0.16 | 29 | 121.1 | 0.16 | 37 |
| LYD58 | 61308.2 | 8.1 | L | 49 | 139.5 | L | 58 |
| LYD283 | 61319.3 | 8.2 | 0.01 | 51 | 133.3 | L | 51 |
| LYD28 | 61712.1 | 6.4 | 0.16 | 18 | 107.1 | 0.07 | 21 |
| LYD28 | 61714.3 | 6.5 | 0.02 | 20 | 115.7 | 0.02 | 31 |
| LYD28 | 61716.2 | 6.7 | 0.14 | 23 | 115.2 | 0.14 | 30 |
| LYD269 | 61462.2 | 6.9 | L | 28 | 108.9 | 0.03 | 23 |
| LYD262 | 61340.1 | 7.4 | L | 37 | 152.9 | L | 73 |
| LYD262 | 61341.2 | 6.3 | 0.12 | 17 | 104.0 | 0.24 | 18 |
| LYD262 | 61342.2 | 7.6 | 0.01 | 39 | 117.7 | 0.01 | 33 |
| LYD259 | 61301.1 | 6.9 | 0.03 | 26 | 114.8 | 0.03 | 30 |
| LYD259 | 61302.3 | 6.3 | 0.12 | 16 | — | — | — |
| LYD259 | 61302.6 | 7.8 | 0.27 | 45 | 139.7 | 0.19 | 58 |
| LYD230 | 61332.1 | — | — | — | 102.8 | 0.22 | 16 |
| LYD230 | 61332.3 | — | — | — | 95.5 | 0.27 | 8 |
| LYD230 | 61333.4 | — | — | — | 111.3 | 0.12 | 26 |
| LYD222 | 61327.3 | — | — | — | 106.3 | 0.17 | 20 |
| LYD222 | 61329.3 | 6.0 | 0.18 | 10 | — | — | — |
| LYD187 | 61312.4 | 6.7 | 0.02 | 23 | — | — | — |
| LYD152 | 61352.4 | 6.6 | L | 22 | 113.2 | L | 28 |
| LYD152 | 61355.3 | 6.8 | L | 26 | 126.9 | 0.03 | 44 |
| LYD150 | 61324.1 | — | — | — | 105.6 | 0.24 | 19 |
| LYD150 | 61324.2 | — | — | — | 108.9 | 0.13 | 23 |
| LYD150 | 61326.1 | 6.5 | 0.10 | 20 | 108.8 | 0.02 | 23 |
| LYD108 | 61294.1 | 9.7 | L | 79 | 151.6 | L | 71 |
| LYD108 | 61294.4 | 9.3 | L | 71 | 159.0 | 0.01 | 80 |
| LYD108 | 61297.2 | 10.8 | L | 99 | 169.8 | L | 92 |
| LYD108 | 61297.4 | 9.7 | 0.03 | 79 | 153.7 | L | 74 |
| CONT. | — | 5.4 | — | — | 88.4 | — | — |
| LYD99 | 60328.6 | 5.3 | 0.07 | 27 | 95.1 | 0.06 | 17 |
| LYD78 | 60359.4 | — | — | — | 91.2 | 0.16 | 12 |
| LYD78 | 60362.4 | 8.4 | 0.05 | 103 | 150.0 | 0.04 | 85 |
| LYD73 | 60368.4 | 5.3 | 0.06 | 27 | 100.4 | 0.18 | 24 |
| LYD47 | 60301.4 | 10.3 | 0.14 | 148 | 195.4 | 0.12 | 141 |
| LYD3 | 60372.4 | 8.3 | 0.03 | 102 | 137.7 | 0.04 | 70 |
| LYD3 | 60375.1 | — | — | — | 102.2 | 0.03 | 26 |

TABLE 33-continued

Genes showing improved plant performance at Normal growth conditions under regulation of 6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD264 | 61526.1 | 10.2 | L | 147 | 194.2 | L | 139 |
| LYD264 | 61526.3 | 8.7 | L | 109 | 167.6 | 0.03 | 106 |
| LYD264 | 61527.4 | 8.5 | L | 105 | 145.9 | L | 80 |
| LYD264 | 61529.3 | 4.8 | 0.07 | 16 | 95.8 | 0.02 | 18 |
| LYD264 | 61530.4 | 5.4 | 0.30 | 30 | 108.3 | 0.18 | 33 |
| LYD262 | 61340.1 | 5.2 | 0.24 | 26 | 108.7 | 0.01 | 34 |
| LYD262 | 61341.2 | 6.6 | 0.11 | 58 | 142.3 | L | 75 |
| LYD262 | 61342.1 | 7.3 | 0.07 | 77 | 159.0 | 0.06 | 96 |
| LYD262 | 61342.2 | 6.3 | 0.05 | 53 | 126.5 | 0.10 | 56 |
| LYD262 | 61342.3 | 4.9 | 0.27 | 17 | 97.4 | L | 20 |
| LYD261 | 61521.4 | 9.1 | 0.17 | 120 | 174.4 | 0.12 | 115 |
| LYD261 | 61522.2 | 6.9 | 0.02 | 67 | 137.9 | L | 70 |
| LYD261 | 61522.3 | 6.5 | 0.03 | 57 | 118.4 | 0.03 | 46 |
| LYD261 | 61524.2 | 5.3 | 0.08 | 27 | 111.0 | 0.04 | 37 |
| LYD252 | 61052.4 | 5.2 | 0.09 | 25 | 102.9 | L | 27 |
| LYD252 | 61052.5 | — | — | — | 106.7 | 0.01 | 31 |
| LYD252 | 61054.1 | — | — | — | 103.2 | 0.03 | 27 |
| LYD252 | 61055.2 | 6.7 | 0.16 | 61 | 150.7 | 0.14 | 85 |
| LYD229 | 60336.3 | 7.6 | 0.09 | 84 | 156.2 | 0.06 | 92 |
| LYD229 | 60337.1 | 8.0 | 0.01 | 92 | 172.9 | L | 113 |
| LYD229 | 60337.2 | 8.9 | 0.06 | 115 | 179.2 | 0.06 | 121 |
| LYD229 | 60338.4 | 13.9 | 0.03 | 236 | 249.0 | 0.03 | 207 |
| LYD229 | 60339.4 | 8.0 | 0.08 | 94 | 154.0 | 0.02 | 90 |
| LYD132 | 60353.3 | 11.4 | L | 174 | 207.2 | L | 155 |
| LYD132 | 60356.2 | 6.8 | 0.18 | 65 | 125.1 | 0.08 | 54 |
| LYD132 | 60357.2 | 7.8 | 0.08 | 89 | 154.7 | L | 90 |
| LYD132 | 60357.3 | 6.3 | L | 53 | 117.6 | L | 45 |
| LYD132 | 60357.4 | 7.8 | 0.02 | 89 | 143.3 | 0.03 | 76 |
| LYD107 | 60341.2 | 9.0 | 0.02 | 117 | 160.4 | 0.02 | 97 |
| LYD107 | 60342.2 | 8.3 | 0.05 | 100 | 171.9 | 0.04 | 112 |
| LYD107 | 60342.3 | 6.6 | 0.30 | 60 | 141.9 | 0.22 | 75 |
| LYD107 | 60342.4 | 8.3 | 0.03 | 102 | 157.0 | L | 93 |
| LYD107 | 60343.3 | 9.4 | 0.05 | 127 | 174.1 | 0.06 | 114 |
| CONT. | — | 4.1 | — | — | 81.2 | — | — |
| LYD85 | 60014.4 | 13.5 | 0.08 | 99 | 245.0 | 0.04 | 90 |
| LYD79 | 60020.4 | 11.1 | 0.03 | 63 | 202.1 | 0.07 | 57 |
| LYD55 | 60174.1 | 12.2 | 0.10 | 80 | 216.6 | 0.08 | 68 |
| LYD55 | 60175.4 | 9.8 | 0.10 | 43 | 162.5 | 0.23 | 26 |
| LYD55 | 60177.2 | 11.1 | 0.08 | 63 | 218.6 | 0.03 | 70 |
| LYD43 | 60610.4 | — | — | — | 171.2 | 0.29 | 33 |
| LYD33 | 60159.3 | 8.1 | 0.08 | 19 | 154.1 | 0.28 | 20 |
| LYD33 | 60160.2 | 9.5 | 0.05 | 39 | 170.3 | 0.04 | 32 |
| LYD235 | 60930.2 | — | — | — | 158.7 | 0.24 | 23 |
| LYD235 | 60930.3 | — | — | — | 157.7 | 0.04 | 22 |
| LYD204 | 60703.1 | 10.1 | 0.05 | 48 | 202.7 | 0.03 | 57 |
| LYD204 | 60704.4 | — | — | — | 178.8 | 0.11 | 39 |
| LYD20 | 60066.2 | 10.6 | L | 55 | 195.0 | 0.02 | 51 |
| LYD20 | 60069.4 | 10.8 | L | 58 | 228.4 | 0.05 | 77 |
| LYD102 | 60960.1 | 9.1 | 0.19 | 34 | 196.1 | 0.10 | 52 |
| CONT. | — | 6.8 | — | — | 128.9 | — | — |
| LYD238 | 60453.2 | 4.9 | 0.21 | 20 | 97.1 | 0.27 | 15 |
| LYD216 | 60331.4 | 8.3 | 0.01 | 102 | 171.2 | L | 102 |
| LYD216 | 60333.3 | 8.6 | 0.13 | 111 | 180.8 | 0.07 | 113 |
| LYD212 | 60522.3 | 5.3 | 0.06 | 30 | 102.2 | 0.03 | 21 |
| LYD211 | 60308.2 | 5.1 | 0.16 | 24 | 103.8 | 0.28 | 23 |
| LYD211 | 60308.3 | 7.6 | 0.01 | 86 | 142.7 | 0.07 | 68 |
| LYD211 | 60309.6 | 5.0 | 0.13 | 22 | 108.9 | 0.14 | 29 |
| LYD209 | 60294.4 | 6.1 | 0.21 | 49 | 141.5 | 0.03 | 67 |
| LYD209 | 60295.4 | 5.8 | 0.06 | 41 | — | — | — |
| LYD209 | 60297.3 | 5.2 | 0.18 | 28 | 118.1 | 0.08 | 39 |
| LYD209 | 60297.4 | 10.1 | 0.21 | 147 | 198.9 | 0.17 | 135 |
| LYD206 | 60491.5 | 4.8 | 0.05 | 18 | 116.3 | 0.06 | 37 |
| LYD206 | 60492.1 | 5.5 | 0.01 | 35 | 112.6 | 0.16 | 33 |
| LYD206 | 60492.3 | — | — | — | 98.4 | 0.12 | 16 |
| LYD201 | 60168.2 | 6.8 | 0.15 | 65 | 148.3 | 0.11 | 75 |
| LYD201 | 60168.4 | 6.9 | L | 68 | 131.0 | 0.11 | 55 |
| LYD196 | 60569.3 | 4.9 | 0.21 | 19 | 100.2 | 0.05 | 18 |
| LYD177 | 60573.2 | 5.1 | 0.13 | 24 | 105.9 | 0.03 | 25 |
| LYD177 | 60574.3 | 6.1 | 0.22 | 50 | 128.4 | 0.10 | 52 |
| LYD167 | 60472.1 | 5.3 | 0.28 | 30 | — | — | — |
| LYD167 | 60473.3 | 4.7 | 0.14 | 15 | 99.3 | 0.23 | 17 |
| LYD149 | 60513.3 | 5.1 | 0.13 | 24 | — | — | — |
| LYD120 | 60882.1 | — | — | — | 112.2 | 0.06 | 32 |

TABLE 33-continued

Genes showing improved plant performance at Normal growth conditions under regulation of 6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD120 | 60882.3 | 5.2 | 0.08 | 28 | 104.6 | 0.06 | 24 |
| LYD120 | 60883.2 | 5.6 | 0.05 | 38 | 112.8 | 0.07 | 33 |
| LYD120 | 60884.1 | 4.9 | 0.07 | 20 | — | — | — |
| LYD1 | 61685.1 | — | — | — | 126.4 | 0.10 | 49 |
| LYD1 | 61686.3 | 5.5 | 0.15 | 36 | 115.5 | 0.06 | 36 |
| CONT. | — | 4.1 | — | — | 84.7 | — | — |
| LYD200 | 60481.2 | 9.6 | 0.03 | 86 | 169.9 | 0.05 | 68 |
| LYD200 | 60482.1 | 8.6 | 0.03 | 65 | 180.2 | 0.02 | 78 |
| LYD200 | 60485.2 | 6.4 | L | 23 | 117.7 | 0.02 | 17 |
| LYD158 | 60581.4 | 10.1 | 0.03 | 95 | 194.2 | 0.04 | 92 |
| LYD153 | 60697.3 | 10.2 | 0.10 | 98 | 221.1 | 0.13 | 119 |
| LYD153 | 60698.3 | 10.5 | 0.04 | 103 | 191.5 | 0.08 | 90 |
| LYD153 | 60700.3 | 7.4 | 0.19 | 43 | 150.3 | 0.09 | 49 |
| LYD148 | 60432.4 | 10.2 | 0.07 | 98 | 210.8 | 0.02 | 109 |
| LYD144 | 60864.2 | 7.2 | 0.09 | 39 | 163.5 | 0.13 | 62 |
| LYD144 | 60866.1 | 5.7 | 0.28 | 10 | — | — | — |
| LYD144 | 60866.4 | 6.6 | 0.06 | 27 | 135.0 | L | 34 |
| LYD129 | 60792.1 | 6.9 | 0.02 | 33 | 117.5 | 0.11 | 16 |
| LYD127 | 60681.1 | 7.6 | 0.05 | 48 | 158.5 | 0.02 | 57 |
| LYD127 | 60682.3 | 8.2 | 0.02 | 58 | 148.4 | 0.06 | 47 |
| LYD127 | 60683.1 | 6.2 | 0.06 | 20 | — | — | — |
| LYD101 | 60072.4 | 9.3 | 0.15 | 80 | 170.7 | 0.13 | 69 |
| LYD101 | 60072.8 | 9.2 | 0.14 | 78 | 158.3 | 0.15 | 57 |
| LYD101 | 60076.4 | 8.9 | 0.04 | 73 | 153.4 | 0.01 | 52 |
| CONT. | — | 5.2 | — | — | 101.0 | — | — |
| LYM275 | 13192.1 | 0.01 | 0.07 | 1.06 | 0.11 | L | 0.67 |
| LYM275 | 13192.11 | 0.01 | 0.15 | 0.73 | 0.12 | 0.05 | 0.81 |
| LYM275 | 13193.1 | — | — | — | 0.09 | 0.05 | 0.26 |
| LYM275 | 13193.15 | 0.01 | 0.06 | 0.70 | 0.12 | 0.02 | 0.81 |
| LYM275 | 13193.17 | 0.00 | 0.04 | 0.24 | 0.09 | 0.04 | 0.26 |

Table 33.
"CONT."—Control;
"Ave"—Average
"% Incr." = % increment;
"p-val."—p-value,
L—p < 0.01.
Values are provided per plant.

The genes presented in Tables 34 and 35 showed a significant improvement in plant performance since they produced a larger leaf biomass (leaf area) and root biomass (root length and root coverage) (Table 34) and a higher relative growth rate of leaf area, root coverage and root length (Table 35) when grown under normal nitrogen growth conditions, compared to control plants. Plants producing larger root biomass have better possibilities to absorb larger amount of nitrogen from soil. Plants producing larger leaf biomass have better ability to produce assimilates). The genes were cloned under the regulation of a constitutive promoter (At6669) or root preferred promoter (RootP). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant

TABLE 34

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD58 | 61306.2 | 0.6 | 0.11 | 43 | 8.5 | L | 72 | 7.2 | L | 21 |
| LYD58 | 61306.6 | 0.5 | 0.12 | 21 | — | — | — | — | — | — |
| LYD58 | 61307.3 | 0.6 | L | 52 | 7.0 | L | 42 | 7.0 | 0.08 | 17 |
| LYD58 | 61308.2 | 0.7 | L | 72 | 7.9 | 0.07 | 60 | 6.9 | L | 15 |
| LYD283 | 61317.4 | 0.6 | 0.03 | 50 | 6.2 | 0.04 | 26 | 6.5 | 0.12 | 9 |
| LYD283 | 61319.3 | 0.6 | 0.03 | 49 | 6.8 | 0.04 | 38 | 6.8 | 0.11 | 14 |
| LYD283 | 61320.1 | 0.6 | 0.03 | 44 | — | — | — | — | — | — |
| LYD283 | 61320.2 | 0.5 | 0.16 | 10 | — | — | — | 6.3 | 0.27 | 5 |
| LYD283 | 61320.4 | — | — | — | 7.5 | 0.07 | 51 | — | — | — |
| LYD270 | 61370.1 | — | — | — | — | — | — | 6.4 | 0.20 | 7 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD270 | 61370.4 | 0.7 | L | 69 | 6.7 | 0.04 | 35 | — | — | — |
| LYD270 | 61373.1 | 0.4 | 0.29 | 7 | — | — | — | — | — | — |
| LYD260 | 61364.4 | 0.6 | 0.08 | 46 | 7.6 | 0.02 | 53 | 7.0 | 0.02 | 17 |
| LYD260 | 61365.3 | 0.7 | L | 68 | 9.4 | 0.02 | 90 | 6.8 | 0.15 | 14 |
| LYD260 | 61365.4 | 0.6 | L | 49 | 8.2 | L | 67 | 6.6 | 0.03 | 11 |
| LYD260 | 61365.6 | 0.5 | 0.29 | 26 | 6.8 | 0.06 | 37 | 6.8 | 0.14 | 13 |
| LYD260 | 61368.1 | 0.5 | 0.02 | 21 | 5.5 | 0.29 | 12 | 6.8 | 0.04 | 13 |
| LYD259 | 61301.2 | — | — | — | 6.3 | 0.12 | 27 | — | — | — |
| LYD259 | 61302.3 | — | — | — | 6.1 | 0.18 | 25 | — | — | — |
| LYD259 | 61302.6 | 0.6 | L | 42 | 5.4 | 0.27 | 10 | — | — | — |
| LYD230 | 61333.4 | 0.6 | L | 38 | 6.1 | 0.01 | 24 | 6.3 | 0.16 | 6 |
| LYD230 | 61334.5 | 0.5 | 0.17 | 29 | 6.7 | 0.21 | 35 | — | — | — |
| LYD230 | 61335.2 | 0.5 | L | 28 | — | — | — | — | — | — |
| LYD222 | 61327.3 | — | — | — | 6.0 | 0.29 | 22 | — | — | — |
| LYD222 | 61327.4 | 0.5 | 0.05 | 27 | — | — | — | — | — | — |
| LYD222 | 61329.2 | 0.6 | 0.07 | 48 | — | — | — | — | — | — |
| LYD222 | 61329.3 | 0.6 | 0.03 | 53 | 7.6 | L | 53 | 6.8 | 0.01 | 13 |
| LYD21 | 61358.1 | 0.6 | 0.02 | 49 | 9.2 | L | 85 | 7.2 | L | 20 |
| LYD21 | 61360.1 | 0.7 | L | 81 | 6.7 | L | 35 | 6.3 | 0.27 | 5 |
| LYD21 | 61362.1 | 0.7 | 0.03 | 77 | 10.0 | 0.02 | 103 | 7.1 | L | 18 |
| LYD21 | 61362.3 | 0.7 | L | 64 | 6.8 | 0.06 | 39 | — | — | — |
| LYD21 | 61362.4 | 0.5 | 0.05 | 29 | 6.5 | L | 31 | 6.7 | 0.03 | 11 |
| LYD187 | 61312.4 | 0.5 | 0.06 | 22 | — | — | — | — | — | — |
| LYD187 | 61313.2 | 0.5 | 0.23 | 14 | 7.3 | 0.02 | 47 | 6.5 | 0.20 | 8 |
| LYD187 | 61314.2 | 0.5 | 0.05 | 24 | 6.4 | L | 30 | — | — | — |
| LYD187 | 61314.4 | — | — | — | — | — | — | 6.5 | 0.26 | 8 |
| LYD152 | 61352.1 | 0.5 | 0.10 | 23 | — | — | — | — | — | — |
| LYD152 | 61352.4 | 0.6 | L | 54 | 8.0 | L | 62 | 6.7 | 0.05 | 13 |
| LYD152 | 61352.5 | — | — | — | 6.2 | 0.16 | 26 | 6.6 | 0.07 | 10 |
| LYD152 | 61352.7 | — | — | — | — | — | — | 6.4 | 0.29 | 6 |
| LYD152 | 61355.3 | 0.7 | 0.07 | 64 | 7.8 | 0.01 | 57 | 6.4 | 0.15 | 6 |
| LYD150 | 61323.2 | 0.6 | L | 39 | 7.4 | 0.06 | 49 | 6.6 | 0.06 | 11 |
| LYD150 | 61324.1 | — | — | — | 5.8 | 0.27 | 18 | — | — | — |
| LYD150 | 61324.2 | 0.7 | L | 72 | 8.8 | L | 79 | 6.8 | 0.03 | 14 |
| LYD150 | 61325.4 | — | — | — | — | — | — | 6.5 | 0.18 | 9 |
| LYD150 | 61326.1 | 0.7 | L | 59 | 7.4 | 0.02 | 51 | 7.3 | L | 22 |
| LYD126 | 61376.1 | 0.6 | 0.03 | 35 | 8.6 | L | 73 | 6.9 | L | 16 |
| LYD126 | 61377.3 | 0.6 | L | 33 | 6.5 | L | 32 | 6.5 | 0.09 | 8 |
| LYD126 | 61380.2 | 0.5 | 0.18 | 19 | — | — | — | — | — | — |
| LYD115 | 61346.2 | 0.6 | 0.11 | 49 | 6.7 | 0.09 | 36 | 6.9 | L | 16 |
| LYD115 | 61349.1 | 0.5 | 0.12 | 22 | 5.8 | 0.24 | 17 | — | — | — |
| LYD115 | 61349.2 | 0.5 | 0.18 | 18 | 7.1 | L | 43 | 6.7 | 0.05 | 12 |
| LYD115 | 61350.3 | 0.5 | 0.25 | 20 | 5.5 | 0.24 | 11 | — | — | — |
| LYD114 | 61383.6 | — | — | — | 6.9 | L | 39 | 6.8 | 0.03 | 14 |
| LYD108 | 61294.1 | 0.6 | L | 43 | — | — | — | — | — | — |
| LYD108 | 61294.4 | 0.7 | L | 72 | — | — | — | — | — | — |
| LYD108 | 61295.1 | 0.7 | 0.04 | 68 | — | — | — | — | — | — |
| LYD108 | 61296.1 | 0.7 | L | 80 | 6.1 | 0.07 | 23 | — | — | — |
| LYD108 | 61297.2 | 0.7 | 0.04 | 68 | — | — | — | — | — | — |
| CONT. | — | 0.4 | — | — | 4.9 | — | — | 6.0 | — | — |
| LYD95 | 61199.1 | 0.6 | L | 31 | 10.5 | 0.01 | 57 | 7.1 | L | 22 |
| LYD95 | 61199.2 | — | — | — | 9.7 | 0.08 | 46 | 6.7 | L | 16 |
| LYD95 | 61201.3 | 0.5 | 0.09 | 21 | — | — | — | — | — | — |
| LYD95 | 61202.2 | 0.5 | 0.25 | 22 | 8.6 | 0.12 | 29 | 6.3 | 0.06 | 10 |
| LYD95 | 61202.3 | — | — | — | — | — | — | 7.2 | 0.01 | 25 |
| LYD61 | 61659.4 | — | — | — | 9.2 | L | 38 | 6.6 | 0.02 | 15 |
| LYD61 | 61660.1 | 0.6 | 0.01 | 42 | — | — | — | 6.5 | 0.12 | 12 |
| LYD61 | 61660.3 | — | — | — | 10.3 | L | 55 | 7.3 | L | 26 |
| LYD61 | 61660.4 | — | — | — | 7.6 | 0.27 | 14 | 6.6 | 0.01 | 14 |
| LYD61 | 61661.1 | 0.7 | 0.08 | 65 | 14.2 | L | 113 | 7.4 | L | 27 |
| LYD286 | 61700.2 | — | — | — | 8.7 | L | 31 | 6.9 | L | 20 |
| LYD286 | 61701.2 | — | — | — | — | — | — | 6.0 | 0.24 | 4 |
| LYD286 | 61701.4 | — | — | — | — | — | — | 6.4 | 0.03 | 11 |
| LYD286 | 61703.3 | — | — | — | 8.5 | L | 27 | 6.4 | 0.02 | 11 |
| LYD282 | 61664.2 | — | — | — | 9.2 | L | 38 | 6.3 | 0.12 | 9 |
| LYD282 | 61664.3 | 0.6 | 0.02 | 35 | 8.7 | 0.02 | 31 | 6.4 | 0.02 | 11 |
| LYD282 | 61665.3 | 0.6 | 0.02 | 41 | 11.2 | 0.02 | 68 | 7.1 | 0.01 | 22 |
| LYD282 | 61665.4 | 0.7 | L | 63 | 11.8 | 0.02 | 77 | 6.7 | 0.05 | 16 |
| LYD282 | 61666.1 | 0.7 | 0.09 | 51 | — | — | — | — | — | — |
| LYD271_H0 | 61876.4 | 0.5 | 0.23 | 19 | 11.8 | L | 77 | 7.3 | L | 26 |
| LYD271_H0 | 61876.5 | — | — | — | 9.1 | 0.03 | 37 | 6.1 | 0.22 | 6 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD271_H0 | 61877.1 | 0.5 | 0.16 | 20 | 8.2 | 0.11 | 24 | — | — | — |
| LYD271_H0 | 61878.2 | — | — | — | 9.6 | 0.06 | 44 | 7.1 | 0.02 | 23 |
| LYD271_H0 | 61879.3 | 0.5 | 0.15 | 20 | 9.4 | 0.05 | 40 | 6.4 | 0.09 | 11 |
| LYD270 | 61370.1 | — | — | — | 9.1 | 0.07 | 37 | 6.6 | 0.19 | 15 |
| LYD270 | 61373.1 | — | — | — | 8.1 | 0.02 | 21 | — | — | — |
| LYD270 | 61374.2 | 0.6 | 0.23 | 29 | 10.9 | 0.02 | 64 | 6.9 | 0.01 | 19 |
| LYD261 | 61521.2 | 0.5 | 0.04 | 22 | 8.5 | 0.10 | 27 | — | — | — |
| LYD261 | 61521.4 | 0.6 | 0.02 | 35 | 7.6 | 0.24 | 14 | 6.5 | 0.08 | 12 |
| LYD261 | 61522.2 | — | — | — | 7.6 | 0.01 | 14 | 6.3 | 0.03 | 10 |
| LYD261 | 61523.2 | — | — | — | 9.2 | 0.11 | 38 | 6.6 | 0.10 | 14 |
| LYD260 | 61364.4 | — | — | — | — | — | — | 6.3 | 0.18 | 9 |
| LYD260 | 61365.3 | 0.8 | 0.09 | 73 | 12.0 | 0.04 | 80 | 7.1 | 0.05 | 23 |
| LYD260 | 61365.4 | — | — | — | 7.6 | 0.15 | 15 | 6.5 | 0.02 | 13 |
| LYD260 | 61365.6 | 0.5 | 0.26 | 10 | 10.5 | L | 57 | 7.6 | L | 32 |
| LYD260 | 61368.1 | 0.6 | 0.22 | 30 | 10.5 | 0.03 | 58 | 6.8 | 0.04 | 17 |
| LYD231 | 60715.1 | — | — | — | 7.6 | 0.15 | 13 | — | — | — |
| LYD231 | 60717.2 | — | — | — | 9.2 | 0.08 | 38 | 6.6 | L | 15 |
| LYD231 | 60718.1 | 0.8 | 0.02 | 75 | 10.2 | 0.08 | 52 | — | — | — |
| LYD231 | 60719.1 | 0.7 | L | 56 | 10.1 | L | 51 | 6.8 | L | 17 |
| LYD223 | 61193.3 | 0.6 | L | 25 | 10.0 | 0.07 | 49 | 7.0 | L | 21 |
| LYD223 | 61194.2 | 0.7 | 0.02 | 46 | 8.2 | L | 23 | 6.3 | 0.12 | 9 |
| LYD223 | 61194.4 | — | — | — | 8.1 | 0.17 | 22 | 6.8 | L | 17 |
| LYD223 | 61195.3 | 0.6 | 0.24 | 26 | 10.1 | 0.01 | 52 | 6.2 | 0.28 | 7 |
| LYD223 | 61196.3 | 0.7 | L | 67 | 11.5 | 0.02 | 72 | 7.2 | L | 24 |
| LYD21 | 61358.1 | 0.6 | 0.04 | 25 | 11.2 | 0.02 | 68 | 7.1 | L | 24 |
| LYD21 | 61362.1 | 0.6 | 0.05 | 44 | 10.1 | 0.06 | 52 | 6.6 | 0.01 | 14 |
| LYD21 | 61362.3 | — | — | — | 8.5 | 0.05 | 27 | 7.1 | L | 23 |
| LYD21 | 61362.4 | — | — | — | — | — | — | 6.6 | 0.05 | 14 |
| LYD126 | 61376.1 | 0.7 | 0.02 | 49 | 10.2 | 0.01 | 53 | 6.9 | L | 19 |
| LYD126 | 61377.3 | — | — | — | — | — | — | 6.3 | 0.05 | 9 |
| LYD126 | 61380.1 | 0.6 | L | 43 | — | — | — | — | — | — |
| LYD126 | 61380.2 | 0.6 | 0.04 | 30 | 9.0 | 0.02 | 35 | — | — | — |
| LYD124_H7 | 61871.2 | — | — | — | 10.1 | 0.05 | 51 | 7.0 | L | 21 |
| LYD124_H7 | 61871.4 | — | — | — | 10.4 | L | 56 | 7.1 | L | 22 |
| LYD124_H7 | 61874.1 | — | — | — | 10.7 | L | 61 | 7.3 | L | 27 |
| LYD114 | 61383.1 | 0.7 | 0.02 | 54 | 11.3 | 0.05 | 69 | 6.8 | 0.06 | 17 |
| LYD114 | 61383.3 | 0.7 | 0.03 | 46 | 11.1 | 0.02 | 67 | 6.9 | 0.04 | 19 |
| LYD114 | 61383.6 | 0.6 | 0.03 | 28 | 10.8 | 0.02 | 61 | 7.1 | L | 23 |
| LYD114 | 61384.2 | 0.6 | 0.11 | 32 | 8.6 | 0.03 | 28 | — | — | — |
| LYD114 | 61385.2 | 0.6 | 0.20 | 25 | 10.9 | 0.04 | 64 | 7.4 | L | 28 |
| CONT. | — | 0.4 | — | — | 6.7 | — | — | 5.8 | — | — |
| LYD92 | 60583.3 | — | — | — | 10.3 | 0.06 | 28 | 7.1 | L | 12 |
| LYD92 | 60585.1 | — | — | — | 9.6 | 0.01 | 19 | 6.8 | 0.05 | 7 |
| LYD92 | 60586.2 | — | — | — | 9.6 | 0.06 | 19 | 7.2 | L | 14 |
| LYD92 | 60586.4 | — | — | — | 9.8 | 0.04 | 22 | 6.8 | 0.21 | 7 |
| LYD92 | 60587.3 | 0.6 | 0.11 | 17 | 12.1 | L | 51 | 8.0 | L | 27 |
| LYD66 | 60114.1 | — | — | — | 10.5 | L | 30 | 7.4 | 0.01 | 17 |
| LYD66 | 60114.3 | — | — | — | 9.9 | 0.14 | 23 | 6.9 | 0.07 | 10 |
| LYD66 | 60117.1 | — | — | — | 10.5 | 0.16 | 31 | 7.0 | 0.08 | 11 |
| LYD66 | 60117.2 | — | — | — | 9.1 | 0.21 | 13 | 7.0 | L | 11 |
| LYD66 | 60118.1 | — | — | — | — | — | — | 6.9 | 0.16 | 9 |
| LYD57 | 61652.2 | — | — | — | 10.1 | 0.07 | 26 | 7.4 | L | 17 |
| LYD57 | 61653.2 | — | — | — | — | — | — | 6.8 | 0.22 | 9 |
| LYD57 | 61654.3 | — | — | — | 9.2 | 0.01 | 14 | 7.3 | L | 15 |
| LYD57 | 61655.2 | — | — | — | 11.3 | L | 40 | 7.1 | L | 13 |
| LYD57 | 61655.3 | — | — | — | 10.3 | 0.14 | 28 | 7.5 | 0.02 | 18 |
| LYD50 | 60601.1 | 0.6 | 0.17 | 25 | 10.5 | 0.22 | 30 | 7.1 | L | 12 |
| LYD50 | 60603.3 | — | — | — | — | — | — | 7.1 | L | 12 |
| LYD50 | 60604.2 | — | — | — | 10.4 | L | 30 | 7.1 | L | 13 |
| LYD50 | 60604.3 | — | — | — | 10.2 | 0.11 | 27 | 6.8 | 0.06 | 8 |
| LYD271_H0 | 61878.2 | — | — | — | 10.8 | 0.02 | 34 | 7.2 | L | 15 |
| LYD271_H0 | 61879.3 | — | — | — | 8.6 | 0.29 | 7 | 7.0 | 0.04 | 10 |
| LYD266 | 60615.3 | — | — | — | 9.3 | 0.11 | 16 | 7.4 | L | 18 |
| LYD266 | 60616.2 | — | — | — | 9.4 | 0.21 | 17 | — | — | — |
| LYD266 | 60617.2 | — | — | — | 8.9 | 0.29 | 10 | — | — | — |
| LYD25 | 60589.4 | 0.6 | 0.17 | 28 | 11.8 | 0.03 | 46 | 7.9 | L | 25 |
| LYD25 | 60591.2 | — | — | — | 9.2 | 0.21 | 14 | — | — | — |
| LYD25 | 60592.4 | — | — | — | — | — | — | 6.8 | 0.18 | 8 |
| LYD124_H7 | 61870.2 | — | — | — | 8.7 | 0.07 | 8 | 7.1 | 0.04 | 12 |
| LYD124_H7 | 61871.2 | — | — | — | 9.4 | 0.05 | 16 | 7.1 | 0.03 | 13 |
| LYD124_H7 | 61874.2 | — | — | — | 9.5 | 0.13 | 18 | 6.8 | 0.16 | 8 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.5 | — | — | 8.1 | — | — | 6.3 | — | — |
| LYM104 | 12914.1 | 0.8 | L | 81 | 9.1 | 0.11 | 35 | — | — | — |
| LYM104 | 12914.14 | 0.8 | 0.01 | 63 | — | — | — | — | — | — |
| LYD88 | 61706.3 | 0.6 | 0.08 | 20 | 10.0 | 0.05 | 48 | 7.3 | 0.01 | 22 |
| LYD88 | 61707.3 | — | — | — | 8.6 | 0.18 | 27 | 7.2 | 0.01 | 20 |
| LYD88 | 61707.4 | — | — | — | — | — | — | 6.4 | 0.28 | 7 |
| LYD88 | 61709.1 | 0.6 | 0.02 | 34 | 9.3 | 0.04 | 38 | 6.5 | 0.08 | 10 |
| LYD84 | 61133.4 | 0.6 | 0.10 | 32 | 9.5 | 0.18 | 40 | 6.8 | 0.18 | 14 |
| LYD84 | 61134.1 | 0.7 | 0.15 | 50 | 10.0 | 0.12 | 48 | 7.3 | L | 21 |
| LYD84 | 61134.3 | 0.9 | 0.02 | 88 | 11.1 | 0.10 | 65 | 7.0 | 0.03 | 18 |
| LYD84 | 61134.4 | 0.7 | 0.28 | 48 | — | — | — | 6.6 | 0.26 | 10 |
| LYD84 | 61135.2 | 0.6 | 0.05 | 32 | 9.2 | 0.15 | 37 | 7.0 | 0.03 | 17 |
| LYD72 | 61163.3 | — | — | — | — | — | — | 6.8 | 0.09 | 13 |
| LYD72 | 61164.1 | 0.6 | 0.21 | 34 | — | — | — | 6.6 | 0.12 | 11 |
| LYD72 | 61164.3 | 0.7 | 0.01 | 48 | — | — | — | 6.4 | 0.29 | 7 |
| LYD72 | 61165.4 | 0.5 | 0.10 | 15 | — | — | — | 6.8 | 0.05 | 13 |
| LYD72 | 61166.4 | 0.6 | 0.26 | 23 | — | — | — | 6.4 | 0.23 | 7 |
| LYD63 | 61228.2 | 0.6 | 0.05 | 29 | 8.4 | 0.24 | 24 | 7.2 | L | 21 |
| LYD63 | 61229.8 | 0.6 | 0.27 | 24 | — | — | — | — | — | — |
| LYD63 | 61231.1 | 0.7 | 0.14 | 43 | — | — | — | 6.4 | 0.21 | 7 |
| LYD286 | 61700.2 | 0.5 | 0.23 | 18 | 10.2 | L | 51 | 6.9 | 0.01 | 15 |
| LYD286 | 61701.2 | — | — | — | 8.8 | 0.27 | 31 | 6.7 | 0.20 | 12 |
| LYD286 | 61701.4 | 0.6 | 0.14 | 25 | 7.9 | 0.29 | 16 | 6.6 | 0.10 | 10 |
| LYD286 | 61703.2 | 0.6 | 0.19 | 31 | 10.2 | 0.02 | 52 | 6.6 | 0.09 | 11 |
| LYD286 | 61703.3 | — | — | — | — | — | — | 6.3 | 0.25 | 6 |
| LYD28 | 61713.2 | 0.5 | 0.14 | 16 | 9.0 | 0.18 | 34 | 6.8 | 0.02 | 15 |
| LYD28 | 61716.2 | 0.7 | 0.13 | 41 | 10.1 | 0.06 | 49 | 7.4 | L | 25 |
| LYD268 | 61151.4 | — | — | — | 8.3 | 0.21 | 23 | 6.8 | 0.06 | 14 |
| LYD268 | 61152.3 | 0.6 | 0.28 | 29 | 10.3 | 0.10 | 53 | 7.5 | L | 25 |
| LYD268 | 61153.3 | 0.6 | 0.02 | 26 | 8.4 | 0.19 | 24 | 7.3 | L | 23 |
| LYD268 | 61153.6 | 0.6 | 0.04 | 28 | 8.1 | 0.20 | 20 | 6.7 | 0.04 | 13 |
| LYD26 | 61168.1 | 0.6 | 0.02 | 22 | 9.0 | 0.16 | 33 | 6.7 | 0.12 | 13 |
| LYD26 | 61169.3 | 0.6 | L | 37 | — | — | — | 6.8 | 0.13 | 15 |
| LYD26 | 61171.1 | 0.5 | 0.03 | 17 | — | — | — | — | — | — |
| LYD157 | 61156.1 | — | — | — | — | — | — | 6.6 | 0.09 | 11 |
| LYD157 | 61156.3 | 0.5 | 0.22 | 16 | 8.8 | 0.15 | 31 | 6.9 | 0.01 | 15 |
| LYD157 | 61158.1 | 0.6 | L | 32 | 9.9 | L | 47 | 7.2 | L | 21 |
| LYD157 | 61158.5 | 0.7 | 0.05 | 50 | 8.7 | 0.14 | 29 | 7.2 | 0.01 | 20 |
| LYD157 | 61159.3 | — | — | — | — | — | — | 6.6 | 0.07 | 10 |
| LYD115 | 61348.2 | 0.6 | 0.09 | 24 | 9.4 | 0.19 | 39 | 6.7 | 0.15 | 12 |
| LYD115 | 61349.1 | 0.6 | L | 32 | — | — | — | 6.6 | 0.05 | 11 |
| LYD115 | 61349.2 | — | — | — | — | — | — | 6.8 | 0.06 | 14 |
| LYD115 | 61350.3 | 0.7 | 0.04 | 42 | — | — | — | — | — | — |
| LYD112 | 61144.1 | 0.6 | 0.05 | 29 | — | — | — | — | — | — |
| LYD112 | 61146.5 | 0.6 | 0.23 | 23 | — | — | — | — | — | — |
| LYD109 | 61175.3 | 0.6 | 0.18 | 23 | 10.0 | 0.20 | 48 | 7.1 | L | 20 |
| LYD109 | 61177.4 | — | — | — | — | — | — | 6.5 | 0.18 | 9 |
| LYD109 | 61178.2 | — | — | — | 8.7 | 0.19 | 29 | 7.1 | 0.07 | 18 |
| LYD106 | 61140.2 | 0.6 | 0.19 | 19 | 10.3 | 0.13 | 52 | 7.1 | 0.02 | 19 |
| LYD106 | 61140.4 | 0.7 | 0.05 | 53 | 10.6 | 0.09 | 57 | 7.3 | 0.01 | 22 |
| LYD106 | 61141.1 | 0.6 | 0.05 | 32 | — | — | — | 6.8 | 0.15 | 13 |
| CONT. | — | 0.5 | — | — | 6.7 | — | — | 6.0 | — | — |
| LYD96 | 60283.4 | 0.7 | 0.08 | 81 | 7.2 | 0.18 | 71 | 6.6 | 0.15 | 18 |
| LYD96 | 60285.1 | 0.6 | 0.04 | 57 | 6.8 | L | 63 | 6.3 | 0.06 | 13 |
| LYD96 | 60285.2 | — | — | — | — | — | — | 6.2 | 0.01 | 11 |
| LYD96 | 60286.2 | 0.6 | 0.03 | 52 | 6.7 | L | 59 | — | — | — |
| LYD96 | 60286.3 | 0.8 | 0.16 | 91 | 8.8 | 0.04 | 109 | 7.0 | 0.05 | 24 |
| LYD91 | 60685.6 | 0.7 | L | 81 | 8.6 | L | 104 | 6.4 | 0.02 | 13 |
| LYD91 | 60689.4 | 0.6 | 0.30 | 56 | — | — | — | — | — | — |
| LYD91 | 60690.1 | 0.6 | 0.08 | 44 | 5.8 | 0.12 | 37 | — | — | — |
| LYD71 | 60637.1 | 0.4 | 0.13 | 10 | — | — | — | — | — | — |
| LYD71 | 60637.3 | 0.5 | 0.01 | 33 | — | — | — | — | — | — |
| LYD71 | 60638.1 | 0.8 | L | 103 | 8.7 | 0.05 | 108 | 7.1 | L | 27 |
| LYD71 | 60641.3 | 0.6 | 0.01 | 52 | 6.6 | L | 57 | 6.3 | 0.17 | 12 |
| LYD65 | 60625.3 | 0.5 | 0.24 | 28 | 7.3 | 0.03 | 74 | 7.0 | L | 24 |
| LYD65 | 60625.4 | 0.5 | 0.10 | 33 | 6.5 | 0.04 | 54 | 6.2 | 0.07 | 11 |
| LYD65 | 60626.2 | 0.5 | 0.04 | 29 | 7.1 | 0.02 | 69 | 6.3 | 0.07 | 12 |
| LYD65 | 60629.1 | 0.6 | 0.19 | 40 | 6.2 | 0.29 | 47 | — | — | — |
| LYD65 | 60629.2 | 0.6 | 0.02 | 50 | 6.5 | 0.06 | 54 | — | — | — |
| LYD287 | 60145.1 | 0.7 | 0.19 | 66 | 7.7 | 0.09 | 84 | 6.8 | L | 21 |
| LYD287 | 60145.2 | 0.7 | 0.15 | 72 | 6.6 | 0.11 | 57 | 6.1 | 0.08 | 9 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD287 | 60145.3 | 0.6 | 0.02 | 46 | 7.4 | 0.04 | 76 | 7.1 | L | 27 |
| LYD287 | 60146.1 | 0.6 | 0.03 | 59 | 7.4 | 0.02 | 77 | 6.9 | L | 23 |
| LYD287 | 60148.1 | 0.7 | L | 80 | 8.3 | 0.01 | 99 | 6.7 | 0.02 | 19 |
| LYD232 | 61640.2 | 0.8 | 0.07 | 96 | 6.7 | 0.10 | 59 | — | — | — |
| LYD232 | 61640.3 | 0.5 | L | 20 | — | — | — | — | — | — |
| LYD232 | 61641.1 | 0.8 | L | 91 | 7.7 | L | 84 | 6.3 | 0.13 | 11 |
| LYD232 | 61642.4 | 0.6 | 0.04 | 38 | — | — | — | — | — | — |
| LYD232 | 61643.4 | 0.8 | 0.03 | 89 | 7.7 | 0.10 | 84 | 6.1 | 0.22 | 8 |
| LYD227 | 60547.3 | 0.5 | 0.05 | 25 | — | — | — | 6.7 | 0.04 | 20 |
| LYD227 | 60548.3 | 0.5 | 0.03 | 35 | 7.2 | L | 71 | 6.8 | 0.02 | 21 |
| LYD227 | 60549.3 | 0.6 | 0.11 | 40 | 6.9 | L | 65 | 6.6 | 0.05 | 18 |
| LYD227 | 60551.1 | 0.6 | 0.05 | 52 | 7.0 | 0.04 | 67 | 6.4 | 0.02 | 13 |
| LYD227 | 60551.4 | 0.6 | L | 55 | 6.8 | L | 62 | 6.4 | 0.07 | 14 |
| LYD193 | 60504.2 | — | — | — | 5.0 | 0.08 | 19 | — | — | — |
| LYD193 | 60505.3 | — | — | — | 5.4 | L | 29 | — | — | — |
| LYD193 | 60506.1 | 0.4 | 0.07 | 12 | — | — | — | — | — | — |
| LYD193 | 60506.4 | — | — | — | 5.5 | 0.23 | 31 | — | — | — |
| LYD178 | 61689.2 | 0.5 | 0.06 | 16 | 5.3 | L | 27 | — | — | — |
| LYD178 | 61690.3 | 0.6 | 0.16 | 38 | 5.5 | 0.07 | 32 | 6.5 | 0.09 | 15 |
| LYD178 | 61691.2 | 0.5 | 0.23 | 22 | 4.9 | 0.13 | 16 | — | — | — |
| LYD178 | 61691.4 | — | — | — | — | — | — | 6.3 | L | 12 |
| LYD156 | 60277.4 | 0.6 | 0.10 | 45 | 6.3 | 0.11 | 51 | 6.8 | L | 20 |
| LYD156 | 60280.1 | — | — | — | 4.9 | 0.23 | 16 | — | — | — |
| LYD156 | 60280.4 | — | — | — | 5.7 | 0.26 | 36 | 6.2 | 0.14 | 11 |
| LYD140 | 60383.3 | — | — | — | 6.6 | 0.03 | 57 | 6.8 | 0.02 | 20 |
| LYD136 | 60441.3 | — | — | — | — | — | — | 6.0 | 0.27 | 7 |
| LYD136 | 60443.1 | 0.5 | 0.13 | 19 | 5.1 | 0.11 | 22 | 6.4 | 0.07 | 13 |
| LYD136 | 60444.1 | — | — | — | 5.6 | 0.09 | 34 | 6.3 | 0.16 | 12 |
| LYD136 | 60445.1 | 0.5 | 0.23 | 35 | — | — | — | — | — | — |
| LYD110 | 60391.3 | 0.5 | 0.08 | 29 | 5.3 | 0.17 | 27 | — | — | — |
| LYD110 | 60391.4 | 0.6 | L | 53 | 5.2 | 0.21 | 23 | — | — | — |
| LYD110 | 60392.1 | 0.8 | L | 89 | 6.7 | L | 61 | 6.1 | 0.03 | 8 |
| LYD110 | 60394.4 | 0.6 | 0.05 | 51 | 5.4 | 0.03 | 29 | 6.8 | 0.04 | 21 |
| LYD103 | 60258.2 | 0.5 | L | 33 | 6.7 | L | 59 | 6.6 | L | 18 |
| LYD103 | 60261.6 | 0.5 | 0.08 | 34 | 6.1 | 0.07 | 45 | 6.9 | 0.01 | 22 |
| LYD103 | 60261.7 | 0.5 | 0.26 | 14 | 4.9 | 0.05 | 16 | 6.4 | 0.02 | 14 |
| CONT. | — | 0.4 | — | — | 4.2 | — | — | 5.6 | — | — |
| LYD78 | 60359.1 | — | — | — | 9.5 | 0.12 | 28 | — | — | — |
| LYD78 | 60362.4 | — | — | — | — | — | — | 6.8 | 0.23 | 9 |
| LYD73 | 60367.1 | — | — | — | — | — | — | 7.2 | 0.09 | 15 |
| LYD73 | 60367.2 | — | — | — | — | — | — | 6.9 | 0.21 | 10 |
| LYD73 | 60368.4 | — | — | — | 12.0 | 0.09 | 62 | 7.6 | 0.02 | 21 |
| LYD66 | 60114.3 | — | — | — | — | — | — | 6.8 | 0.10 | 8 |
| LYD47 | 60301.1 | — | — | — | 10.6 | 0.07 | 43 | 7.6 | L | 21 |
| LYD47 | 60301.4 | — | — | — | — | — | — | 6.7 | 0.09 | 7 |
| LYD37 | 60165.1 | — | — | — | 8.6 | 0.28 | 17 | 7.1 | 0.12 | 14 |
| LYD3 | 60374.3 | — | — | — | — | — | — | 6.7 | 0.19 | 6 |
| LYD3 | 60375.3 | — | — | — | 10.5 | 0.09 | 42 | 7.7 | 0.01 | 22 |
| LYD236 | 60187.6 | 0.8 | 0.10 | 38 | — | — | — | — | — | — |
| LYD229 | 60338.4 | 0.7 | 0.09 | 25 | 11.3 | L | 53 | 6.8 | 0.07 | 8 |
| LYD221 | 60351.3 | — | — | — | 9.5 | 0.28 | 28 | 7.5 | L | 19 |
| LYD156 | 60277.4 | — | — | — | — | — | — | 6.9 | 0.17 | 11 |
| LYD156 | 60278.2 | — | — | — | — | — | — | 7.4 | 0.02 | 18 |
| LYD156 | 60280.1 | 0.9 | 0.03 | 60 | 11.0 | 0.02 | 48 | 7.7 | L | 23 |
| LYD132 | 60353.3 | 0.7 | 0.29 | 16 | 9.9 | L | 34 | 7.6 | L | 21 |
| LYD132 | 60356.2 | 0.8 | 0.18 | 35 | 9.8 | 0.23 | 32 | — | — | — |
| LYD132 | 60357.2 | — | — | — | — | — | — | 7.2 | 0.06 | 16 |
| LYD132 | 60357.3 | 0.7 | 0.28 | 22 | 11.2 | 0.01 | 51 | 7.0 | 0.03 | 12 |
| LYD132 | 60357.4 | 0.8 | 0.26 | 32 | 10.0 | 0.01 | 35 | 7.0 | L | 12 |
| LYD107 | 60341.2 | — | — | — | 10.7 | 0.07 | 45 | — | — | — |
| LYD107 | 60342.3 | 0.8 | 0.07 | 43 | 11.8 | 0.02 | 60 | 7.3 | L | 16 |
| LYD107 | 60342.4 | — | — | — | — | — | — | 6.8 | 0.19 | 9 |
| LYD107 | 60343.3 | 0.7 | 0.22 | 15 | 10.7 | 0.07 | 44 | 7.2 | 0.03 | 14 |
| CONT. | — | 0.6 | — | — | 7.4 | — | — | 6.3 | — | — |
| LYD90 | 60831.5 | — | — | — | 6.8 | 0.20 | 20 | 6.7 | 0.22 | 12 |
| LYD70 | 60856.2 | — | — | — | 8.2 | 0.20 | 46 | 7.5 | 0.05 | 26 |
| LYD70 | 60856.4 | — | — | — | 9.4 | 0.14 | 66 | 7.5 | 0.05 | 26 |
| LYD228 | 60403.4 | 0.5 | 0.28 | 24 | — | — | — | — | — | — |
| LYD202 | 60421.2 | — | — | — | 7.3 | 0.11 | 29 | — | — | — |
| LYD174 | 60816.4 | 0.8 | 0.14 | 79 | 9.0 | 0.24 | 60 | — | — | — |
| LYD174 | 60818.3 | 0.7 | 0.02 | 69 | — | — | — | — | — | — |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD16 | 60314.1 | — | — | — | 7.4 | 0.06 | 32 | 6.8 | 0.19 | 13 |
| LYD16 | 60314.2 | 0.6 | 0.24 | 30 | 7.5 | 0.09 | 34 | 7.2 | 0.09 | 20 |
| LYD16 | 60315.1 | — | — | — | — | — | — | 7.2 | 0.07 | 20 |
| LYD159 | 60662.3 | 0.7 | 0.06 | 51 | 10.7 | 0.23 | 89 | 7.8 | 0.02 | 31 |
| LYD159 | 60665.1 | — | — | — | 7.9 | 0.29 | 41 | — | — | — |
| LYD159 | 60666.2 | — | — | — | 10.8 | L | 91 | 7.2 | 0.06 | 21 |
| CONT. | — | 0.4 | — | — | 5.6 | — | — | 6.0 | — | — |
| LYD96 | 60285.1 | — | — | — | 6.6 | 0.10 | 33 | 6.6 | L | 20 |
| LYD96 | 60285.2 | 0.7 | 0.09 | 55 | — | — | — | 6.3 | 0.10 | 15 |
| LYD96 | 60285.3 | — | — | — | 9.1 | L | 82 | 7.1 | L | 29 |
| LYD96 | 60286.2 | — | — | — | 5.7 | 0.06 | 14 | — | — | — |
| LYD96 | 60286.3 | 0.9 | 0.02 | 96 | 8.0 | 0.03 | 60 | 6.3 | L | 14 |
| LYD91 | 60685.6 | 0.9 | 0.03 | 92 | 8.8 | 0.02 | 75 | 6.7 | 0.01 | 21 |
| LYD91 | 60689.4 | 0.5 | 0.21 | 10 | 5.9 | 0.26 | 17 | — | — | — |
| LYD91 | 60690.2 | 0.5 | 0.06 | 14 | 6.0 | 0.01 | 20 | 5.9 | 0.25 | 7 |
| LYD71 | 60637.3 | — | — | — | — | — | — | 6.0 | 0.27 | 9 |
| LYD71 | 60641.2 | 0.8 | 0.01 | 79 | 7.4 | 0.02 | 47 | 5.9 | 0.24 | 7 |
| LYD71 | 60641.3 | 0.9 | L | 82 | 7.3 | 0.02 | 45 | 6.1 | 0.04 | 10 |
| LYD65 | 60625.2 | — | — | — | 7.0 | 0.10 | 39 | 6.0 | 0.08 | 9 |
| LYD65 | 60625.3 | — | — | — | 6.8 | L | 36 | 6.3 | 0.01 | 14 |
| LYD65 | 60625.4 | 0.7 | 0.06 | 50 | 7.5 | 0.05 | 49 | — | — | — |
| LYD65 | 60626.2 | 0.7 | 0.01 | 55 | 8.3 | L | 65 | 6.7 | L | 21 |
| LYD287 | 60145.1 | 0.9 | 0.02 | 84 | 8.3 | 0.02 | 66 | 6.5 | 0.06 | 17 |
| LYD287 | 60145.3 | 0.5 | 0.23 | 15 | 7.2 | 0.03 | 43 | 6.3 | L | 15 |
| LYD287 | 60146.1 | — | — | — | 7.0 | 0.14 | 40 | — | — | — |
| LYD287 | 60146.3 | 0.6 | 0.01 | 22 | 7.4 | L | 47 | 6.6 | L | 21 |
| LYD287 | 60148.1 | — | — | — | 5.8 | 0.23 | 16 | 6.3 | L | 14 |
| LYD232 | 61640.2 | 0.5 | 0.29 | 7 | — | — | — | — | — | — |
| LYD232 | 61641.1 | — | — | — | 6.8 | 0.18 | 36 | 6.3 | 0.24 | 15 |
| LYD232 | 61641.4 | 0.7 | 0.11 | 55 | 6.7 | 0.21 | 34 | — | — | — |
| LYD232 | 61642.4 | 0.5 | 0.22 | 13 | — | — | — | — | — | — |
| LYD232 | 61643.4 | 0.6 | 0.19 | 32 | — | — | — | 5.8 | 0.15 | 6 |
| LYD227 | 60547.3 | — | — | — | 7.5 | L | 50 | 7.2 | L | 31 |
| LYD227 | 60548.3 | 0.7 | 0.03 | 54 | 7.4 | L | 47 | 6.4 | 0.04 | 16 |
| LYD227 | 60549.3 | 0.6 | 0.04 | 28 | 8.0 | 0.01 | 59 | 6.7 | L | 21 |
| LYD227 | 60551.1 | 0.6 | L | 33 | 6.9 | L | 37 | 6.0 | 0.03 | 9 |
| LYD227 | 60551.4 | — | — | — | 6.2 | 0.02 | 23 | 6.0 | L | 9 |
| LYD214 | 60127.5 | 0.7 | 0.07 | 49 | 8.3 | 0.02 | 65 | 6.5 | L | 17 |
| LYD214 | 60129.1 | 0.7 | 0.02 | 41 | 5.9 | 0.10 | 17 | 6.2 | 0.02 | 12 |
| LYD214 | 60130.3 | 0.7 | L | 50 | 7.3 | 0.04 | 45 | 6.5 | L | 17 |
| LYD193 | 60504.2 | — | — | — | 5.9 | 0.25 | 18 | 6.1 | L | 12 |
| LYD193 | 60505.2 | — | — | — | — | — | — | 6.3 | 0.03 | 15 |
| LYD193 | 60505.3 | 0.6 | 0.08 | 33 | 5.8 | 0.11 | 15 | 6.1 | 0.07 | 10 |
| LYD193 | 60506.1 | 0.6 | 0.10 | 24 | 6.6 | 0.04 | 32 | 6.6 | L | 20 |
| LYD193 | 60506.4 | 0.5 | 0.26 | 16 | 6.3 | 0.10 | 26 | 6.0 | 0.23 | 8 |
| LYD178 | 61689.2 | 0.6 | 0.05 | 39 | 7.5 | L | 50 | 6.7 | L | 21 |
| LYD178 | 61690.1 | — | — | — | 6.5 | 0.13 | 30 | 6.4 | 0.04 | 16 |
| LYD178 | 61690.3 | 0.8 | L | 63 | 6.9 | 0.02 | 37 | — | — | — |
| LYD178 | 61691.2 | 0.7 | 0.05 | 51 | 8.1 | L | 62 | 6.6 | L | 21 |
| LYD178 | 61691.4 | 0.5 | 0.16 | 7 | 7.5 | 0.07 | 49 | 6.8 | 0.02 | 23 |
| LYD148 | 60431.3 | — | — | — | 8.1 | 0.15 | 61 | 6.6 | 0.19 | 20 |
| LYD148 | 60432.1 | — | — | — | 8.0 | 0.06 | 59 | 7.0 | L | 27 |
| LYD148 | 60433.2 | — | — | — | 5.9 | 0.19 | 17 | — | — | — |
| LYD148 | 60434.3 | 0.7 | L | 58 | 7.5 | L | 50 | 6.5 | 0.02 | 18 |
| LYD148 | 60434.4 | — | — | — | 9.0 | 0.03 | 80 | 7.4 | L | 35 |
| LYD140 | 60381.4 | — | — | — | 8.1 | L | 62 | 7.0 | L | 28 |
| LYD140 | 60382.3 | 0.7 | 0.21 | 40 | 7.8 | 0.11 | 55 | 6.6 | 0.03 | 20 |
| LYD140 | 60383.2 | 0.6 | 0.01 | 30 | 7.5 | 0.05 | 51 | 7.2 | L | 31 |
| LYD140 | 60383.3 | 0.8 | 0.05 | 66 | 8.3 | 0.02 | 65 | 7.0 | L | 26 |
| LYD140 | 60384.2 | 0.7 | 0.18 | 45 | 6.1 | 0.20 | 23 | 6.2 | L | 12 |
| LYD136 | 60441.3 | 0.6 | 0.02 | 35 | 7.5 | 0.12 | 50 | 6.4 | 0.11 | 16 |
| LYD136 | 60443.1 | 0.7 | 0.10 | 48 | 6.9 | 0.18 | 38 | 6.2 | 0.10 | 13 |
| LYD136 | 60444.1 | — | — | — | 6.5 | 0.21 | 30 | 6.3 | L | 14 |
| LYD136 | 60444.3 | — | — | — | 7.6 | 0.10 | 51 | 6.7 | L | 23 |
| LYD110 | 60391.2 | 0.7 | 0.25 | 56 | — | — | — | — | — | — |
| LYD110 | 60392.1 | 0.8 | 0.10 | 61 | 7.8 | 0.22 | 55 | 6.4 | 0.06 | 16 |
| LYD110 | 60393.3 | 0.6 | 0.08 | 29 | 9.1 | 0.01 | 82 | 7.0 | L | 27 |
| LYD110 | 60393.4 | 0.9 | L | 103 | 8.7 | 0.01 | 73 | 6.4 | 0.06 | 17 |
| LYD110 | 60394.4 | 0.6 | 0.02 | 19 | 7.8 | L | 56 | 7.3 | L | 32 |
| CONT. | — | 0.5 | — | — | 5.0 | — | — | 5.5 | — | — |
| LYD99 | 60325.5 | — | — | — | 6.1 | 0.05 | 26 | 6.6 | 0.01 | 15 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD99 | 60327.5 | — | — | — | 7.2 | 0.05 | 49 | 6.8 | L | 17 |
| LYD99 | 60327.7 | — | — | — | 5.6 | 0.04 | 16 | 6.3 | 0.04 | 9 |
| LYD99 | 60328.6 | — | — | — | 5.6 | 0.15 | 16 | 6.0 | 0.29 | 4 |
| LYD88 | 61706.3 | — | — | — | 5.5 | 0.07 | 13 | 6.7 | L | 16 |
| LYD88 | 61707.3 | 0.4 | 0.30 | 11 | 6.7 | 0.05 | 39 | 6.7 | 0.08 | 17 |
| LYD88 | 61707.4 | — | — | — | — | — | — | 6.9 | 0.02 | 19 |
| LYD88 | 61709.1 | — | — | — | 9.1 | 0.01 | 88 | 6.8 | L | 18 |
| LYD88 | 61709.2 | 0.4 | 0.27 | 10 | 5.6 | 0.25 | 16 | — | — | — |
| LYD58 | 61306.2 | — | — | — | 5.2 | 0.25 | 7 | 6.4 | 0.02 | 11 |
| LYD58 | 61307.3 | — | — | — | 6.9 | L | 43 | 6.4 | L | 10 |
| LYD58 | 61308.2 | — | — | — | 7.7 | L | 59 | 6.8 | 0.01 | 17 |
| LYD283 | 61317.4 | 0.5 | 0.01 | 27 | 6.3 | 0.03 | 30 | 6.9 | L | 19 |
| LYD283 | 61319.3 | 0.6 | L | 53 | 8.7 | L | 79 | 7.1 | 0.03 | 23 |
| LYD283 | 61320.1 | — | — | — | — | — | — | 6.1 | 0.20 | 6 |
| LYD283 | 61320.2 | — | — | — | 5.4 | 0.15 | 12 | 6.3 | 0.15 | 9 |
| LYD28 | 61714.6 | — | — | — | 5.8 | L | 20 | — | — | — |
| LYD28 | 61716.2 | — | — | — | 6.9 | 0.03 | 42 | 6.3 | 0.02 | 10 |
| LYD269 | 61461.4 | — | — | — | — | — | — | 6.2 | 0.23 | 8 |
| LYD269 | 61462.1 | — | — | — | — | — | — | 6.6 | L | 15 |
| LYD269 | 61462.2 | — | — | — | 7.3 | L | 51 | 6.8 | L | 18 |
| LYD262 | 61340.1 | — | — | — | 7.4 | 0.07 | 54 | 6.6 | 0.02 | 14 |
| LYD262 | 61341.2 | 0.5 | 0.09 | 16 | — | — | — | — | — | — |
| LYD262 | 61342.3 | 0.5 | 0.08 | 20 | — | — | — | — | — | — |
| LYD259 | 61301.1 | 0.5 | L | 36 | 5.9 | 0.12 | 22 | 6.1 | 0.12 | 5 |
| LYD259 | 61301.2 | — | — | — | — | — | — | 6.3 | 0.15 | 9 |
| LYD259 | 61302.3 | 0.5 | 0.16 | 20 | 6.6 | 0.18 | 36 | — | — | — |
| LYD259 | 61302.6 | 0.5 | 0.05 | 25 | 8.8 | L | 83 | 7.0 | L | 21 |
| LYD222 | 61328.1 | — | — | — | — | — | — | 6.2 | 0.07 | 8 |
| LYD222 | 61329.3 | 0.5 | 0.13 | 19 | — | — | — | 6.2 | 0.17 | 7 |
| LYD187 | 61312.4 | 0.4 | 0.29 | 9 | 5.6 | 0.20 | 15 | — | — | — |
| LYD187 | 61313.2 | — | — | — | 6.2 | 0.13 | 27 | 6.9 | 0.03 | 19 |
| LYD187 | 61314.2 | — | — | — | 5.2 | 0.07 | 8 | 6.1 | 0.21 | 5 |
| LYD152 | 61352.4 | — | — | — | 6.1 | 0.04 | 26 | 6.5 | 0.05 | 12 |
| LYD152 | 61355.3 | — | — | — | 7.6 | 0.16 | 57 | 6.8 | 0.13 | 17 |
| LYD150 | 61323.2 | — | — | — | — | — | — | 6.6 | 0.06 | 15 |
| LYD150 | 61324.2 | 0.4 | 0.13 | 12 | 5.9 | L | 22 | 6.1 | 0.21 | 6 |
| LYD150 | 61325.4 | — | — | — | — | — | — | 6.5 | 0.08 | 12 |
| LYD150 | 61326.1 | 0.5 | 0.16 | 19 | 6.9 | 0.05 | 42 | 6.7 | 0.08 | 16 |
| LYD108 | 61294.1 | 0.7 | 0.01 | 64 | 6.5 | L | 34 | 6.6 | 0.04 | 14 |
| LYD108 | 61294.4 | 0.6 | 0.22 | 47 | — | — | — | 6.2 | 0.08 | 7 |
| LYD108 | 61297.2 | 0.6 | 0.02 | 57 | 7.2 | L | 48 | 6.8 | L | 18 |
| LYD108 | 61297.4 | 0.7 | L | 70 | 6.1 | 0.03 | 26 | 6.1 | 0.26 | 5 |
| CONT. | — | 0.4 | — | — | 4.8 | — | — | 5.8 | — | — |
| LYD99 | 60325.5 | — | — | — | — | — | — | 6.8 | 0.19 | 9 |
| LYD99 | 60328.6 | 0.6 | 0.15 | 10 | 9.0 | 0.30 | 19 | 6.9 | 0.11 | 10 |
| LYD78 | 60359.1 | — | — | — | — | — | — | 6.6 | 0.08 | 7 |
| LYD78 | 60359.4 | 0.6 | 0.25 | 9 | — | — | — | — | — | — |
| LYD78 | 60361.3 | — | — | — | — | — | — | 6.8 | 0.03 | 9 |
| LYD78 | 60362.4 | 0.9 | 0.04 | 57 | 11.7 | 0.05 | 54 | 7.2 | L | 16 |
| LYD73 | 60367.2 | — | — | — | — | — | — | 6.9 | L | 11 |
| LYD73 | 60368.4 | — | — | — | 9.7 | 0.01 | 28 | 7.2 | L | 16 |
| LYD47 | 60300.4 | — | — | — | — | — | — | 7.0 | L | 13 |
| LYD47 | 60301.4 | 1.0 | 0.13 | 72 | 11.1 | 0.26 | 46 | 7.0 | 0.21 | 12 |
| LYD3 | 60372.4 | 0.8 | 0.04 | 46 | 10.3 | 0.26 | 35 | — | — | — |
| LYD3 | 60373.2 | — | — | — | — | — | — | 6.4 | 0.29 | 3 |
| LYD3 | 60375.1 | 0.7 | 0.21 | 16 | 9.4 | 0.20 | 23 | 6.9 | 0.09 | 11 |
| LYD3 | 60375.3 | — | — | — | — | — | — | 7.1 | L | 14 |
| LYD269 | 61461.4 | — | — | — | — | — | — | 6.8 | 0.24 | 9 |
| LYD269 | 61462.1 | — | — | — | 9.3 | 0.08 | 22 | 6.8 | 0.07 | 9 |
| LYD269 | 61462.2 | — | — | — | — | — | — | 6.9 | L | 11 |
| LYD264 | 61526.1 | 1.1 | L | 93 | 12.4 | L | 63 | 7.4 | 0.02 | 18 |
| LYD264 | 61526.3 | 1.0 | 0.03 | 77 | 11.6 | 0.06 | 53 | — | — | — |
| LYD264 | 61527.4 | 0.9 | L | 63 | 10.1 | L | 33 | 6.6 | 0.23 | 6 |
| LYD264 | 61529.3 | 0.6 | 0.23 | 5 | 8.3 | 0.25 | 9 | 7.4 | L | 18 |
| LYD264 | 61530.4 | — | — | — | — | — | — | 6.9 | 0.13 | 12 |
| LYD262 | 61340.1 | — | — | — | — | — | — | 7.2 | L | 15 |
| LYD262 | 61341.2 | 0.8 | L | 42 | — | — | — | — | — | — |
| LYD262 | 61342.1 | 0.9 | 0.09 | 50 | — | — | — | — | — | — |
| LYD262 | 61342.2 | 0.8 | 0.08 | 40 | — | — | — | — | — | — |
| LYD262 | 61342.3 | 0.7 | 0.15 | 14 | — | — | — | 6.9 | 0.04 | 10 |
| LYD261 | 61521.4 | 1.0 | 0.06 | 75 | 12.7 | 0.07 | 67 | 7.5 | L | 21 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD261 | 61522.2 | 0.8 | 0.04 | 35 | 10.5 | 0.11 | 37 | 7.4 | 0.02 | 18 |
| LYD261 | 61522.3 | 0.7 | 0.02 | 21 | 11.5 | 0.04 | 51 | 7.3 | L | 18 |
| LYD261 | 61523.2 | — | — | — | — | — | — | 6.4 | 0.28 | 3 |
| LYD261 | 61524.2 | 0.7 | 0.02 | 17 | 9.3 | L | 23 | 6.5 | 0.27 | 4 |
| LYD252 | 61052.4 | 0.7 | 0.06 | 15 | 9.3 | 0.06 | 22 | 7.7 | L | 24 |
| LYD252 | 61052.5 | — | — | — | 8.9 | 0.17 | 17 | 7.1 | L | 14 |
| LYD252 | 61054.1 | — | — | — | — | — | — | 6.8 | 0.05 | 10 |
| LYD252 | 61054.3 | — | — | — | — | — | — | 7.2 | 0.04 | 15 |
| LYD252 | 61055.2 | 0.8 | 0.26 | 33 | — | — | — | 7.4 | 0.02 | 18 |
| LYD229 | 60336.3 | 0.9 | 0.09 | 60 | — | — | — | — | — | — |
| LYD229 | 60337.1 | 0.9 | 0.01 | 62 | 9.7 | L | 28 | 6.6 | 0.19 | 6 |
| LYD229 | 60337.2 | 1.0 | 0.04 | 74 | 10.3 | 0.12 | 36 | 6.7 | 0.12 | 7 |
| LYD229 | 60338.4 | 1.0 | 0.02 | 71 | 14.7 | 0.01 | 93 | — | — | — |
| LYD229 | 60339.4 | 0.8 | 0.03 | 44 | 10.3 | 0.11 | 36 | 6.9 | 0.18 | 10 |
| LYD132 | 60353.3 | 1.2 | L | 99 | 13.0 | L | 71 | 7.7 | L | 23 |
| LYD132 | 60356.2 | 0.8 | 0.10 | 31 | 10.1 | 0.16 | 33 | — | — | — |
| LYD132 | 60357.2 | 0.8 | 0.03 | 42 | 11.3 | 0.03 | 49 | 7.3 | L | 18 |
| LYD132 | 60357.3 | 0.7 | 0.01 | 26 | 9.3 | 0.15 | 22 | 6.9 | L | 11 |
| LYD132 | 60357.4 | 0.8 | L | 47 | 11.6 | 0.01 | 53 | 7.5 | L | 21 |
| LYD107 | 60341.2 | 0.9 | L | 52 | 11.8 | 0.06 | 54 | 6.8 | 0.25 | 10 |
| LYD107 | 60342.2 | 0.9 | 0.01 | 61 | 13.2 | 0.02 | 73 | 7.5 | L | 20 |
| LYD107 | 60342.3 | 0.8 | 0.14 | 43 | 9.7 | 0.06 | 28 | 7.2 | L | 15 |
| LYD107 | 60342.4 | 0.8 | L | 46 | 9.1 | 0.28 | 19 | — | — | — |
| LYD107 | 60343.3 | 1.0 | 0.07 | 68 | 11.4 | L | 50 | 7.2 | L | 15 |
| CONT. | — | 0.6 | — | — | 7.6 | — | — | 6.2 | — | — |
| LYD85 | 60014.2 | — | — | — | 7.6 | 0.26 | 24 | 6.5 | 0.12 | 7 |
| LYD85 | 60014.4 | — | — | — | 14.3 | L | 133 | 7.8 | L | 28 |
| LYD85 | 60016.4 | — | — | — | 7.6 | 0.02 | 24 | — | — | — |
| LYD79 | 60018.2 | — | — | — | 9.5 | 0.04 | 56 | 7.2 | L | 18 |
| LYD79 | 60020.4 | — | — | — | 10.3 | L | 69 | 7.2 | L | 18 |
| LYD79 | 60021.4 | — | — | — | — | — | — | 6.8 | 0.08 | 12 |
| LYD55 | 60174.1 | 0.8 | 0.18 | 37 | 9.0 | 0.10 | 47 | — | — | — |
| LYD55 | 60175.4 | 0.8 | 0.28 | 31 | 8.3 | 0.12 | 35 | 6.9 | L | 13 |
| LYD55 | 60177.2 | 0.9 | L | 57 | 10.4 | 0.04 | 70 | 7.1 | 0.03 | 17 |
| LYD43 | 60610.4 | 0.7 | 0.04 | 20 | 7.9 | 0.30 | 29 | — | — | — |
| LYD33 | 60159.3 | — | — | — | 8.9 | 0.03 | 45 | 6.6 | 0.18 | 8 |
| LYD33 | 60159.5 | — | — | — | 8.0 | 0.09 | 31 | 6.8 | 0.12 | 11 |
| LYD33 | 60160.2 | 0.7 | 0.29 | 25 | 11.2 | L | 83 | 7.7 | L | 27 |
| LYD235 | 60929.3 | — | — | — | 7.3 | 0.14 | 19 | 6.9 | 0.03 | 14 |
| LYD235 | 60930.2 | — | — | — | 7.1 | 0.28 | 16 | — | — | — |
| LYD235 | 60930.6 | 0.8 | 0.02 | 31 | 7.6 | 0.03 | 24 | 7.0 | L | 15 |
| LYD235 | 60931.2 | — | — | — | — | — | — | 7.0 | L | 16 |
| LYD204 | 60703.1 | 0.8 | L | 41 | 8.0 | L | 30 | — | — | — |
| LYD204 | 60704.4 | 0.7 | 0.02 | 30 | 8.0 | 0.01 | 30 | 6.6 | 0.10 | 8 |
| LYD20 | 60066.2 | 0.8 | 0.03 | 37 | 8.0 | 0.13 | 31 | 6.6 | 0.13 | 8 |
| LYD20 | 60069.4 | 0.8 | 0.22 | 34 | 11.0 | 0.02 | 79 | 7.5 | 0.03 | 23 |
| LYD102 | 60959.1 | 0.8 | 0.07 | 31 | — | — | — | — | — | — |
| LYD102 | 60960.1 | 0.9 | 0.03 | 50 | 9.6 | 0.02 | 57 | 7.3 | L | 20 |
| CONT. | — | 0.6 | — | — | 6.1 | — | — | 6.1 | — | — |
| LYD238 | 60452.3 | 0.6 | 0.08 | 28 | — | — | — | — | — | — |
| LYD238 | 60453.2 | 0.6 | 0.07 | 31 | 9.3 | 0.08 | 25 | 6.7 | 0.03 | 13 |
| LYD238 | 60453.3 | — | — | — | — | — | — | 6.7 | L | 14 |
| LYD238 | 60455.2 | — | — | — | — | — | — | 6.2 | 0.26 | 4 |
| LYD216 | 60330.4 | 0.6 | 0.26 | 25 | — | — | — | — | — | — |
| LYD216 | 60331.4 | 0.8 | L | 75 | 12.5 | 0.02 | 68 | 7.2 | 0.02 | 21 |
| LYD216 | 60333.1 | — | — | — | — | — | — | 6.3 | 0.28 | 6 |
| LYD216 | 60333.3 | 0.8 | 0.20 | 71 | 13.2 | 0.01 | 77 | 7.7 | L | 30 |
| LYD216 | 60333.4 | 0.6 | 0.18 | 35 | — | — | — | 6.5 | L | 9 |
| LYD215 | 60412.2 | — | — | — | 9.6 | 0.14 | 30 | 6.9 | 0.10 | 17 |
| LYD215 | 60412.4 | — | — | — | 9.1 | 0.12 | 22 | 7.0 | 0.03 | 19 |
| LYD215 | 60414.1 | — | — | — | 9.6 | 0.09 | 30 | 7.0 | L | 18 |
| LYD215 | 60415.1 | — | — | — | 14.1 | L | 90 | 7.7 | L | 30 |
| LYD215 | 60415.4 | — | — | — | 10.5 | 0.07 | 41 | 7.2 | L | 22 |
| LYD212 | 60521.3 | 0.5 | 0.05 | 18 | 10.9 | L | 47 | 7.4 | L | 26 |
| LYD212 | 60522.2 | — | — | — | — | — | — | 6.9 | L | 17 |
| LYD212 | 60522.3 | — | — | — | 11.4 | L | 54 | 7.3 | L | 24 |
| LYD212 | 60524.3 | — | — | — | 9.2 | 0.05 | 24 | 7.5 | L | 27 |
| LYD212 | 60525.2 | 0.5 | 0.20 | 16 | 9.0 | 0.14 | 22 | 7.1 | 0.01 | 21 |
| LYD211 | 60308.2 | 0.6 | 0.10 | 25 | 9.8 | 0.08 | 32 | 6.8 | 0.01 | 15 |
| LYD211 | 60308.3 | 0.7 | 0.05 | 63 | 12.7 | L | 70 | 7.6 | L | 28 |
| LYD209 | 60294.3 | — | — | — | — | — | — | 6.7 | 0.12 | 14 |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD209 | 60294.4 | 0.6 | 0.26 | 28 | 10.3 | 0.07 | 38 | 6.9 | 0.05 | 16 |
| LYD209 | 60295.4 | — | — | — | 9.8 | 0.03 | 32 | — | — | — |
| LYD209 | 60297.3 | — | — | — | 9.4 | 0.03 | 26 | 6.4 | 0.14 | 9 |
| LYD209 | 60297.4 | 1.0 | 0.05 | 116 | 12.7 | 0.04 | 71 | 7.5 | L | 27 |
| LYD206 | 60491.5 | — | — | — | 11.9 | 0.02 | 61 | 7.6 | L | 29 |
| LYD206 | 60492.1 | 0.7 | 0.01 | 55 | 13.2 | L | 78 | 7.4 | L | 25 |
| LYD206 | 60492.3 | 0.5 | 0.26 | 20 | 10.3 | L | 38 | 6.8 | 0.12 | 14 |
| LYD206 | 60493.2 | 0.5 | 0.20 | 23 | 10.8 | 0.06 | 46 | 7.4 | 0.02 | 25 |
| LYD206 | 60494.1 | — | — | — | 10.9 | 0.03 | 46 | 7.7 | L | 30 |
| LYD201 | 60168.2 | 0.6 | 0.10 | 42 | 9.9 | 0.14 | 33 | — | — | — |
| LYD201 | 60168.4 | 0.7 | 0.04 | 52 | 9.7 | 0.09 | 31 | — | — | — |
| LYD201 | 60170.1 | 0.5 | 0.19 | 23 | — | — | — | 7.0 | 0.03 | 19 |
| LYD201 | 60172.1 | — | — | — | 9.9 | 0.16 | 33 | 7.4 | L | 25 |
| LYD201 | 60173.2 | — | — | — | — | — | — | 6.8 | 0.07 | 15 |
| LYD196 | 60567.1 | — | — | — | 8.7 | 0.11 | 17 | 7.1 | L | 21 |
| LYD196 | 60568.1 | — | — | — | — | — | — | 6.9 | L | 17 |
| LYD196 | 60568.4 | — | — | — | — | — | — | 6.3 | 0.16 | 6 |
| LYD196 | 60569.1 | — | — | — | 9.9 | 0.01 | 33 | 7.2 | L | 22 |
| LYD196 | 60569.3 | 0.6 | 0.03 | 39 | 10.9 | 0.02 | 47 | 7.7 | L | 30 |
| LYD177 | 60571.1 | 0.5 | 0.22 | 23 | 10.8 | 0.02 | 46 | 7.2 | L | 21 |
| LYD177 | 60571.4 | 0.6 | 0.01 | 27 | 10.9 | L | 47 | 7.4 | L | 25 |
| LYD177 | 60572.1 | — | — | — | 11.6 | 0.01 | 56 | 7.5 | L | 27 |
| LYD177 | 60573.2 | 0.5 | 0.29 | 17 | 9.0 | 0.22 | 21 | — | — | — |
| LYD177 | 60574.3 | 0.6 | 0.22 | 40 | 12.1 | L | 63 | 7.5 | L | 28 |
| LYD167 | 60472.1 | — | — | — | 13.3 | 0.02 | 79 | 7.3 | 0.01 | 23 |
| LYD167 | 60473.1 | — | — | — | 9.0 | 0.18 | 21 | 7.2 | L | 21 |
| LYD167 | 60473.2 | — | — | — | 8.9 | 0.24 | 20 | 6.9 | L | 18 |
| LYD167 | 60473.3 | 0.5 | 0.24 | 14 | 9.2 | 0.07 | 24 | 7.0 | 0.02 | 19 |
| LYD149 | 60511.3 | — | — | — | 10.0 | 0.02 | 35 | 6.8 | 0.01 | 15 |
| LYD149 | 60513.2 | — | — | — | — | — | — | 6.5 | 0.28 | 9 |
| LYD149 | 60513.3 | 0.6 | L | 35 | 11.9 | L | 61 | 7.9 | L | 34 |
| LYD149 | 60513.4 | 0.5 | 0.04 | 23 | 10.5 | L | 42 | 7.7 | L | 30 |
| LYD149 | 60515.2 | 0.6 | 0.05 | 34 | 9.8 | 0.06 | 32 | 7.2 | 0.03 | 21 |
| LYD120 | 60882.1 | 0.6 | 0.01 | 26 | 8.3 | 0.30 | 12 | 6.6 | 0.10 | 11 |
| LYD120 | 60882.3 | 0.5 | L | 22 | 8.9 | 0.07 | 20 | 6.9 | L | 17 |
| LYD120 | 60883.2 | 0.5 | 0.19 | 9 | 9.5 | 0.15 | 28 | — | — | — |
| LYD120 | 60884.1 | 0.5 | 0.01 | 22 | 8.9 | 0.25 | 19 | 6.8 | 0.14 | 15 |
| LYD120 | 60884.3 | 0.7 | 0.02 | 49 | 10.6 | 0.04 | 43 | 7.4 | L | 25 |
| LYD1 | 61682.3 | — | — | — | 9.7 | 0.02 | 31 | 7.0 | L | 18 |
| LYD1 | 61685.1 | 0.6 | 0.16 | 25 | 11.2 | L | 51 | 7.2 | L | 21 |
| LYD1 | 61685.3 | — | — | — | 10.3 | L | 38 | 7.1 | L | 21 |
| LYD1 | 61685.4 | — | — | — | 10.5 | L | 41 | 7.2 | L | 22 |
| LYD1 | 61686.3 | 0.6 | 0.03 | 41 | 12.9 | L | 74 | 7.6 | L | 29 |
| CONT. | — | 0.4 | — | — | 7.4 | — | — | 5.9 | — | — |
| LYD200 | 60481.1 | — | — | — | — | — | — | 7.3 | 0.05 | 12 |
| LYD200 | 60481.2 | 0.6 | 0.22 | 35 | — | — | — | — | — | — |
| LYD200 | 60482.1 | 0.5 | 0.16 | 24 | 10.0 | L | 38 | 7.2 | 0.02 | 11 |
| LYD200 | 60485.2 | 0.5 | 0.17 | 13 | — | — | — | — | — | — |
| LYD158 | 60581.4 | 0.6 | 0.20 | 40 | 11.2 | 0.10 | 55 | — | — | — |
| LYD158 | 60582.1 | — | — | — | — | — | — | 7.1 | 0.12 | 9 |
| LYD158 | 60582.2 | — | — | — | — | — | — | 7.1 | 0.03 | 8 |
| LYD153 | 60698.3 | 0.7 | 0.02 | 66 | 11.0 | 0.08 | 52 | 7.2 | 0.13 | 11 |
| LYD153 | 60698.6 | 0.6 | L | 29 | — | — | — | 7.2 | L | 11 |
| LYD153 | 60700.3 | 0.5 | 0.15 | 25 | 8.4 | 0.04 | 16 | 6.9 | 0.19 | 6 |
| LYD148 | 60431.3 | — | — | — | 7.9 | 0.28 | 10 | 6.9 | 0.14 | 6 |
| LYD148 | 60432.1 | — | — | — | 9.8 | 0.20 | 35 | 7.2 | 0.07 | 10 |
| LYD148 | 60432.4 | 0.6 | 0.22 | 42 | 11.6 | 0.04 | 61 | 7.4 | 0.02 | 12 |
| LYD148 | 60434.3 | — | — | — | 9.2 | 0.05 | 27 | 7.2 | L | 11 |
| LYD144 | 60864.2 | 0.6 | 0.10 | 45 | 10.1 | L | 40 | 7.5 | L | 15 |
| LYD144 | 60866.1 | 0.5 | 0.23 | 20 | — | — | — | — | — | — |
| LYD144 | 60866.4 | 0.5 | 0.29 | 17 | 8.7 | 0.24 | 20 | — | — | — |
| LYD129 | 60792.1 | 0.6 | L | 41 | — | — | — | — | — | — |
| LYD127 | 60681.1 | 0.6 | 0.15 | 42 | 11.4 | 0.04 | 58 | 7.7 | 0.03 | 17 |
| LYD127 | 60682.2 | — | — | — | — | — | — | 7.0 | 0.09 | 6 |
| LYD127 | 60682.3 | 0.5 | 0.07 | 23 | — | — | — | — | — | — |
| LYD127 | 60683.1 | — | — | — | 9.3 | 0.08 | 29 | 7.0 | 0.21 | 8 |
| LYD101 | 60072.8 | 0.5 | 0.28 | 21 | — | — | — | — | — | — |

TABLE 34-continued

Genes showing improved plant performance at Normal growth conditions under regulation of 6669 promoter

| Gene Name | Event # | Leaf Area [cm2] | | | Roots Coverage [cm2] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD101 | 60075.3 | 0.6 | L | 39 | — | — | — | 6.9 | 0.16 | 6 |
| CONT. | — | 0.4 | — | — | 7.2 | — | — | 6.5 | — | — |

Table 34.
"CONT."—Control;
"Ave."—Average;
"% Incr." = % increment;
"p-val."—p-value,
L—p < 0.01.
Values are provided per plant.

TABLE 35

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD58 | 61306.2 | 0.1 | 0.01 | 48 | 1.0 | L | 73 | — | — | — |
| LYD58 | 61306.6 | 0.0 | 0.15 | 18 | — | — | — | — | — | — |
| LYD58 | 61307.3 | 0.1 | L | 56 | 0.8 | L | 45 | 0.6 | 0.08 | 20 |
| LYD58 | 61308.2 | 0.1 | L | 76 | 0.9 | L | 63 | 0.6 | 0.13 | 17 |
| LYD283 | 61317.4 | 0.1 | L | 52 | 0.7 | 0.05 | 26 | 0.6 | 0.27 | 12 |
| LYD283 | 61319.3 | 0.1 | L | 40 | 0.8 | 0.01 | 36 | — | — | — |
| LYD283 | 61320.1 | 0.1 | L | 40 | — | — | — | — | — | — |
| LYD283 | 61320.4 | 0.1 | 0.07 | 33 | 0.9 | L | 58 | 0.6 | 0.26 | 14 |
| LYD270 | 61370.4 | 0.1 | L | 71 | 0.8 | 0.01 | 37 | — | — | — |
| LYD260 | 61364.4 | 0.1 | L | 51 | 0.9 | L | 57 | 0.6 | 0.19 | 15 |
| LYD260 | 61365.3 | 0.1 | L | 70 | 1.1 | L | 94 | — | — | — |
| LYD260 | 61365.4 | 0.1 | L | 48 | 1.0 | L | 68 | — | — | — |
| LYD260 | 61365.6 | — | — | — | 0.8 | 0.03 | 33 | — | — | — |
| LYD260 | 61368.1 | 0.0 | 0.10 | 19 | — | — | — | — | — | — |
| LYD259 | 61301.2 | — | — | — | 0.8 | 0.05 | 32 | — | — | — |
| LYD259 | 61302.3 | 0.0 | 0.23 | 19 | 0.7 | 0.08 | 27 | — | — | — |
| LYD259 | 61302.6 | 0.1 | L | 32 | 0.6 | 0.27 | 13 | 0.6 | 0.17 | 14 |
| LYD230 | 61333.4 | 0.1 | L | 35 | 0.7 | 0.03 | 28 | 0.6 | 0.21 | 13 |
| LYD230 | 61334.5 | 0.1 | 0.06 | 30 | 0.8 | 0.04 | 37 | — | — | — |
| LYD230 | 61335.2 | 0.1 | 0.03 | 24 | — | — | — | — | — | — |
| LYD222 | 61327.3 | — | — | — | 0.7 | 0.16 | 23 | — | — | — |
| LYD222 | 61327.4 | 0.1 | 0.02 | 31 | — | — | — | — | — | — |
| LYD222 | 61329.2 | 0.1 | L | 46 | — | — | — | — | — | — |
| LYD222 | 61329.3 | 0.1 | L | 59 | 0.9 | L | 53 | — | — | — |
| LYD21 | 61358.1 | 0.1 | L | 49 | 1.0 | L | 84 | — | — | — |
| LYD21 | 61360.1 | 0.1 | L | 78 | 0.8 | L | 38 | — | — | — |
| LYD21 | 61362.1 | 0.1 | L | 76 | 1.2 | L | 102 | — | — | — |
| LYD21 | 61362.3 | 0.1 | L | 61 | 0.8 | 0.01 | 40 | — | — | — |
| LYD21 | 61362.4 | 0.1 | 0.13 | 20 | 0.8 | 0.01 | 33 | 0.6 | 0.22 | 13 |
| LYD187 | 61312.4 | 0.0 | 0.23 | 15 | — | — | — | — | — | — |
| LYD187 | 61313.2 | — | — | — | 0.9 | L | 50 | — | — | — |
| LYD187 | 61314.2 | 0.0 | 0.21 | 16 | 0.7 | 0.02 | 29 | — | — | — |
| LYD187 | 61314.4 | — | — | — | — | — | — | 0.6 | 0.30 | 12 |
| LYD152 | 61352.1 | 0.0 | 0.16 | 19 | — | — | — | — | — | — |
| LYD152 | 61352.4 | 0.1 | L | 57 | 1.0 | L | 68 | 0.6 | 0.14 | 17 |
| LYD152 | 61352.5 | — | — | — | 0.7 | 0.07 | 27 | 0.6 | 0.26 | 12 |
| LYD152 | 61352.7 | 0.0 | 0.30 | 14 | — | — | — | 0.6 | 0.14 | 17 |
| LYD152 | 61355.3 | 0.1 | 0.01 | 56 | 0.9 | L | 52 | — | — | — |
| LYD150 | 61323.2 | 0.1 | L | 45 | 0.9 | L | 51 | — | — | — |
| LYD150 | 61324.1 | 0.0 | 0.23 | 17 | 0.7 | 0.15 | 21 | 0.6 | 0.22 | 13 |
| LYD150 | 61324.2 | 0.1 | L | 77 | 1.1 | L | 86 | — | — | — |
| LYD150 | 61325.4 | — | — | — | 0.7 | 0.24 | 16 | 0.6 | 0.08 | 20 |
| LYD150 | 61326.1 | 0.1 | L | 58 | 0.9 | L | 53 | 0.6 | 0.01 | 29 |
| LYD126 | 61376.1 | 0.1 | L | 36 | 1.0 | L | 75 | — | — | — |
| LYD126 | 61377.3 | 0.1 | L | 43 | 0.8 | L | 35 | 0.6 | 0.08 | 19 |
| LYD126 | 61380.2 | 0.1 | 0.08 | 24 | — | — | — | — | — | — |
| LYD115 | 61346.2 | 0.1 | 0.03 | 47 | 0.8 | 0.04 | 34 | — | — | — |
| LYD115 | 61349.1 | 0.1 | 0.12 | 21 | 0.7 | 0.17 | 19 | — | — | — |
| LYD115 | 61349.2 | — | — | — | 0.8 | L | 41 | — | — | — |

TABLE 35-continued

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD115 | 61350.3 | — | — | — | 0.6 | 0.30 | 12 | — | — | — |
| LYD114 | 61383.6 | — | — | — | 0.8 | L | 42 | 0.6 | 0.05 | 23 |
| LYD108 | 61294.1 | 0.1 | L | 52 | — | — | — | — | — | — |
| LYD108 | 61294.4 | 0.1 | L | 66 | — | — | — | — | — | — |
| LYD108 | 61295.1 | 0.1 | L | 72 | — | — | — | — | — | — |
| LYD108 | 61296.1 | 0.1 | L | 79 | 0.7 | 0.09 | 24 | — | — | — |
| LYD108 | 61297.2 | 0.1 | L | 79 | 0.7 | 0.29 | 19 | — | — | — |
| CONT. | — | 0.0 | — | — | 0.6 | — | — | 0.5 | — | — |
| LYD95 | 61199.1 | 0.1 | L | 39 | 1.2 | L | 55 | 0.6 | 0.05 | 16 |
| LYD95 | 61199.2 | — | — | — | 1.1 | 0.01 | 48 | 0.6 | 0.02 | 17 |
| LYD95 | 61201.3 | 0.1 | 0.10 | 24 | — | — | — | — | — | — |
| LYD95 | 61202.2 | 0.1 | 0.23 | 21 | 1.0 | 0.10 | 27 | — | — | — |
| LYD95 | 61202.3 | — | — | — | — | — | — | 0.6 | 0.05 | 16 |
| LYD61 | 61659.4 | — | — | — | 1.1 | 0.01 | 38 | 0.6 | 0.13 | 11 |
| LYD61 | 61660.1 | 0.1 | L | 48 | 0.9 | 0.17 | 22 | 0.6 | 0.12 | 13 |
| LYD61 | 61660.3 | 0.1 | 0.28 | 18 | 1.2 | L | 55 | 0.7 | L | 23 |
| LYD61 | 61661.1 | 0.1 | L | 71 | 1.7 | L | 119 | 0.7 | L | 25 |
| LYD286 | 61700.2 | — | — | — | 1.0 | 0.05 | 29 | 0.6 | 0.07 | 12 |
| LYD286 | 61701.2 | — | — | — | — | — | — | 0.6 | 0.27 | 7 |
| LYD286 | 61703.3 | — | — | — | 1.0 | 0.08 | 26 | — | — | — |
| LYD282 | 61664.2 | — | — | — | 1.1 | 0.02 | 38 | — | — | — |
| LYD282 | 61664.3 | 0.1 | 0.02 | 39 | 1.0 | 0.03 | 32 | 0.6 | 0.15 | 10 |
| LYD282 | 61665.3 | 0.1 | L | 49 | 1.3 | L | 70 | 0.6 | 0.03 | 17 |
| LYD282 | 61665.4 | 0.1 | L | 72 | 1.4 | L | 79 | — | — | — |
| LYD282 | 61666.1 | 0.1 | 0.01 | 52 | — | — | — | — | — | — |
| LYD271_H0 | 61876.4 | 0.1 | 0.14 | 23 | 1.4 | L | 80 | 0.7 | L | 23 |
| LYD271_H0 | 61876.5 | — | — | — | 1.1 | 0.02 | 39 | — | — | — |
| LYD271_H0 | 61877.1 | 0.1 | 0.04 | 31 | 0.9 | 0.19 | 21 | — | — | — |
| LYD271_H0 | 61878.2 | — | — | — | 1.1 | 0.01 | 45 | 0.6 | L | 22 |
| LYD271_H0 | 61879.3 | 0.1 | 0.15 | 22 | 1.1 | 0.02 | 38 | — | — | — |
| LYD270 | 61370.1 | — | — | — | 1.0 | 0.05 | 35 | 0.6 | 0.29 | 10 |
| LYD270 | 61373.1 | — | — | — | 0.9 | 0.13 | 23 | — | — | — |
| LYD270 | 61374.2 | 0.1 | 0.17 | 26 | 1.3 | L | 65 | 0.6 | 0.10 | 15 |
| LYD261 | 61521.2 | 0.1 | 0.04 | 29 | 1.0 | 0.05 | 33 | — | — | — |
| LYD261 | 61521.4 | 0.1 | 0.01 | 37 | — | — | — | — | — | — |
| LYD261 | 61523.2 | — | — | — | 1.1 | 0.03 | 40 | 0.6 | 0.16 | 12 |
| LYD260 | 61364.4 | — | — | — | 1.0 | 0.21 | 27 | — | — | — |
| LYD260 | 61365.3 | 0.1 | 0.02 | 63 | 1.4 | L | 76 | — | — | — |
| LYD260 | 61365.6 | — | — | — | 1.2 | L | 55 | 0.7 | L | 23 |
| LYD260 | 61368.1 | 0.1 | 0.21 | 24 | 1.2 | L | 57 | — | — | — |
| LYD231 | 60717.2 | — | — | — | 1.1 | 0.03 | 40 | 0.6 | 0.01 | 19 |
| LYD231 | 60718.1 | 0.1 | L | 87 | 1.2 | L | 57 | 0.6 | 0.29 | 10 |
| LYD231 | 60719.1 | 0.1 | L | 64 | 1.2 | L | 53 | 0.6 | 0.02 | 17 |
| LYD223 | 61193.3 | 0.1 | 0.02 | 31 | 1.1 | L | 49 | 0.6 | 0.02 | 17 |
| LYD223 | 61194.2 | 0.1 | L | 45 | 1.0 | 0.07 | 26 | — | — | — |
| LYD223 | 61194.4 | — | — | — | 0.9 | 0.30 | 17 | 0.6 | 0.05 | 14 |
| LYD223 | 61195.3 | 0.1 | 0.11 | 29 | 1.2 | L | 57 | 0.6 | 0.22 | 11 |
| LYD223 | 61196.3 | 0.1 | L | 63 | 1.3 | L | 74 | 0.6 | 0.06 | 16 |
| LYD21 | 61358.1 | 0.1 | 0.07 | 26 | 1.3 | L | 67 | 0.6 | 0.06 | 12 |
| LYD21 | 61362.1 | 0.1 | 0.06 | 35 | 1.2 | L | 52 | — | — | — |
| LYD21 | 61362.3 | — | — | — | 0.9 | 0.14 | 22 | 0.6 | 0.13 | 12 |
| LYD126 | 61376.1 | 0.1 | 0.01 | 40 | 1.2 | L | 53 | 0.6 | 0.18 | 10 |
| LYD126 | 61377.3 | — | — | — | — | — | — | 0.6 | 0.07 | 12 |
| LYD126 | 61380.1 | 0.1 | L | 41 | — | — | — | — | — | — |
| LYD126 | 61380.2 | 0.1 | 0.10 | 25 | 1.0 | 0.02 | 36 | — | — | — |
| LYD124_H7 | 61871.2 | 0.1 | 0.17 | 28 | 1.2 | L | 50 | 0.6 | 0.17 | 11 |
| LYD124_H7 | 61871.4 | — | — | — | 1.2 | L | 53 | 0.6 | 0.13 | 11 |
| LYD124_H7 | 61874.1 | — | — | — | 1.3 | L | 63 | 0.7 | L | 26 |
| LYD114 | 61383.1 | 0.1 | L | 53 | 1.3 | L | 74 | 0.6 | 0.03 | 19 |
| LYD114 | 61383.3 | 0.1 | L | 51 | 1.3 | L | 69 | 0.6 | 0.04 | 19 |
| LYD114 | 61383.6 | 0.1 | 0.02 | 32 | 1.2 | L | 56 | — | — | — |
| LYD114 | 61384.2 | — | — | — | 1.0 | 0.09 | 24 | — | — | — |
| LYD114 | 61385.2 | 0.1 | 0.21 | 22 | 1.3 | L | 63 | 0.6 | 0.01 | 19 |
| CONT. | — | 0.0 | — | — | 0.8 | — | — | 0.5 | — | — |
| LYD92 | 60583.3 | — | — | — | 1.2 | 0.09 | 29 | 0.7 | 0.04 | 12 |
| LYD92 | 60585.1 | — | — | — | 1.1 | 0.29 | 15 | — | — | — |
| LYD92 | 60586.4 | — | — | — | 1.1 | 0.16 | 21 | — | — | — |
| LYD92 | 60587.3 | 0.1 | 0.13 | 23 | 1.4 | L | 52 | 0.7 | L | 28 |
| LYD66 | 60114.1 | — | — | — | 1.2 | 0.08 | 26 | — | — | — |
| LYD66 | 60114.3 | — | — | — | 1.1 | 0.29 | 18 | — | — | — |
| LYD66 | 60117.1 | — | — | — | 1.2 | 0.11 | 31 | 0.6 | 0.21 | 9 |
| LYD66 | 60117.2 | — | — | — | — | — | — | 0.6 | 0.05 | 10 |
| LYD57 | 61652.2 | — | — | — | 1.1 | 0.20 | 21 | — | — | — |

TABLE 35-continued

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD57 | 61654.3 | 0.1 | 0.28 | 16 | — | — | — | — | — | — |
| LYD57 | 61655.2 | — | — | — | 1.3 | 0.02 | 36 | — | — | — |
| LYD57 | 61655.3 | — | — | — | 1.2 | 0.15 | 26 | 0.7 | 0.04 | 16 |
| LYD50 | 60601.1 | 0.1 | 0.16 | 24 | 1.2 | 0.19 | 25 | — | — | — |
| LYD50 | 60604.2 | — | — | — | 1.2 | 0.09 | 28 | — | — | — |
| LYD50 | 60604.3 | — | — | — | 1.2 | 0.13 | 25 | — | — | — |
| LYD271_H0 | 61878.2 | — | — | — | 1.2 | 0.08 | 30 | — | — | — |
| LYD271_H0 | 61879.3 | — | — | — | — | — | — | 0.6 | 0.14 | 8 |
| LYD266 | 60615.3 | — | — | — | — | — | — | 0.6 | 0.16 | 8 |
| LYD25 | 60589.4 | 0.1 | 0.11 | 31 | 1.3 | 0.02 | 40 | — | — | — |
| LYD124_H7 | 61874.2 | — | — | — | 1.1 | 0.25 | 18 | 0.6 | 0.20 | 8 |
| CONT. | — | 0.0 | — | — | 0.9 | — | — | 0.6 | — | — |
| LYM104 | 12913.21 | 0.1 | 0.06 | 45 | 1.1 | 0.12 | 34 | — | — | — |
| LYM104 | 12914.1 | 0.1 | L | 79 | 1.1 | 0.08 | 33 | — | — | — |
| LYM104 | 12914.14 | 0.1 | L | 54 | — | — | — | — | — | — |
| LYD88 | 61706.3 | 0.1 | 0.10 | 24 | 1.2 | 0.02 | 45 | — | — | — |
| LYD88 | 61707.3 | — | — | — | 1.0 | 0.14 | 27 | 0.6 | 0.11 | 17 |
| LYD88 | 61709.1 | 0.1 | 0.02 | 34 | 1.1 | 0.04 | 37 | — | — | — |
| LYD84 | 61133.4 | 0.1 | 0.03 | 37 | 1.1 | 0.08 | 37 | — | — | — |
| LYD84 | 61134.1 | 0.1 | 0.06 | 44 | 1.2 | 0.05 | 43 | — | — | — |
| LYD84 | 61134.3 | 0.1 | L | 79 | 1.3 | 0.01 | 61 | — | — | — |
| LYD84 | 61134.4 | 0.1 | 0.27 | 37 | — | — | — | — | — | — |
| LYD84 | 61135.2 | 0.1 | 0.04 | 30 | 1.1 | 0.09 | 34 | — | — | — |
| LYD72 | 61163.3 | — | — | — | 1.0 | 0.24 | 24 | — | — | — |
| LYD72 | 61164.1 | 0.1 | 0.21 | 26 | — | — | — | 0.6 | 0.25 | 12 |
| LYD72 | 61164.3 | 0.1 | 0.01 | 43 | — | — | — | — | — | — |
| LYD72 | 61166.4 | 0.1 | 0.14 | 27 | — | — | — | — | — | — |
| LYD63 | 61228.2 | 0.1 | 0.20 | 20 | 1.0 | 0.27 | 20 | — | — | — |
| LYD63 | 61229.8 | — | — | — | 1.0 | 0.18 | 28 | — | — | — |
| LYD63 | 61231.1 | 0.1 | 0.06 | 41 | — | — | — | — | — | — |
| LYD286 | 61700.2 | 0.1 | 0.05 | 30 | 1.2 | L | 52 | 0.6 | 0.07 | 18 |
| LYD286 | 61701.2 | — | — | — | 1.0 | 0.16 | 29 | — | — | — |
| LYD286 | 61701.4 | 0.1 | 0.06 | 31 | — | — | — | — | — | — |
| LYD286 | 61703.2 | 0.1 | 0.04 | 40 | 1.2 | L | 52 | 0.6 | 0.13 | 15 |
| LYD28 | 61713.2 | 0.1 | 0.17 | 19 | 1.1 | 0.11 | 31 | — | — | — |
| LYD28 | 61716.2 | 0.1 | 0.02 | 48 | 1.2 | 0.02 | 47 | 0.6 | 0.12 | 17 |
| LYD268 | 61151.4 | — | — | — | 1.0 | 0.27 | 20 | — | — | — |
| LYD268 | 61152.3 | — | — | — | 1.2 | 0.03 | 49 | — | — | — |
| LYD268 | 61153.3 | — | — | — | 1.0 | 0.23 | 22 | — | — | — |
| LYD268 | 61153.6 | 0.1 | 0.06 | 29 | 1.0 | 0.24 | 21 | — | — | — |
| LYD26 | 61168.1 | 0.1 | 0.04 | 29 | 1.1 | 0.10 | 32 | — | — | — |
| LYD26 | 61169.3 | 0.1 | L | 36 | 1.0 | 0.24 | 26 | — | — | — |
| LYD26 | 61171.1 | 0.1 | 0.09 | 24 | — | — | — | — | — | — |
| LYD157 | 61156.3 | 0.1 | 0.21 | 18 | 1.0 | 0.13 | 28 | — | — | — |
| LYD157 | 61158.1 | 0.1 | L | 37 | 1.2 | 0.01 | 45 | — | — | — |
| LYD157 | 61158.5 | 0.1 | L | 50 | 1.0 | 0.17 | 25 | — | — | — |
| LYD115 | 61348.2 | 0.1 | 0.08 | 28 | 1.1 | 0.07 | 39 | — | — | — |
| LYD115 | 61349.1 | 0.1 | L | 39 | — | — | — | — | — | — |
| LYD115 | 61350.3 | 0.1 | 0.08 | 33 | 1.0 | 0.30 | 21 | — | — | — |
| LYD112 | 61144.1 | 0.1 | 0.09 | 25 | — | — | — | — | — | — |
| LYD109 | 61175.3 | 0.1 | 0.03 | 34 | 1.2 | 0.04 | 48 | 0.6 | 0.07 | 19 |
| LYD109 | 61178.2 | — | — | — | 1.0 | 0.16 | 27 | — | — | — |
| LYD106 | 61140.2 | 0.1 | 0.14 | 22 | 1.2 | 0.02 | 49 | 0.6 | 0.23 | 14 |
| LYD106 | 61140.4 | 0.1 | 0.01 | 49 | 1.3 | 0.01 | 54 | 0.6 | 0.14 | 15 |
| LYD106 | 61141.1 | 0.1 | 0.04 | 35 | — | — | — | — | — | — |
| CONT. | — | 0.0 | — | — | 0.8 | — | — | 0.5 | — | — |
| LYD96 | 60283.4 | 0.1 | L | 67 | 0.8 | L | 72 | 0.6 | 0.12 | 17 |
| LYD96 | 60285.1 | 0.1 | L | 49 | 0.8 | L | 68 | 0.6 | 0.16 | 15 |
| LYD96 | 60285.2 | — | — | — | — | — | — | 0.5 | 0.26 | 11 |
| LYD96 | 60286.2 | 0.1 | L | 56 | 0.8 | L | 64 | — | — | — |
| LYD96 | 60286.3 | 0.1 | L | 88 | 1.0 | L | 116 | 0.6 | L | 34 |
| LYD91 | 60685.6 | 0.1 | L | 78 | 1.0 | L | 113 | 0.6 | 0.13 | 15 |
| LYD91 | 60689.4 | 0.1 | 0.05 | 48 | 0.7 | 0.02 | 49 | — | — | — |
| LYD91 | 60690.1 | 0.1 | 0.01 | 36 | 0.7 | L | 42 | — | — | — |
| LYD71 | 60637.3 | 0.1 | L | 36 | — | — | — | 0.5 | 0.18 | 13 |
| LYD71 | 60638.1 | 0.1 | L | 108 | 1.0 | L | 116 | 0.6 | L | 35 |
| LYD71 | 60641.3 | 0.1 | L | 52 | 0.8 | L | 62 | 0.5 | 0.21 | 13 |
| LYD65 | 60625.3 | 0.1 | 0.07 | 26 | 0.9 | L | 80 | 0.6 | L | 33 |
| LYD65 | 60625.4 | 0.1 | 0.07 | 27 | 0.8 | L | 59 | 0.5 | 0.21 | 12 |
| LYD65 | 60626.2 | 0.1 | 0.08 | 24 | 0.8 | L | 73 | — | — | — |
| LYD65 | 60629.1 | 0.1 | 0.07 | 32 | 0.7 | L | 52 | — | — | — |
| LYD65 | 60629.2 | 0.1 | L | 45 | 0.8 | L | 62 | — | — | — |
| LYD287 | 60145.1 | 0.1 | L | 67 | 0.9 | L | 88 | 0.6 | 0.05 | 20 |

TABLE 35-continued

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD287 | 60145.2 | 0.1 | L | 69 | 0.8 | L | 59 | 0.5 | 0.27 | 11 |
| LYD287 | 60145.3 | 0.1 | 0.01 | 35 | 0.9 | L | 82 | 0.6 | L | 27 |
| LYD287 | 60146.1 | 0.1 | L | 63 | 0.9 | L | 82 | 0.6 | L | 29 |
| LYD287 | 60148.1 | 0.1 | L | 79 | 1.0 | L | 108 | 0.6 | 0.02 | 26 |
| LYD232 | 61640.2 | 0.1 | L | 91 | 0.8 | L | 63 | — | — | — |
| LYD232 | 61640.3 | 0.0 | 0.28 | 13 | — | — | — | — | — | — |
| LYD232 | 61641.1 | 0.1 | L | 79 | 0.9 | L | 91 | 0.6 | 0.08 | 18 |
| LYD232 | 61642.4 | 0.1 | 0.02 | 34 | 0.6 | 0.09 | 25 | — | — | — |
| LYD232 | 61643.4 | 0.1 | L | 79 | 0.9 | L | 92 | — | — | — |
| LYD227 | 60547.3 | 0.0 | 0.28 | 15 | 0.6 | 0.02 | 36 | 0.6 | 0.02 | 25 |
| LYD227 | 60548.3 | 0.1 | 0.01 | 34 | 0.8 | L | 74 | 0.6 | 0.03 | 24 |
| LYD227 | 60549.3 | 0.1 | 0.04 | 32 | 0.8 | L | 70 | 0.6 | 0.05 | 21 |
| LYD227 | 60551.1 | 0.1 | L | 54 | 0.8 | L | 73 | 0.5 | 0.19 | 13 |
| LYD227 | 60551.4 | 0.1 | L | 47 | 0.8 | L | 67 | — | — | — |
| LYD193 | 60504.2 | — | — | — | 0.6 | 0.08 | 22 | — | — | — |
| LYD193 | 60505.3 | — | — | — | 0.6 | L | 32 | — | — | — |
| LYD193 | 60506.4 | — | — | — | 0.6 | 0.03 | 30 | — | — | — |
| LYD178 | 61689.2 | — | — | — | 0.6 | 0.03 | 27 | — | — | — |
| LYD178 | 61690.3 | 0.1 | 0.03 | 34 | 0.7 | L | 36 | 0.6 | 0.03 | 22 |
| LYD178 | 61691.2 | — | — | — | 0.6 | 0.19 | 17 | — | — | — |
| LYD178 | 61691.4 | — | — | — | — | — | — | 0.6 | 0.17 | 16 |
| LYD156 | 60277.4 | 0.1 | L | 43 | 0.7 | L | 54 | 0.6 | 0.02 | 23 |
| LYD156 | 60280.1 | — | — | — | 0.6 | 0.12 | 19 | — | — | — |
| LYD156 | 60280.4 | — | — | — | 0.7 | L | 39 | 0.5 | 0.20 | 14 |
| LYD140 | 60383.3 | — | — | — | 0.8 | L | 61 | 0.6 | L | 29 |
| LYD140 | 60384.3 | — | — | — | 0.6 | 0.13 | 22 | 0.6 | 0.23 | 15 |
| LYD136 | 60441.3 | — | — | — | 0.6 | 0.11 | 21 | 0.6 | 0.13 | 16 |
| LYD136 | 60443.1 | 0.1 | 0.08 | 24 | 0.6 | 0.05 | 25 | 0.6 | 0.03 | 23 |
| LYD136 | 60444.1 | — | — | — | 0.7 | L | 36 | 0.6 | 0.10 | 18 |
| LYD136 | 60445.1 | 0.1 | 0.07 | 29 | 0.6 | 0.22 | 18 | — | — | — |
| LYD110 | 60391.3 | 0.1 | 0.05 | 27 | 0.6 | 0.02 | 31 | — | — | — |
| LYD110 | 60391.4 | 0.1 | L | 51 | 0.6 | 0.06 | 25 | — | — | — |
| LYD110 | 60392.1 | 0.1 | L | 75 | 0.8 | L | 61 | — | — | — |
| LYD110 | 60393.3 | — | — | — | 0.6 | 0.04 | 31 | 0.5 | 0.27 | 12 |
| LYD110 | 60394.4 | 0.1 | L | 42 | 0.6 | 0.02 | 31 | 0.6 | 0.01 | 27 |
| LYD103 | 60258.2 | 0.1 | L | 40 | 0.8 | L | 66 | 0.6 | L | 26 |
| LYD103 | 60261.6 | 0.1 | 0.03 | 31 | 0.7 | L | 49 | 0.6 | 0.01 | 27 |
| LYD103 | 60261.7 | — | — | — | 0.6 | 0.08 | 20 | 0.6 | 0.05 | 19 |
| CONT. | — | 0.0 | — | — | 0.5 | — | — | 0.5 | — | — |
| LYD78 | 60359.1 | 0.1 | 0.25 | 24 | 1.1 | 0.08 | 28 | — | — | — |
| LYD73 | 60368.4 | — | — | — | 1.4 | 0.01 | 55 | — | — | — |
| LYD47 | 60301.1 | — | — | — | 1.2 | 0.02 | 39 | 0.7 | 0.14 | 9 |
| LYD3 | 60375.3 | — | — | — | 1.3 | 0.01 | 41 | 0.7 | 0.03 | 17 |
| LYD236 | 60187.6 | 0.1 | 0.03 | 42 | — | — | — | — | — | — |
| LYD229 | 60338.4 | 0.1 | 0.06 | 32 | 1.3 | L | 48 | — | — | — |
| LYD221 | 60351.3 | — | — | — | 1.1 | 0.17 | 25 | — | — | — |
| LYD156 | 60280.1 | 0.1 | L | 58 | 1.3 | L | 41 | 0.7 | 0.30 | 7 |
| LYD132 | 60353.3 | 0.1 | 0.08 | 30 | 1.1 | 0.03 | 28 | — | — | — |
| LYD132 | 60356.2 | 0.1 | 0.08 | 37 | 1.2 | 0.09 | 30 | — | — | — |
| LYD132 | 60357.2 | — | — | — | 1.1 | 0.25 | 18 | — | — | — |
| LYD132 | 60357.3 | 0.1 | 0.22 | 23 | 1.3 | L | 49 | 0.7 | 0.16 | 9 |
| LYD132 | 60357.4 | 0.1 | 0.23 | 26 | 1.2 | 0.02 | 30 | — | — | — |
| LYD107 | 60341.2 | — | — | — | 1.2 | 0.02 | 37 | — | — | — |
| LYD107 | 60342.3 | 0.1 | 0.02 | 51 | 1.4 | L | 58 | — | — | — |
| LYD107 | 60343.3 | — | — | — | 1.2 | 0.01 | 40 | — | — | — |
| CONT. | — | 0.1 | — | — | 0.9 | — | — | 0.6 | — | — |
| LYD90 | 60828.2 | — | — | — | 0.7 | 0.28 | 23 | 0.7 | 0.15 | 23 |
| LYD90 | 60831.4 | — | — | — | — | — | — | 0.7 | 0.23 | 25 |
| LYD70 | 60852.3 | — | — | — | 1.0 | 0.01 | 75 | — | — | — |
| LYD70 | 60856.2 | — | — | — | 0.9 | L | 57 | 0.7 | 0.07 | 24 |
| LYD70 | 60856.4 | — | — | — | 1.0 | L | 71 | 0.7 | 0.20 | 17 |
| LYD7 | 60671.3 | — | — | — | 0.7 | 0.21 | 24 | — | — | — |
| LYD62 | 60810.2 | — | — | — | 0.9 | 0.12 | 45 | 0.7 | 0.23 | 25 |
| LYD240 | 60968.4 | — | — | — | 0.8 | 0.24 | 33 | 0.7 | 0.15 | 30 |
| LYD228 | 60402.1 | — | — | — | — | — | — | 0.7 | 0.15 | 31 |
| LYD228 | 60403.4 | — | — | — | 0.8 | 0.09 | 34 | — | — | — |
| LYD228 | 60405.1 | 0.1 | 0.29 | 31 | 1.0 | L | 62 | 0.7 | 0.14 | 23 |
| LYD219 | 60674.4 | — | — | — | — | — | — | 0.7 | 0.17 | 28 |
| LYD202 | 60421.2 | — | — | — | 0.8 | 0.07 | 33 | — | — | — |
| LYD202 | 60422.2 | — | — | — | 0.9 | 0.10 | 48 | — | — | — |
| LYD174 | 60816.4 | 0.1 | L | 96 | 1.1 | L | 83 | — | — | — |
| LYD174 | 60817.3 | 0.1 | 0.07 | 54 | — | — | — | — | — | — |
| LYD174 | 60818.3 | 0.1 | L | 89 | — | — | — | — | — | — |

TABLE 35-continued

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD16 | 60313.2 | — | — | — | 0.9 | 0.03 | 47 | 0.7 | 0.26 | 18 |
| LYD16 | 60314.1 | 0.1 | 0.23 | 35 | 0.8 | 0.05 | 35 | — | — | — |
| LYD16 | 60314.2 | 0.1 | 0.30 | 26 | 0.8 | 0.08 | 33 | — | — | — |
| LYD16 | 60315.1 | — | — | — | 0.8 | 0.10 | 31 | 0.7 | 0.25 | 16 |
| LYD16 | 60315.3 | 0.1 | 0.29 | 30 | 0.8 | 0.09 | 38 | 0.7 | 0.17 | 21 |
| LYD159 | 60662.3 | 0.1 | 0.03 | 59 | 1.2 | L | 102 | 0.7 | 0.09 | 23 |
| LYD159 | 60662.6 | — | — | — | 0.8 | 0.20 | 37 | 0.8 | 0.09 | 35 |
| LYD159 | 60665.1 | — | — | — | 0.9 | 0.03 | 44 | — | — | — |
| LYD159 | 60666.2 | — | — | — | 1.2 | L | 103 | 0.7 | 0.20 | 17 |
| LYD125 | 60823.1 | — | — | — | 0.9 | 0.09 | 54 | 0.7 | 0.20 | 27 |
| LYD125 | 60823.3 | — | — | — | 0.9 | 0.03 | 50 | — | — | — |
| LYD125 | 60826.2 | 0.1 | 0.11 | 47 | — | — | — | — | — | — |
| LYD123 | 60786.3 | 0.1 | 0.16 | 41 | 1.1 | L | 84 | 0.7 | 0.16 | 22 |
| LYD123 | 60789.2 | — | — | — | 0.9 | 0.01 | 54 | — | — | — |
| CONT. | — | 0.0 | — | — | 0.6 | — | — | 0.6 | — | — |
| LYD96 | 60285.1 | — | — | — | 0.8 | L | 32 | 0.6 | L | 25 |
| LYD96 | 60285.2 | 0.1 | L | 52 | 0.7 | 0.07 | 25 | — | — | — |
| LYD96 | 60285.3 | — | — | — | 1.1 | L | 87 | 0.7 | L | 36 |
| LYD96 | 60286.2 | 0.1 | 0.30 | 20 | 0.7 | 0.22 | 12 | — | — | — |
| LYD96 | 60286.3 | 0.1 | L | 104 | 0.9 | L | 59 | 0.5 | 0.25 | 9 |
| LYD91 | 60685.6 | 0.1 | L | 97 | 1.1 | L | 79 | 0.6 | L | 26 |
| LYD91 | 60689.3 | — | — | — | 0.7 | 0.10 | 21 | — | — | — |
| LYD91 | 60689.4 | — | — | — | 0.7 | 0.10 | 18 | — | — | — |
| LYD91 | 60690.2 | — | — | — | 0.7 | 0.06 | 19 | — | — | — |
| LYD71 | 60637.3 | — | — | — | 0.7 | 0.06 | 23 | 0.6 | 0.10 | 14 |
| LYD71 | 60641.2 | 0.1 | L | 93 | 0.9 | L | 51 | 0.5 | 0.20 | 11 |
| LYD71 | 60641.3 | 0.1 | L | 87 | 0.9 | L | 46 | 0.5 | 0.18 | 11 |
| LYD65 | 60625.2 | — | — | — | 0.8 | L | 40 | 0.5 | 0.15 | 12 |
| LYD65 | 60625.3 | — | — | — | 0.8 | L | 38 | 0.6 | 0.03 | 18 |
| LYD65 | 60625.4 | 0.1 | L | 51 | 0.9 | L | 52 | — | — | — |
| LYD65 | 60626.2 | 0.1 | L | 55 | 1.0 | L | 67 | 0.6 | L | 25 |
| LYD287 | 60145.1 | 0.1 | L | 86 | 1.0 | L | 67 | 0.6 | 0.13 | 13 |
| LYD287 | 60145.3 | — | — | — | 0.8 | L | 42 | — | — | — |
| LYD287 | 60146.1 | — | — | — | 0.8 | L | 33 | — | — | — |
| LYD287 | 60146.3 | 0.1 | 0.12 | 26 | 0.9 | L | 49 | 0.6 | 0.09 | 14 |
| LYD232 | 61641.1 | — | — | — | 0.8 | L | 37 | 0.6 | 0.06 | 18 |
| LYD232 | 61641.4 | 0.1 | L | 55 | 0.8 | L | 35 | — | — | — |
| LYD232 | 61643.4 | 0.1 | 0.08 | 30 | 0.7 | 0.15 | 18 | — | — | — |
| LYD227 | 60547.3 | — | — | — | 0.9 | L | 49 | 0.6 | L | 27 |
| LYD227 | 60548.3 | 0.1 | L | 58 | 0.9 | L | 49 | 0.6 | 0.10 | 14 |
| LYD227 | 60549.3 | 0.1 | 0.04 | 33 | 0.9 | L | 59 | 0.6 | 0.03 | 17 |
| LYD227 | 60551.1 | 0.1 | 0.05 | 32 | 0.8 | L | 35 | — | — | — |
| LYD227 | 60551.4 | — | — | — | 0.7 | 0.02 | 24 | — | — | — |
| LYD214 | 60127.5 | 0.1 | 0.02 | 43 | 1.0 | L | 62 | 0.6 | 0.04 | 17 |
| LYD214 | 60129.1 | 0.1 | 0.03 | 36 | 0.7 | 0.10 | 17 | — | — | — |
| LYD214 | 60130.1 | — | — | — | — | — | — | 0.5 | 0.19 | 11 |
| LYD214 | 60130.3 | 0.1 | 0.01 | 46 | 0.8 | L | 43 | 0.6 | 0.05 | 17 |
| LYD193 | 60504.2 | — | — | — | 0.7 | 0.06 | 21 | 0.5 | 0.25 | 9 |
| LYD193 | 60505.2 | — | — | — | — | — | — | 0.5 | 0.25 | 10 |
| LYD193 | 60505.3 | 0.1 | 0.08 | 28 | 0.7 | 0.15 | 15 | — | — | — |
| LYD193 | 60506.1 | — | — | — | 0.8 | L | 31 | 0.6 | 0.04 | 17 |
| LYD193 | 60506.4 | — | — | — | 0.8 | 0.01 | 28 | 0.6 | 0.08 | 15 |
| LYD178 | 61689.2 | 0.1 | 0.04 | 36 | 0.9 | L | 53 | 0.6 | L | 25 |
| LYD178 | 61690.1 | — | — | — | 0.8 | L | 31 | 0.6 | 0.11 | 14 |
| LYD178 | 61690.3 | 0.1 | L | 67 | 0.8 | L | 39 | — | — | — |
| LYD178 | 61691.2 | 0.1 | L | 47 | 1.0 | L | 63 | 0.6 | 0.02 | 19 |
| LYD178 | 61691.4 | — | — | — | 0.9 | L | 47 | 0.6 | 0.02 | 21 |
| LYD148 | 60431.3 | 0.1 | 0.23 | 23 | 1.0 | L | 63 | 0.6 | L | 26 |
| LYD148 | 60432.1 | — | — | — | 0.9 | L | 61 | 0.6 | L | 27 |
| LYD148 | 60433.2 | — | — | — | 0.7 | 0.20 | 14 | — | — | — |
| LYD148 | 60434.3 | 0.1 | L | 56 | 0.9 | L | 50 | 0.6 | 0.10 | 15 |
| LYD148 | 60434.4 | — | — | — | 1.1 | L | 80 | 0.6 | L | 31 |
| LYD140 | 60381.4 | — | — | — | 1.0 | L | 66 | 0.6 | L | 31 |
| LYD140 | 60382.3 | 0.1 | 0.12 | 30 | 0.9 | L | 57 | 0.6 | L | 24 |
| LYD140 | 60383.2 | 0.1 | 0.12 | 25 | 0.9 | L | 52 | 0.6 | L | 27 |
| LYD140 | 60383.3 | 0.1 | L | 66 | 1.0 | L | 61 | 0.6 | 0.04 | 18 |
| LYD140 | 60384.2 | 0.1 | 0.02 | 43 | 0.7 | 0.05 | 22 | — | — | — |
| LYD136 | 60441.3 | 0.1 | 0.05 | 33 | 0.9 | L | 51 | 0.6 | 0.12 | 14 |
| LYD136 | 60443.1 | 0.1 | 0.01 | 48 | 0.8 | L | 39 | 0.5 | 0.23 | 10 |
| LYD136 | 60444.1 | — | — | — | 0.8 | L | 31 | 0.5 | 0.18 | 11 |
| LYD136 | 60444.3 | — | — | — | 0.9 | L | 53 | 0.6 | L | 27 |
| LYD110 | 60391.2 | 0.1 | 0.03 | 50 | 0.7 | 0.21 | 15 | — | — | — |
| LYD110 | 60392.1 | 0.1 | L | 53 | 0.9 | L | 54 | 0.6 | 0.02 | 21 |

TABLE 35-continued

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD110 | 60393.3 | 0.1 | 0.01 | 42 | 1.1 | L | 87 | 0.7 | L | 35 |
| LYD110 | 60393.4 | 0.1 | L | 96 | 1.0 | L | 71 | — | — | — |
| LYD110 | 60394.4 | — | — | — | 0.9 | L | 54 | 0.6 | 0.01 | 21 |
| CONT. | — | 0.0 | — | — | 0.6 | — | — | 0.5 | — | — |
| LYD99 | 60325.5 | — | — | — | 0.7 | L | 33 | 0.6 | L | 28 |
| LYD99 | 60327.5 | — | — | — | 0.9 | L | 59 | 0.7 | L | 37 |
| LYD99 | 60327.7 | — | — | — | 0.7 | L | 23 | 0.6 | L | 24 |
| LYD99 | 60328.5 | — | — | — | 0.7 | 0.07 | 24 | — | — | — |
| LYD99 | 60328.6 | — | — | — | 0.6 | 0.06 | 18 | — | — | — |
| LYD88 | 61706.3 | — | — | — | 0.6 | 0.06 | 16 | 0.6 | L | 26 |
| LYD88 | 61707.3 | — | — | — | 0.8 | L | 43 | 0.6 | 0.01 | 26 |
| LYD88 | 61707.4 | — | — | — | 0.7 | 0.02 | 36 | 0.6 | L | 35 |
| LYD88 | 61709.1 | — | — | — | 1.1 | L | 97 | — | — | — |
| LYD88 | 61709.2 | — | — | — | 0.6 | 0.10 | 17 | 0.5 | 0.22 | 11 |
| LYD58 | 61306.2 | — | — | — | 0.6 | 0.15 | 12 | 0.6 | 0.01 | 20 |
| LYD58 | 61307.3 | — | — | — | 0.8 | L | 49 | 0.5 | 0.08 | 14 |
| LYD58 | 61308.2 | — | — | — | 0.9 | L | 66 | 0.6 | 0.04 | 19 |
| LYD283 | 61317.4 | 0.0 | 0.13 | 18 | 0.7 | L | 36 | 0.6 | L | 28 |
| LYD283 | 61319.3 | 0.1 | L | 48 | 1.0 | L | 86 | 0.6 | 0.02 | 27 |
| LYD283 | 61320.1 | — | — | — | 0.6 | 0.22 | 12 | 0.5 | 0.06 | 14 |
| LYD283 | 61320.2 | — | — | — | 0.6 | 0.14 | 14 | 0.5 | 0.26 | 10 |
| LYD28 | 61712.1 | — | — | — | 0.6 | 0.17 | 16 | 0.5 | 0.07 | 14 |
| LYD28 | 61714.6 | — | — | — | 0.7 | 0.05 | 20 | 0.6 | 0.04 | 21 |
| LYD28 | 61716.2 | — | — | — | 0.8 | L | 51 | 0.6 | 0.04 | 16 |
| LYD269 | 61460.2 | — | — | — | 0.6 | 0.21 | 14 | 0.6 | 0.04 | 20 |
| LYD269 | 61461.4 | — | — | — | 0.6 | 0.22 | 12 | 0.6 | 0.06 | 16 |
| LYD269 | 61462.1 | — | — | — | 0.6 | 0.30 | 12 | 0.6 | 0.02 | 23 |
| LYD269 | 61462.2 | — | — | — | 0.9 | L | 58 | 0.6 | 0.01 | 22 |
| LYD264 | 61526.1 | — | — | — | — | — | — | 0.6 | 0.03 | 21 |
| LYD264 | 61529.3 | — | — | — | 0.7 | 0.12 | 20 | — | — | — |
| LYD262 | 61340.1 | — | — | — | 0.9 | L | 61 | 0.5 | 0.12 | 13 |
| LYD262 | 61344.1 | — | — | — | — | — | — | 0.6 | 0.05 | 20 |
| LYD259 | 61301.1 | 0.1 | 0.02 | 32 | 0.7 | L | 28 | 0.5 | 0.15 | 10 |
| LYD259 | 61301.2 | — | — | — | 0.6 | 0.12 | 13 | 0.6 | L | 28 |
| LYD259 | 61302.3 | 0.0 | 0.30 | 15 | 0.8 | 0.02 | 41 | 0.5 | 0.30 | 11 |
| LYD259 | 61302.6 | 0.1 | 0.03 | 31 | 1.1 | L | 95 | 0.7 | L | 38 |
| LYD230 | 61332.3 | — | — | — | — | — | — | 0.5 | 0.13 | 13 |
| LYD230 | 61334.5 | — | — | — | 0.6 | 0.26 | 15 | — | — | — |
| LYD222 | 61327.3 | — | — | — | — | — | — | 0.5 | 0.07 | 14 |
| LYD222 | 61328.1 | — | — | — | — | — | — | 0.6 | 0.02 | 19 |
| LYD222 | 61329.3 | 0.0 | 0.23 | 16 | 0.6 | 0.29 | 13 | 0.5 | 0.18 | 11 |
| LYD187 | 61312.4 | — | — | — | 0.7 | 0.06 | 22 | — | — | — |
| LYD187 | 61313.2 | — | — | — | 0.7 | L | 30 | 0.6 | L | 25 |
| LYD187 | 61314.2 | — | — | — | 0.6 | 0.18 | 10 | — | — | — |
| LYD152 | 61352.1 | — | — | — | — | — | — | 0.5 | 0.22 | 9 |
| LYD152 | 61352.4 | — | — | — | 0.7 | L | 32 | 0.6 | 0.05 | 18 |
| LYD152 | 61352.5 | — | — | — | 0.6 | 0.16 | 17 | — | — | — |
| LYD152 | 61355.3 | — | — | — | 0.9 | L | 62 | 0.6 | 0.04 | 23 |
| LYD150 | 61323.2 | — | — | — | 0.6 | 0.29 | 11 | 0.6 | 0.01 | 26 |
| LYD150 | 61324.1 | — | — | — | 0.7 | 0.13 | 24 | — | — | — |
| LYD150 | 61324.2 | 0.0 | 0.21 | 15 | 0.7 | L | 28 | 0.5 | 0.14 | 12 |
| LYD150 | 61325.4 | — | — | — | 0.6 | 0.22 | 12 | 0.6 | 0.03 | 21 |
| LYD150 | 61326.1 | — | — | — | 0.8 | L | 47 | 0.6 | 0.05 | 18 |
| LYD108 | 61294.1 | 0.1 | L | 56 | 0.8 | L | 39 | 0.6 | 0.02 | 21 |
| LYD108 | 61294.4 | 0.1 | 0.16 | 36 | 0.6 | 0.19 | 11 | 0.6 | 0.04 | 16 |
| LYD108 | 61297.2 | 0.1 | L | 47 | 0.8 | L | 54 | 0.6 | L | 27 |
| LYD108 | 61297.4 | 0.1 | L | 58 | 0.7 | L | 26 | — | — | — |
| CONT. | — | 0.0 | — | — | 0.5 | — | — | 0.5 | — | — |
| LYD99 | 60325.5 | — | — | — | 1.0 | 0.27 | 14 | — | — | — |
| LYD99 | 60328.6 | — | — | — | 1.1 | 0.11 | 20 | — | — | — |
| LYD78 | 60362.4 | 0.1 | L | 55 | 1.4 | L | 55 | 0.6 | 0.19 | 11 |
| LYD73 | 60367.2 | — | — | — | — | — | — | 0.6 | 0.13 | 12 |
| LYD73 | 60368.4 | — | — | — | 1.2 | 0.01 | 28 | 0.6 | 0.16 | 11 |
| LYD47 | 60300.4 | — | — | — | — | — | — | 0.7 | 0.07 | 14 |
| LYD47 | 60301.4 | 0.1 | L | 71 | 1.3 | 0.02 | 43 | — | — | — |
| LYD3 | 60372.4 | 0.1 | L | 45 | 1.2 | 0.05 | 32 | — | — | — |
| LYD3 | 60375.1 | 0.1 | 0.28 | 14 | 1.1 | 0.07 | 22 | 0.6 | 0.28 | 9 |
| LYD3 | 60375.3 | — | — | — | — | — | — | 0.6 | 0.10 | 13 |
| LYD269 | 61461.4 | — | — | — | 1.1 | 0.21 | 17 | — | — | — |
| LYD269 | 61462.1 | — | — | — | 1.1 | 0.08 | 21 | — | — | — |
| LYD264 | 61526.1 | 0.1 | L | 93 | 1.5 | L | 62 | 0.6 | 0.14 | 13 |
| LYD264 | 61526.3 | 0.1 | L | 76 | 1.4 | L | 54 | 0.6 | 0.16 | 12 |
| LYD264 | 61527.4 | 0.1 | L | 58 | 1.2 | L | 33 | — | — | — |

TABLE 35-continued

Genes showing improved plant performance at Normal growth conditions under regulation of 6669 promoter

| Gene Name | Event # | RGR Of Leaf Area Ave. | P-Val. | % Incr. | RGR Of Root Coverage Ave. | P-Val. | % Incr. | RGR Of Roots Length Ave. | P-Val. | % Incr. |
|---|---|---|---|---|---|---|---|---|---|---|
| LYD264 | 61530.4 | 0.1 | 0.21 | 17 | 1.2 | 0.07 | 29 | — | — | — |
| LYD262 | 61340.1 | — | — | — | 1.0 | 0.23 | 15 | — | — | — |
| LYD262 | 61341.2 | 0.1 | 0.01 | 29 | — | — | — | — | — | — |
| LYD262 | 61342.1 | 0.1 | L | 47 | — | — | — | — | — | — |
| LYD262 | 61342.2 | 0.1 | 0.02 | 34 | — | — | — | — | — | — |
| LYD262 | 61342.3 | — | — | — | 1.0 | 0.28 | 12 | — | — | — |
| LYD261 | 61521.4 | 0.1 | L | 77 | 1.5 | L | 66 | 0.6 | 0.28 | 10 |
| LYD261 | 61522.2 | 0.1 | L | 36 | 1.3 | L | 38 | — | — | — |
| LYD261 | 61522.3 | 0.1 | 0.16 | 16 | 1.4 | L | 51 | — | — | — |
| LYD261 | 61524.2 | 0.1 | 0.26 | 12 | 1.1 | 0.04 | 22 | — | — | — |
| LYD252 | 61052.4 | 0.1 | 0.24 | 14 | 1.1 | 0.06 | 21 | 0.7 | 0.04 | 17 |
| LYD252 | 61052.5 | — | — | — | 1.1 | 0.14 | 17 | — | — | — |
| LYD252 | 61054.3 | — | — | — | 1.0 | 0.26 | 14 | 0.6 | 0.08 | 14 |
| LYD252 | 61055.2 | 0.1 | 0.08 | 29 | 1.1 | 0.14 | 21 | 0.6 | 0.20 | 11 |
| LYD229 | 60336.3 | 0.1 | L | 62 | — | — | — | — | — | — |
| LYD229 | 60337.1 | 0.1 | L | 57 | 1.2 | L | 29 | — | — | — |
| LYD229 | 60337.2 | 0.1 | L | 77 | 1.2 | L | 36 | — | — | — |
| LYD229 | 60338.4 | 0.1 | L | 71 | 1.8 | L | 94 | — | — | — |
| LYD229 | 60339.4 | 0.1 | L | 42 | 1.2 | 0.01 | 35 | — | — | — |
| LYD132 | 60353.3 | 0.1 | L | 101 | 1.5 | L | 69 | 0.7 | 0.06 | 16 |
| LYD132 | 60356.2 | 0.1 | 0.02 | 32 | 1.2 | 0.01 | 34 | — | — | — |
| LYD132 | 60357.2 | 0.1 | L | 42 | 1.3 | L | 48 | — | — | — |
| LYD132 | 60357.3 | 0.1 | 0.05 | 23 | 1.1 | 0.09 | 20 | — | — | — |
| LYD132 | 60357.4 | 0.1 | L | 48 | 1.4 | L | 53 | 0.7 | 0.08 | 15 |
| LYD107 | 60341.2 | 0.1 | L | 56 | 1.4 | L | 52 | — | — | — |
| LYD107 | 60342.2 | 0.1 | L | 67 | 1.6 | L | 73 | 0.6 | 0.13 | 14 |
| LYD107 | 60342.3 | 0.1 | L | 46 | 1.2 | 0.03 | 27 | 0.6 | 0.29 | 9 |
| LYD107 | 60342.4 | 0.1 | L | 35 | 1.1 | 0.11 | 20 | — | — | — |
| LYD107 | 60343.3 | 0.1 | L | 70 | 1.4 | L | 52 | 0.7 | 0.09 | 14 |
| CONT. | — | 0.1 | — | — | 0.9 | — | — | 0.6 | — | — |
| LYD85 | 60014.2 | — | — | — | 0.9 | 0.11 | 21 | — | — | — |
| LYD85 | 60014.4 | 0.1 | 0.06 | 41 | 1.7 | L | 138 | 0.7 | 0.01 | 28 |
| LYD85 | 60016.4 | — | — | — | 0.9 | 0.02 | 25 | — | — | — |
| LYD79 | 60018.2 | — | — | — | 1.1 | L | 57 | 0.6 | 0.19 | 15 |
| LYD79 | 60020.4 | 0.1 | 0.22 | 26 | 1.2 | L | 71 | 0.6 | 0.15 | 15 |
| LYD55 | 60174.1 | 0.1 | 0.02 | 48 | 1.1 | L | 53 | 0.6 | 0.18 | 15 |
| LYD55 | 60175.4 | 0.1 | 0.04 | 42 | 1.0 | L | 34 | 0.6 | 0.29 | 11 |
| LYD55 | 60177.2 | 0.1 | L | 77 | 1.2 | L | 72 | — | — | — |
| LYD43 | 60610.4 | 0.1 | 0.05 | 32 | 0.9 | 0.03 | 31 | — | — | — |
| LYD43 | 60611.2 | — | — | — | 0.8 | 0.27 | 13 | — | — | — |
| LYD33 | 60159.3 | — | — | — | 1.0 | L | 46 | — | — | — |
| LYD33 | 60159.5 | — | — | — | 1.0 | L | 34 | 0.7 | 0.13 | 17 |
| LYD33 | 60160.2 | 0.1 | 0.07 | 35 | 1.3 | L | 86 | 0.7 | 0.01 | 29 |
| LYD33 | 60160.4 | — | — | — | — | — | — | 0.6 | 0.25 | 14 |
| LYD235 | 60929.3 | — | — | — | 0.9 | 0.10 | 19 | 0.6 | 0.29 | 12 |
| LYD235 | 60930.2 | — | — | — | 0.8 | 0.17 | 16 | — | — | — |
| LYD235 | 60930.6 | 0.1 | 0.01 | 42 | 0.9 | 0.03 | 26 | 0.7 | 0.06 | 20 |
| LYD235 | 60931.2 | — | — | — | — | — | — | 0.6 | 0.23 | 13 |
| LYD204 | 60703.1 | 0.1 | L | 62 | 1.0 | L | 36 | — | — | — |
| LYD204 | 60704.4 | 0.1 | 0.01 | 42 | 0.9 | L | 29 | — | — | — |
| LYD20 | 60066.2 | 0.1 | L | 57 | 0.9 | 0.01 | 32 | — | — | — |
| LYD20 | 60069.4 | 0.1 | 0.03 | 44 | 1.3 | L | 77 | 0.7 | 0.13 | 18 |
| LYD102 | 60959.1 | 0.1 | 0.02 | 43 | — | — | — | — | — | — |
| LYD102 | 60960.1 | 0.1 | L | 60 | 1.1 | L | 59 | 0.7 | 0.06 | 21 |
| LYD102 | 60961.3 | — | — | — | 0.9 | 0.12 | 20 | — | — | — |
| CONT. | — | 0.1 | — | — | 0.7 | — | — | 0.6 | — | — |
| LYD238 | 60452.3 | 0.1 | 0.23 | 22 | — | — | — | — | — | — |
| LYD238 | 60453.2 | 0.1 | 0.06 | 32 | 1.1 | 0.08 | 29 | 0.6 | 0.11 | 14 |
| LYD216 | 60330.4 | 0.1 | 0.15 | 30 | — | — | — | — | — | — |
| LYD216 | 60331.4 | 0.1 | L | 86 | 1.4 | L | 66 | 0.6 | 0.29 | 10 |
| LYD216 | 60333.3 | 0.1 | 0.06 | 72 | 1.5 | L | 77 | 0.6 | 0.04 | 20 |
| LYD216 | 60333.4 | 0.1 | 0.12 | 35 | — | — | — | — | — | — |
| LYD215 | 60412.2 | — | — | — | 1.0 | 0.16 | 26 | — | — | — |
| LYD215 | 60412.4 | 0.0 | 0.28 | 15 | 1.0 | 0.15 | 24 | 0.6 | 0.04 | 21 |
| LYD215 | 60414.1 | — | — | — | 1.1 | 0.08 | 31 | 0.6 | 0.16 | 15 |
| LYD215 | 60415.1 | — | — | — | 1.6 | L | 93 | — | — | — |
| LYD215 | 60415.4 | — | — | — | 1.2 | 0.02 | 47 | 0.6 | 0.03 | 22 |
| LYD212 | 60521.3 | 0.1 | 0.08 | 27 | 1.2 | L | 48 | 0.6 | 0.05 | 17 |
| LYD212 | 60522.3 | 0.1 | 0.21 | 27 | 1.3 | L | 54 | 0.6 | 0.11 | 14 |
| LYD212 | 60524.3 | 0.1 | 0.21 | 20 | 1.0 | 0.15 | 23 | 0.6 | 0.01 | 20 |
| LYD212 | 60525.2 | — | — | — | 1.0 | 0.18 | 23 | 0.6 | 0.16 | 13 |
| LYD211 | 60308.2 | 0.1 | 0.18 | 22 | 1.1 | 0.10 | 30 | — | — | — |
| LYD211 | 60308.3 | 0.1 | L | 70 | 1.4 | L | 70 | 0.6 | 0.02 | 19 |

TABLE 35-continued

Genes showing improved plant performance at Normal growth conditions under regulation of 6669 promoter

| Gene Name | Event # | RGR Of Leaf Area | | | RGR Of Root Coverage | | | RGR Of Roots Length | | |
|---|---|---|---|---|---|---|---|---|---|---|
| | | Ave. | P-Val. | % Incr. | Ave. | P-Val. | % Incr. | Ave. | P-Val. | % Incr. |
| LYD209 | 60294.4 | 0.1 | 0.10 | 40 | 1.2 | 0.02 | 41 | 0.6 | 0.09 | 15 |
| LYD209 | 60295.4 | — | — | — | 1.1 | 0.07 | 32 | — | — | — |
| LYD209 | 60297.3 | — | — | — | 1.0 | 0.12 | 26 | — | — | — |
| LYD209 | 60297.4 | 0.1 | L | 126 | 1.4 | L | 72 | 0.6 | 0.02 | 18 |
| LYD206 | 60491.5 | 0.1 | 0.13 | 30 | 1.4 | L | 64 | 0.7 | L | 25 |
| LYD206 | 60492.1 | 0.1 | L | 69 | 1.5 | L | 80 | 0.6 | 0.22 | 13 |
| LYD206 | 60492.3 | — | — | — | 1.1 | 0.02 | 38 | — | — | — |
| LYD206 | 60493.2 | 0.1 | 0.08 | 30 | 1.2 | 0.01 | 48 | 0.6 | 0.06 | 17 |
| LYD206 | 60494.1 | — | — | — | 1.2 | 0.03 | 43 | 0.6 | 0.12 | 14 |
| LYD201 | 60168.2 | 0.1 | 0.11 | 35 | 1.1 | 0.07 | 35 | — | — | — |
| LYD201 | 60168.4 | 0.1 | L | 62 | 1.0 | 0.15 | 25 | — | — | — |
| LYD201 | 60170.1 | 0.1 | 0.19 | 23 | — | — | — | 0.6 | 0.04 | 18 |
| LYD201 | 60172.1 | — | — | — | 1.1 | 0.08 | 35 | 0.6 | L | 23 |
| LYD196 | 60567.1 | — | — | — | 1.0 | 0.28 | 17 | 0.6 | 0.06 | 15 |
| LYD196 | 60569.1 | — | — | — | 1.1 | 0.05 | 32 | 0.6 | 0.24 | 10 |
| LYD196 | 60569.3 | 0.1 | 0.02 | 40 | 1.2 | L | 47 | 0.6 | 0.01 | 22 |
| LYD177 | 60571.1 | 0.1 | 0.11 | 29 | 1.2 | L | 46 | 0.6 | 0.05 | 16 |
| LYD177 | 60571.4 | 0.1 | 0.11 | 25 | 1.2 | L | 45 | 0.6 | 0.15 | 13 |
| LYD177 | 60572.1 | — | — | — | 1.3 | L | 58 | 0.6 | 0.11 | 16 |
| LYD177 | 60573.2 | 0.1 | 0.12 | 28 | 1.1 | 0.10 | 29 | 0.6 | 0.29 | 10 |
| LYD177 | 60574.3 | 0.1 | 0.05 | 50 | 1.4 | L | 64 | 0.6 | 0.04 | 17 |
| LYD167 | 60472.1 | 0.1 | 0.29 | 20 | 1.5 | L | 83 | 0.6 | 0.23 | 12 |
| LYD167 | 60473.1 | 0.1 | 0.17 | 29 | 1.0 | 0.17 | 23 | 0.6 | 0.02 | 21 |
| LYD167 | 60473.3 | — | — | — | 1.0 | 0.13 | 24 | — | — | — |
| LYD149 | 60511.3 | — | — | — | 1.1 | 0.05 | 33 | — | — | — |
| LYD149 | 60513.3 | 0.1 | L | 43 | 1.3 | L | 59 | 0.6 | 0.09 | 16 |
| LYD149 | 60513.4 | 0.1 | 0.05 | 30 | 1.2 | 0.02 | 40 | 0.6 | 0.05 | 16 |
| LYD149 | 60515.2 | 0.1 | 0.04 | 36 | 1.1 | 0.09 | 29 | — | — | — |
| LYD120 | 60882.1 | 0.1 | 0.15 | 24 | — | — | — | 0.6 | 0.16 | 12 |
| LYD120 | 60882.3 | 0.1 | 0.15 | 22 | — | — | — | — | — | — |
| LYD120 | 60883.2 | — | — | — | 1.1 | 0.11 | 29 | — | — | — |
| LYD120 | 60884.1 | 0.1 | 0.03 | 33 | 1.0 | 0.24 | 20 | 0.6 | 0.22 | 12 |
| LYD120 | 60884.3 | 0.1 | L | 58 | 1.2 | 0.02 | 43 | 0.6 | 0.05 | 17 |
| LYD1 | 61682.3 | — | — | — | 1.1 | 0.05 | 32 | 0.6 | 0.08 | 15 |
| LYD1 | 61685.1 | 0.1 | 0.10 | 33 | 1.3 | L | 56 | 0.6 | L | 24 |
| LYD1 | 61685.3 | — | — | — | 1.1 | 0.03 | 36 | 0.6 | 0.27 | 9 |
| LYD1 | 61685.4 | — | — | — | 1.2 | L | 45 | 0.6 | 0.01 | 23 |
| LYD1 | 61686.3 | 0.1 | L | 51 | 1.5 | L | 75 | 0.6 | 0.03 | 20 |
| CONT. | — | 0.0 | — | — | 0.8 | — | — | 0.5 | — | — |
| LYD200 | 60481.2 | 0.1 | 0.12 | 26 | 1.2 | 0.08 | 28 | — | — | — |
| LYD200 | 60482.1 | — | — | — | 1.2 | L | 36 | — | — | — |
| LYD200 | 60485.2 | 0.1 | 0.21 | 17 | — | — | — | — | — | — |
| LYD158 | 60581.4 | 0.1 | 0.08 | 31 | 1.4 | L | 54 | — | — | — |
| LYD153 | 60697.3 | — | — | — | 1.0 | 0.25 | 16 | — | — | — |
| LYD153 | 60698.3 | 0.1 | L | 67 | 1.4 | L | 54 | 0.7 | 0.17 | 12 |
| LYD153 | 60698.6 | 0.1 | 0.13 | 20 | — | — | — | — | — | — |
| LYD153 | 60700.3 | 0.1 | 0.17 | 20 | 1.0 | 0.26 | 15 | — | — | — |
| LYD148 | 60432.1 | — | — | — | 1.2 | 0.03 | 35 | — | — | — |
| LYD148 | 60432.4 | 0.1 | 0.03 | 39 | 1.5 | L | 61 | — | — | — |
| LYD148 | 60434.3 | — | — | — | 1.1 | 0.05 | 26 | — | — | — |
| LYD144 | 60864.2 | 0.1 | 0.19 | 20 | 1.2 | L | 38 | — | — | — |
| LYD144 | 60866.1 | 0.1 | 0.20 | 18 | — | — | — | — | — | — |
| LYD144 | 60866.4 | — | — | — | 1.1 | 0.15 | 20 | — | — | — |
| LYD129 | 60792.1 | 0.1 | 0.05 | 27 | — | — | — | — | — | — |
| LYD127 | 60681.1 | 0.1 | 0.08 | 30 | 1.4 | L | 59 | 0.7 | 0.10 | 15 |
| LYD127 | 60682.3 | 0.1 | 0.26 | 15 | 1.0 | 0.29 | 14 | — | — | — |
| LYD127 | 60683.1 | — | — | — | 1.2 | 0.04 | 28 | — | — | — |
| LYD101 | 60075.3 | 0.1 | 0.03 | 30 | — | — | — | — | — | — |
| CONT. | — | 0.0 | — | — | 0.9 | — | — | 0.6 | — | — |

Table 35. "CONT."—Control; "Ave."—Average; "% Incr." = % increment; "p-val."—p-value, L—p < 0.01. Values are provided per plant.

Results from T1 Plants

The genes presented in Tables 36-39 showed a significant improvement in plant biomass and root development since they produced a larger leaf and root biomass (root length and root coverage) (Table 36), a larger leaf and root biomass (leaf area, root length and root coverage; Table 37), a higher relative growth rate of leaf area, root coverage and root length (Table 38), and a higher fresh and dry weight (Table 39) when to grown under standard or low nitrogen growth conditions, compared to control plants. Plants producing larger root biomass have better possibilities to absorb larger amount of nitrogen from soil. Plants producing larger leaf biomass have better ability to produce assimilates). The genes were cloned under the regulation of a constitutive promoter (At6669; SEQ ID NO:8096) or root preferred promoter (RootP). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant

TABLE 36

Genes showing improved plant performance at Low Nitrogen growth conditions under regulation of promoter

| Gene Name | Leaf Area [cm2] | | | Roots Coverage [cm2] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD185* | — | — | — | 1.27 | 0.04 | 18 | 2.12 | 0.1 | 7 |

Table 36.
"CONT."—Control;
"Ave."—Average;
"% Incr." = % increment;
"p-val."—p-value,
L—p < 0.01.
*measured at day 9 from planting

TABLE 37

Genes showing improved plant performance at standard growth conditions (T1 generation) under the regulation of the At6669 promoter

| Gene Name | Leaf Area [cm2] | | | Roots Coverage [cm2] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD267_H0 | 0.5 | 0.13 | 17 | 4.1 | 0.19 | 12 | — | — | — |
| LYD188* | — | — | — | 0.07 | 0.23 | 79 | 0.4 | 0.3 | 29 |
| CONT. | 0.5 | — | — | 3.7 | — | — | — | — | — |

Table 37.
"CONT."—Control;
"Ave."—Average;
"% Incr." = % increment;
"p-val."—p-value.
*measured at day 5 from planting.

TABLE 38

Genes showing improved growth rate at standard growth conditions (T1 generation) under the regulation of the At6669 promoter

| Gene Name | RGR Of Leaf Area | | | RGR Of Roots Coverage | | | RGR Of Roots Length | | |
|---|---|---|---|---|---|---|---|---|---|
| | Ave. | p-val. | % Incr. | Ave. | p-val. | % Incr. | Ave. | p-val. | % Incr. |
| LYD267_H0 | 0.1 | 0.24 | 18 | 0.5 | 0.27 | 13 | — | — | — |
| LYD265 | — | — | — | 0.6 | 0.17 | 33 | — | — | — |
| LYD248 | — | — | — | 0.5 | 0.25 | 15 | — | — | — |
| CONT. | 0.0 | — | — | 0.5 | — | — | — | — | — |

Table 38.
"CONT."—Control;
"Ave."—Average;
"% Incr." = % increment;
"p-val."—p-value.

TABLE 39

Genes showing improved plant performance at Low Nitrogen growth conditions under regulation of 6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYD248 | 7.1 | 0.03 | 59 | — | — | — |
| LYD128_H1 | — | — | — | 132.7 | 0.16 | 18 |
| CONT. | 4.5 | — | — | 112.3 | — | — |

Table 39.
"CONT."—Control;
"Ave."—Average;
"% Incr." = % increment;
"p-val."—p-value.

Example 15

Evaluation of Transgenic *Arabidopsis* NUE, Yield and Plant Growth Rate Under Low or Normal Nitrogen Fertilization in Greenhouse Assay Assay 1: Nitrogen Use efficiency: Seed yield plant biomass and plant growth rate at limited and optimal nitrogen concentration under greenhouse conditions—This assay follows seed yield production, the biomass formation and the rosette area growth of plants grown in the greenhouse at limiting and non-limiting nitrogen growth conditions. Transgenic *Arabidopsis* seeds were sown in agar media supplemented with to ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the 35S promoter and the selectable marker was used as control.

The plants were analyzed for their overall size, growth rate, flowering, seed yield, 1,000-seed weight, dry matter and harvest index (HI—seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs are square shape include 1.7 liter trays. During the capture process, the tubs are placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images are captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area.

Vegetative growth rate: the relative growth rate (RGR) of leaf number [formula XI (described above)], rosette area (formula XVI), plot coverage (formula XVII) and harvest index (formula IV) was calculated with the indicated formulas.

Relative growth rate of rosette area=Regression coefficient of rosette area along time course.    Formula XVI Relative growth rate of plot coverage=Regression coefficient of plot coverage along time course.    Formula XVII Seeds average weight—At the end of the experiment all seeds are collected. The seeds are scattered on a glass tray and a picture was taken. Using the digital analysis, the number of seeds in each sample was calculated.

Dry weight and seed yield—On about day 80 from sowing, the plants are harvested and left to dry at 30° C. in a drying chamber. The biomass and seed weight of each plot are measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) was calculated using Formula IV as described above.

Oil percentage in seeds—At the end of the experiment all seeds from each plot are collected. Seeds from 3 plots are mixed grounded and then mounted onto the extraction chamber. 210 ml of n-Hexane (Cat No. 080951 Biolab Ltd.) are used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant software package Silique length analysis—On day 50 from sowing, 30 siliques from different plants in each plot are sampled in block A. The chosen siliques are green-yellow in color and are collected from the bottom parts of a grown plant's stem. A digital photograph was taken to determine silique's length.

Statistical analyses—To identify genes conferring significantly improved tolerance to abiotic stresses, the results obtained from the transgenic plants are compared to those obtained from control plants. To identify outperforming genes and constructs, results from the independent transformation events tested are analyzed separately. Data was analyzed using Student's t-test and results are considered significant if the p value was less than 0.1. The JMP statistics software package was used (Version 5.2.1, SAS Institute Inc., Cary, N.C., USA).

TABLE 40

Genes showing improved plant performance at Normal growth conditions under regulation of 6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LYD97 | 60078.1 | — | — | — | 18.8 | 0.01 | −4 | — | — | — |
| LYD97 | 60078.4 | — | — | — | 16.2 | 0.21 | −17 | 11.2 | 0.20 | −15 |
| LYD97 | 60080.1 | — | — | — | 18.3 | 0.27 | −6 | 12.8 | 0.14 | −2 |
| LYD97 | 60082.1 | — | — | — | — | — | — | 12.6 | 0.03 | −4 |
| LYD87 | 60150.2 | — | — | — | 19.1 | 0.28 | −2 | — | — | — |
| LYD87 | 60150.3 | — | — | — | 16.8 | 0.17 | −14 | 11.0 | L | −16 |
| LYD87 | 60152.1 | — | — | — | 19.2 | 0.21 | −1 | 12.9 | 0.22 | −2 |
| LYD87 | 60153.1 | 1138.1 | 0.24 | 18 | 17.8 | 0.03 | −9 | 11.9 | L | −9 |
| LYD85 | 60014.2 | — | — | — | 18.1 | L | −7 | — | — | — |
| LYD85 | 60015.1 | — | — | — | 17.3 | L | −11 | 12.2 | L | −7 |
| LYD79 | 60018.2 | — | — | — | 17.4 | L | −11 | 12.3 | 0.08 | −6 |
| LYD79 | 60018.3 | — | — | — | 17.6 | 0.27 | −10 | — | — | — |
| LYD79 | 60018.4 | — | — | — | 19.2 | 0.21 | −1 | — | — | — |
| LYD79 | 60021.1 | — | — | — | — | — | — | 12.9 | 0.29 | −2 |
| LYD79 | 60021.4 | — | — | — | 17.4 | L | −11 | 12.2 | 0.16 | −7 |
| LYD76 | 60288.3 | — | — | — | 19.0 | 0.05 | −3 | 12.7 | 0.03 | −3 |
| LYD76 | 60288.4 | — | — | — | 18.1 | 0.11 | −7 | 12.7 | 0.03 | −3 |
| LYD76 | 60289.3 | — | — | — | 17.2 | 0.02 | −12 | — | — | — |
| LYD76 | 60290.1 | — | — | — | 18.2 | 0.04 | −7 | 12.4 | L | −5 |
| LYD76 | 60291.3 | — | — | — | 18.9 | 0.14 | −3 | 12.9 | 0.22 | −2 |
| LYD6 | 60090.2 | — | — | — | — | — | — | 12.7 | 0.03 | −3 |
| LYD6 | 60093.4 | — | — | — | 17.8 | L | −9 | 12.2 | L | −7 |
| LYD6 | 60094.1 | — | — | — | 19.1 | 0.28 | −2 | 12.5 | 0.12 | −5 |
| LYD6 | 60094.3 | — | — | — | 17.1 | 0.01 | −12 | 12.3 | L | −6 |
| LYD55 | 60174.1 | — | — | — | 17.9 | 0.19 | −8 | 12.8 | 0.14 | −2 |
| LYD55 | 60175.1 | — | — | — | — | — | — | 12.9 | 0.22 | −2 |
| LYD55 | 60175.2 | — | — | — | 19.2 | 0.21 | −1 | 12.9 | 0.22 | −2 |
| LYD55 | 60175.4 | — | — | — | 17.9 | 0.05 | −8 | 12.4 | L | −5 |
| LYD55 | 60177.2 | — | — | — | 17.8 | 0.02 | −9 | — | — | — |
| LYD53 | 60206.2 | — | — | — | — | — | — | 12.7 | 0.03 | −3 |
| LYD44 | 60248.2 | — | — | — | 17.4 | L | −11 | 12.5 | 0.12 | −5 |
| LYD44 | 60249.1 | — | — | — | — | — | — | 12.8 | 0.14 | −2 |
| LYD4 | 60096.2 | — | — | — | 18.2 | 0.30 | −7 | 12.7 | 0.03 | −3 |
| LYD4 | 60096.3 | — | — | — | 19.1 | 0.28 | −2 | 12.8 | 0.14 | −2 |
| LYD4 | 60096.6 | — | — | — | — | — | — | 12.8 | 0.14 | −2 |
| LYD4 | 60098.1 | — | — | — | 18.7 | 0.08 | −4 | 12.8 | 0.14 | −2 |
| LYD4 | 60098.2 | — | — | — | — | — | — | 12.7 | 0.03 | −3 |
| LYD33 | 60159.5 | — | — | — | — | — | — | 12.8 | 0.14 | −2 |
| LYD33 | 60160.2 | — | — | — | 19.1 | 0.28 | −2 | — | — | — |
| LYD33 | 60160.4 | — | — | — | — | — | — | 12.7 | 0.19 | −3 |
| LYD275 | 60000.3 | — | — | — | 19.1 | 0.28 | −2 | — | — | — |
| LYD275 | 60002.3 | — | — | — | 17.8 | 0.01 | −9 | 12.2 | L | −7 |
| LYD275 | 60003.5 | — | — | — | 16.9 | L | −13 | 12.0 | L | −9 |
| LYD275 | 60003.8 | — | — | — | 18.0 | 0.03 | −8 | 12.3 | 0.08 | −6 |
| LYD246 | 60213.2 | — | — | — | 18.7 | 0.08 | −4 | 12.7 | 0.23 | −3 |
| LYD246 | 60214.2 | — | — | — | 18.4 | 0.07 | −6 | 12.8 | 0.16 | −3 |
| LYD246 | 60214.3 | — | — | — | — | — | — | 12.8 | 0.14 | −2 |
| LYD234 | 60180.3 | — | — | — | — | — | — | 12.8 | 0.14 | −2 |
| LYD234 | 60181.3 | — | — | — | 17.7 | 0.13 | −9 | — | — | — |
| LYD234 | 60181.4 | — | — | — | 17.9 | 0.18 | −8 | 12.6 | 0.03 | −4 |
| LYD234 | 60182.3 | — | — | — | 18.8 | 0.22 | −4 | — | — | — |
| LYD23 | 60216.1 | — | — | — | 17.1 | 0.22 | −12 | — | — | — |
| LYD23 | 60216.2 | — | — | — | 18.9 | 0.15 | −3 | — | — | — |
| LYD23 | 60217.2 | — | — | — | 18.7 | 0.07 | −4 | — | — | — |
| LYD23 | 60217.3 | — | — | — | 19.0 | 0.05 | −3 | 12.7 | 0.23 | −3 |
| LYD23 | 60218.3 | — | — | — | — | — | — | 12.9 | 0.22 | −2 |
| LYD224 | 60038.1 | — | — | — | 18.2 | L | −7 | 12.3 | 0.27 | −6 |
| LYD224 | 60038.2 | — | — | — | 18.5 | 0.19 | −5 | 12.5 | 0.12 | −5 |
| LYD224 | 60038.5 | — | — | — | — | — | — | 12.7 | 0.23 | −3 |
| LYD224 | 60040.1 | — | — | — | 17.6 | 0.10 | −10 | 11.9 | L | −9 |
| LYD224 | 60040.8 | — | — | — | — | — | — | 12.3 | 0.08 | −6 |
| LYD220 | 60222.2 | — | — | — | 18.5 | 0.19 | −5 | 12.1 | 0.05 | −8 |
| LYD220 | 60223.1 | — | — | — | 18.8 | 0.23 | −4 | 12.4 | L | −5 |
| LYD220 | 60223.2 | — | — | — | 18.0 | 0.01 | −8 | 12.2 | 0.16 | −7 |

TABLE 40-continued

Genes showing improved plant performance at Normal growth conditions under regulation of 6669 promoter

| Gene Name | Event # | Dry Weight [mg] Ave. | P-Val. | % Incr. | Flowering (days) Ave. | P-Val. | % Incr. | Inflorescence Emergence (days) Ave. | P-Val. | % Incr. |
|---|---|---|---|---|---|---|---|---|---|---|
| LYD220 | 60224.1 | — | — | — | 17.7 | L | −9 | 12.0 | L | −9 |
| LYD220 | 60224.2 | — | — | — | 17.9 | L | −8 | 12.3 | 0.08 | −6 |
| LYD22 | 60043.1 | — | — | — | 18.3 | 0.26 | −6 | 12.3 | L | −7 |
| LYD22 | 60043.4 | — | — | — | 17.2 | 0.04 | −12 | 12.1 | 0.05 | −8 |
| LYD22 | 60044.1 | — | — | — | 17.4 | 0.06 | −11 | 12.1 | 0.01 | −8 |
| LYD22 | 60044.3 | — | — | — | 17.9 | 0.05 | −8 | — | — | — |
| LYD217 | 60048.4 | — | — | — | — | — | — | 12.9 | 0.19 | −2 |
| LYD217 | 60050.2 | — | — | — | 17.7 | 0.13 | −9 | 12.3 | 0.08 | −6 |
| LYD217 | 60051.2 | — | — | — | — | — | — | 12.2 | 0.16 | −7 |
| LYD217 | 60052.3 | — | — | — | 18.1 | L | −7 | 12.5 | 0.12 | −5 |
| LYD217 | 60052.4 | — | — | — | 19.0 | 0.05 | −3 | — | — | — |
| LYD213 | 60054.1 | — | — | — | 18.4 | 0.22 | −5 | 12.7 | 0.23 | −3 |
| LYD213 | 60054.4 | — | — | — | 17.9 | L | −8 | 12.6 | 0.03 | −4 |
| LYD213 | 60055.4 | — | — | — | 17.1 | 0.01 | −12 | 12.3 | 0.08 | −6 |
| LYD213 | 60056.3 | — | — | — | 17.3 | 0.17 | −11 | — | — | — |
| LYD213 | 60058.3 | — | — | — | 16.7 | 0.11 | −14 | 11.1 | L | −16 |
| LYD208 | 60062.3 | — | — | — | 17.2 | 0.02 | −12 | 12.2 | L | −7 |
| LYD208 | 60064.1 | — | — | — | 17.2 | 0.02 | −12 | 12.1 | 0.05 | −8 |
| LYD208 | 60064.2 | — | — | — | 18.0 | 0.01 | −8 | 12.2 | L | −7 |
| LYD208 | 60064.6 | — | — | — | 18.1 | 0.23 | −7 | 12.8 | 0.05 | −3 |
| LYD208 | 60064.8 | — | — | — | 17.5 | 0.13 | −10 | 12.4 | L | −5 |
| LYD20 | 60066.2 | — | — | — | 17.3 | L | −11 | 12.2 | L | −7 |
| LYD20 | 60067.1 | — | — | — | 17.2 | 0.02 | −12 | 11.6 | 0.17 | −12 |
| LYD20 | 60070.1 | — | — | — | 18.7 | 0.08 | −4 | 12.5 | 0.12 | −5 |
| LYD20 | 60070.2 | — | — | — | 17.7 | 0.06 | −9 | 12.3 | 0.08 | −6 |
| LYD2 | 60103.4 | — | — | — | 18.5 | 0.19 | −5 | 12.8 | 0.14 | −2 |
| LYD194 | 60084.3 | — | — | — | — | — | — | 12.6 | 0.03 | −4 |
| LYD194 | 60084.4 | — | — | — | 17.6 | 0.10 | −10 | — | — | — |
| LYD194 | 60085.2 | — | — | — | 17.2 | 0.04 | −12 | 12.0 | L | −9 |
| LYD194 | 60086.1 | — | — | — | 18.3 | 0.27 | −6 | 12.7 | 0.07 | −3 |
| LYD194 | 60086.2 | — | — | — | 18.5 | L | −5 | 12.4 | 0.21 | −5 |
| LYD190 | 60241.2 | — | — | — | 18.7 | 0.07 | −4 | — | — | — |
| LYD190 | 60241.3 | — | — | — | — | — | — | 12.9 | 0.22 | −2 |
| LYD190 | 60242.2 | — | — | — | 18.3 | 0.12 | −6 | 12.7 | 0.03 | −3 |
| LYD190 | 60243.2 | — | — | — | 18.2 | 0.18 | −7 | 12.9 | 0.11 | −2 |
| LYD190 | 60244.1 | — | — | — | 18.9 | L | −3 | 12.8 | 0.14 | −2 |
| LYD186 | 60237.3 | — | — | — | 18.5 | L | −5 | 12.8 | 0.14 | −2 |
| LYD186 | 60237.4 | — | — | — | 18.2 | 0.18 | −7 | 12.6 | 0.03 | −4 |
| LYD186 | 60238.4 | — | — | — | 17.8 | 0.03 | −9 | 12.9 | 0.22 | −2 |
| LYD184 | 60228.4 | — | — | — | 17.7 | 0.06 | −9 | — | — | — |
| LYD184 | 60229.1 | — | — | — | 18.4 | 0.22 | −5 | 12.6 | 0.03 | −4 |
| LYD173 | 60139.2 | — | — | — | 18.8 | 0.04 | −4 | 12.9 | 0.19 | −2 |
| LYD173 | 60139.3 | — | — | — | — | — | — | 12.5 | 0.12 | −5 |
| LYD173 | 60139.5 | — | — | — | 18.8 | 0.01 | −4 | 12.8 | 0.14 | −2 |
| LYD146 | 60024.2 | — | — | — | 18.4 | 0.22 | −5 | — | — | — |
| LYD146 | 60025.3 | — | — | — | 18.3 | 0.27 | −6 | 12.6 | 0.03 | −4 |
| LYD146 | 60027.1 | — | — | — | 17.9 | 0.10 | −8 | 12.3 | 0.24 | −6 |
| LYD14 | 60120.2 | — | — | — | 17.1 | 0.09 | −12 | 11.7 | 0.24 | −11 |
| LYD14 | 60122.2 | — | — | — | 18.0 | 0.16 | −8 | — | — | — |
| LYD14 | 60123.8 | — | — | — | 16.7 | L | −14 | 11.0 | L | −16 |
| LYD14 | 60123.9 | — | — | — | 18.7 | 0.10 | −4 | 12.7 | 0.23 | −3 |
| LYD134 | 60109.6 | — | — | — | 19.0 | 0.13 | −2 | 12.7 | 0.23 | −3 |
| LYD134 | 60110.1 | — | — | — | — | — | — | 12.8 | 0.14 | −2 |
| LYD134 | 60110.4 | — | — | — | — | — | — | 12.9 | 0.22 | −2 |
| LYD134 | 60110.5 | — | — | — | 17.9 | 0.29 | −8 | 12.7 | 0.23 | −4 |
| LYD13 | 60193.4 | — | — | — | 17.7 | 0.06 | −9 | — | — | — |
| LYD13 | 60195.2 | — | — | — | — | — | — | 12.7 | 0.03 | −3 |
| LYD13 | 60195.4 | — | — | — | 19.1 | 0.28 | −2 | 12.5 | 0.12 | −5 |
| LYD122 | 60199.2 | — | — | — | — | — | — | 12.8 | 0.14 | −2 |
| LYD122 | 60201.1 | — | — | — | 18.3 | 0.12 | −6 | — | — | — |
| LYD122 | 60201.3 | — | — | — | 18.8 | 0.23 | −4 | 12.4 | 0.21 | −5 |
| LYD117 | 60033.5 | — | — | — | 17.2 | L | −12 | 12.3 | L | −6 |
| LYD117 | 60033.6 | — | — | — | 17.8 | 0.03 | −9 | 12.5 | 0.12 | −5 |
| LYD117 | 60034.3 | — | — | — | — | — | — | 12.4 | 0.21 | −5 |
| LYD117 | 60034.4 | — | — | — | 17.7 | 0.13 | −9 | — | — | — |
| LYD11 | 60007.1 | — | — | — | 19.0 | 0.04 | −2 | 12.6 | 0.01 | −4 |
| LYD11 | 60009.3 | — | — | — | 18.2 | 0.29 | −6 | 12.5 | 0.12 | −5 |
| LYD11 | 60010.2 | — | — | — | 17.3 | L | −11 | 11.6 | 0.17 | −12 |
| LYD11 | 60010.3 | — | — | — | 18.4 | L | −6 | 12.4 | L | −5 |
| LYD101 | 60072.4 | — | — | — | 17.7 | 0.13 | −9 | 12.3 | 0.27 | −6 |
| LYD101 | 60075.3 | — | — | — | 18.1 | L | −7 | 12.2 | L | −7 |

TABLE 40-continued

Genes showing improved plant performance at Normal growth conditions under regulation of 6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LYD101 | 60076.4 | — | — | — | 19.1 | 0.05 | −2 | — | — | — |
| LYD10 | 60132.1 | — | — | — | 19.2 | 0.21 | −1 | 12.5 | 0.12 | −5 |
| LYD10 | 60132.2 | — | — | — | 17.0 | 0.18 | −13 | 11.6 | 0.20 | −12 |
| LYD10 | 60132.3 | 1068.8 | 0.16 | 11 | — | — | — | 12.8 | 0.14 | −2 |
| LYD10 | 60134.2 | — | — | — | 18.5 | 0.18 | −5 | 12.5 | L | −5 |
| LYD10 | 60134.3 | — | — | — | 18.7 | L | −4 | 12.6 | 0.03 | −4 |
| LYD10 | 60134.4 | — | — | — | 19.1 | 0.05 | −2 | 12.7 | 0.23 | −3 |
| CONT. | — | 961.2 | — | — | 19.5 | — | — | 13.1 | — | — |
| LYD94 | 61678.1 | 877.5 | 0.20 | 5 | — | — | — | — | — | — |
| LYD90 | 60828.1 | 888.1 | 0.27 | 6 | — | — | — | — | — | — |
| LYD90 | 60831.5 | 899.4 | 0.02 | 7 | — | — | — | — | — | — |
| LYD75 | 60655.8 | 949.4 | 0.20 | 13 | — | — | — | — | — | — |
| LYD43 | 60610.1 | 994.4 | 0.03 | 18 | — | — | — | — | — | — |
| LYD43 | 60610.2 | 1102.5 | 0.01 | 31 | — | — | — | — | — | — |
| LYD38 | 60535.4 | 869.3 | 0.23 | 4 | — | — | — | — | — | — |
| LYD35 | 60949.1 | 982.3 | 0.25 | 17 | — | — | — | — | — | — |
| LYD279 | 60553.3 | 886.2 | 0.13 | 6 | — | — | — | — | — | — |
| LYD279 | 60556.3 | 926.9 | 0.22 | 10 | — | — | — | — | — | — |
| LYD257 | 60560.4 | 903.1 | 0.03 | 8 | — | — | — | — | — | — |
| LYD257 | 60562.1 | 917.5 | 0.06 | 9 | — | — | — | — | — | — |
| LYD257 | 60562.4 | 926.9 | 0.04 | 10 | — | — | — | — | — | — |
| LYD253 | 60841.4 | 935.0 | L | 11 | — | — | — | — | — | — |
| LYD245 | 60646.4 | 867.5 | 0.28 | 3 | — | — | — | — | — | — |
| LYD244 | 61647.3 | 1021.2 | 0.02 | 22 | — | — | — | — | — | — |
| LYD240 | 60965.1 | 891.2 | 0.05 | 6 | — | — | — | — | — | — |
| LYD219 | 60673.1 | — | — | — | 17.9 | 0.10 | −3 | — | — | — |
| LYD219 | 60674.4 | 1025.9 | 0.24 | 22 | — | — | — | — | — | — |
| LYD209 | 60294.3 | 952.5 | 0.03 | 13 | — | — | — | — | — | — |
| LYD180 | 60462.2 | 896.2 | 0.22 | 7 | — | — | — | — | — | — |
| LYD180 | 60464.4 | 961.9 | 0.18 | 15 | — | — | — | — | — | — |
| LYD144 | 60866.4 | 1008.8 | 0.05 | 20 | 17.7 | 0.02 | −4 | — | — | — |
| LYD14 | 60123.1 | 1047.4 | 0.26 | 25 | — | — | — | — | — | — |
| LYD14 | 60123.9 | 917.5 | 0.11 | 9 | — | — | — | — | — | — |
| LYD129 | 60792.1 | 982.5 | L | 17 | 17.8 | 0.16 | −3 | — | — | — |
| LYD129 | 60794.2 | 896.2 | 0.06 | 7 | — | — | — | — | — | — |
| LYD125 | 60825.1 | 895.6 | 0.07 | 7 | — | — | — | — | — | — |
| LYD12 | 60936.4 | 972.7 | L | 16 | 17.8 | 0.29 | −3 | — | — | — |
| LYD104 | 60956.1 | 978.8 | L | 17 | — | — | — | — | — | — |
| LYD104 | 60957.2 | 873.1 | 0.14 | 4 | — | — | — | — | — | — |
| LYD103 | 60261.7 | 1024.7 | L | 22 | 18.1 | 0.22 | −2 | — | — | — |
| CONT. | — | 839.5 | — | — | 18.4 | — | — | — | — | — |
| LYD82 | 61061.3 | — | — | — | 18.3 | 0.15 | −5 | — | — | — |
| LYD82 | 61061.4 | 887.5 | 0.14 | 19 | 16.6 | 0.21 | −14 | — | — | — |
| LYD81 | 60940.3 | — | — | — | 18.8 | 0.13 | −3 | — | — | — |
| LYD81 | 60943.4 | — | — | — | 18.7 | 0.22 | −3 | — | — | — |
| LYD81 | 60944.1 | — | — | — | 18.8 | 0.14 | −3 | — | — | — |
| LYD81 | 60944.4 | — | — | — | 18.6 | 0.11 | −4 | — | — | — |
| LYD81 | 60944.8 | — | — | — | 17.3 | L | −10 | — | — | — |
| LYD70 | 60854.3 | — | — | — | 15.5 | 0.07 | −20 | 11.9 | 0.25 | −9 |
| LYD7 | 60668.1 | 833.8 | 0.02 | 12 | 17.6 | 0.29 | −9 | — | — | — |
| LYD7 | 60670.2 | — | — | — | 18.5 | L | −4 | — | — | — |
| LYD7 | 60671.2 | 776.9 | 0.30 | 4 | — | — | — | — | — | — |
| LYD69 | 61028.1 | — | — | — | 18.9 | 0.07 | −2 | — | — | — |
| LYD69 | 61028.5 | — | — | — | 19.0 | 0.08 | −2 | — | — | — |
| LYD67 | 60633.4 | 995.6 | 0.16 | 33 | 18.0 | 0.28 | −7 | — | — | — |
| LYD67 | 60634.1 | 823.1 | 0.30 | 10 | — | — | — | — | — | — |
| LYD59 | 61011.2 | 818.8 | 0.03 | 10 | — | — | — | — | — | — |
| LYD58 | 61098.4 | 884.4 | 0.22 | 19 | — | — | — | — | — | — |
| LYD51 | 60266.6 | 821.2 | 0.20 | 10 | — | — | — | — | — | — |
| LYD51 | 60269.3 | 857.5 | 0.02 | 15 | — | — | — | — | — | — |
| LYD5 | 61087.2 | 861.9 | L | 15 | — | — | — | — | — | — |
| LYD5 | 61090.2 | 921.9 | 0.01 | 24 | — | — | — | — | — | — |
| LYD49 | 60710.2 | 1030.0 | 0.13 | 38 | — | — | — | — | — | — |
| LYD49 | 60712.1 | 1011.2 | L | 36 | — | — | — | 12.9 | 0.29 | −2 |
| LYD49 | 60713.2 | 823.1 | 0.09 | 10 | — | — | — | — | — | — |
| LYD49 | 60714.1 | 1159.4 | 0.07 | 55 | — | — | — | — | — | — |
| LYD48 | 61034.2 | 801.9 | 0.10 | 7 | — | — | — | — | — | — |
| LYD48 | 61035.4 | 825.6 | 0.03 | 11 | — | — | — | — | — | — |
| LYD36 | 60980.3 | 859.4 | 0.13 | 15 | — | — | — | 12.6 | L | −4 |
| LYD36 | 60982.1 | 988.1 | 0.19 | 32 | — | — | — | — | — | — |
| LYD276 | 61016.1 | 929.4 | 0.06 | 25 | — | — | — | — | — | — |

TABLE 40-continued

Genes showing improved plant performance at Normal growth conditions under regulation of 6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LYD276 | 61020.4 | 830.0 | 0.10 | 11 | — | — | — | — | — | — |
| LYD253 | 60841.3 | 1009.4 | 0.06 | 35 | — | — | — | — | — | — |
| LYD253 | 60841.4 | 840.0 | 0.15 | 13 | — | — | — | — | — | — |
| LYD253 | 60842.1 | 980.0 | 0.02 | 31 | 18.8 | 0.14 | −3 | — | — | — |
| LYD253 | 60842.3 | 994.4 | L | 33 | — | — | — | — | — | — |
| LYD235 | 60930.6 | — | — | — | 17.4 | 0.05 | −10 | — | — | — |
| LYD204 | 60704.4 | 923.1 | L | 24 | — | — | — | — | — | — |
| LYD204 | 60707.1 | 978.1 | L | 31 | — | — | — | — | — | — |
| LYD204 | 60707.2 | 946.2 | 0.23 | 27 | — | — | — | — | — | — |
| LYD202 | 60421.2 | 1243.1 | 0.07 | 67 | — | — | — | — | — | — |
| LYD202 | 60421.3 | 980.0 | 0.13 | 31 | — | — | — | — | — | — |
| LYD202 | 60422.2 | 953.8 | L | 28 | — | — | — | — | — | — |
| LYD202 | 60422.4 | 930.0 | L | 25 | — | — | — | — | — | — |
| LYD197 | 60988.2 | 810.6 | 0.09 | 9 | — | — | — | — | — | — |
| LYD195 | 60253.2 | — | — | — | 18.3 | 0.26 | −5 | — | — | — |
| LYD195 | 60257.2 | — | — | — | — | — | — | 12.9 | 0.30 | −2 |
| LYD176 | 61040.2 | 1038.8 | 0.03 | 39 | — | — | — | — | — | — |
| LYD176 | 61041.1 | 1000.0 | 0.02 | 34 | — | — | — | — | — | — |
| LYD176 | 61041.4 | 867.5 | 0.27 | 16 | — | — | — | — | — | — |
| LYD176 | 61043.1 | 991.9 | L | 33 | — | — | — | — | — | — |
| LYD172 | 61064.2 | 884.4 | L | 19 | — | — | — | — | — | — |
| LYD172 | 61065.3 | 949.4 | 0.06 | 27 | — | — | — | — | — | — |
| LYD172 | 61066.3 | 851.9 | 0.18 | 14 | — | — | — | — | — | — |
| LYD172 | 61066.4 | 1008.8 | L | 35 | — | — | — | — | — | — |
| LYD172 | 61067.3 | 812.5 | 0.07 | 9 | — | — | — | — | — | — |
| LYD166 | 60998.3 | 1083.1 | 0.08 | 45 | — | — | — | — | — | — |
| LYD166 | 60999.1 | 1006.3 | 0.05 | 35 | — | — | — | — | — | — |
| LYD166 | 61000.2 | 1031.9 | 0.18 | 38 | — | — | — | — | — | — |
| LYD166 | 61000.4 | 878.8 | 0.03 | 18 | — | — | — | — | — | — |
| LYD16 | 60313.2 | 1028.9 | 0.13 | 38 | — | — | — | — | — | — |
| LYD16 | 60314.1 | 928.1 | L | 24 | — | — | — | — | — | — |
| LYD16 | 60314.4 | 956.2 | L | 28 | — | — | — | — | — | — |
| LYD16 | 60315.1 | 839.4 | 0.27 | 12 | — | — | — | — | — | — |
| LYD159 | 60662.6 | 1070.6 | 0.12 | 43 | — | — | — | — | — | — |
| LYD159 | 60665.1 | 826.2 | 0.20 | 11 | — | — | — | — | — | — |
| LYD159 | 60665.5 | 1047.5 | L | 40 | — | — | — | — | — | — |
| LYD129 | 60792.1 | 1038.8 | L | 39 | — | — | — | — | — | — |
| LYD129 | 60793.2 | 796.9 | 0.10 | 7 | — | — | — | — | — | — |
| LYD129 | 60794.2 | 928.1 | L | 24 | — | — | — | 12.5 | 0.01 | −4 |
| LYD127 | 60682.3 | 1051.2 | 0.24 | 41 | — | — | — | — | — | — |
| LYD127 | 60683.1 | 871.9 | 0.21 | 17 | — | — | — | — | — | — |
| LYD127 | 60683.4 | 857.5 | 0.18 | 15 | — | — | — | — | — | — |
| LYD123 | 60786.3 | 907.5 | 0.02 | 22 | 18.2 | 0.07 | −6 | — | — | — |
| LYD123 | 60788.1 | 1059.4 | L | 42 | — | — | — | — | — | — |
| LYD123 | 60789.2 | 978.1 | 0.12 | 31 | — | — | — | — | — | — |
| LYD12 | 60934.1 | — | — | — | 18.5 | 0.19 | −4 | — | — | — |
| LYD12 | 60937.1 | 981.2 | 0.25 | 31 | — | — | — | — | — | — |
| LYD119 | 61004.2 | 895.6 | L | 20 | — | — | — | — | — | — |
| LYD119 | 61008.3 | 881.2 | 0.17 | 18 | — | — | — | — | — | — |
| LYD105 | 60652.4 | 960.6 | 0.06 | 29 | — | — | — | — | — | — |
| LYD105 | 60653.2 | 976.2 | 0.25 | 31 | — | — | — | — | — | — |
| LYD104 | 60952.1 | 866.9 | 0.09 | 16 | — | — | — | — | — | — |
| LYD104 | 60953.2 | 888.1 | 0.15 | 19 | — | — | — | — | — | — |
| LYD104 | 60957.2 | 883.1 | L | 18 | — | — | — | — | — | — |
| LYD102 | 60958.3 | 838.8 | 0.13 | 12 | — | — | — | — | — | — |
| LYD102 | 60960.1 | 863.8 | 0.18 | 16 | — | — | — | — | — | — |
| LYD102 | 60961.2 | — | — | — | 16.7 | 0.29 | −13 | — | — | — |
| LYD102 | 60961.3 | — | — | — | 17.1 | L | −11 | — | — | — |
| CONT. | — | 746.2 | — | — | 19.3 | — | — | 13.1 | — | — |
| LYD142* | 60971.1 | 0.81 | 0.20 | 8 | — | — | — | — | — | — |
| LYD142* | 60973.3 | 0.84 | 0.07 | 12 | — | — | — | — | — | — |

Table 40.
"CONT."—Control;
"Ave."—Average;
"% Incr." = % increment;
"p-val."—p-value,
L—p < 0.01.
*was regulated by 35S promoter (SEQ ID NO: 8094).

TABLE 41

Genes showing improved plant performance at Normal growth conditions under regulation of 6669 promoter

| Gene | | Leaf Blade Area [cm2] | | | Leaf Number | | | Plot Coverage [cm2] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD97 | 60082.1 | — | — | — | 9.4 | 0.01 | 5 | — | — | — |
| LYD87 | 60150.3 | — | — | — | 9.9 | 0.22 | 10 | 65.5 | 0.21 | 29 |
| LYD87 | 60153.1 | — | — | — | 9.2 | 0.18 | 3 | — | — | — |
| LYD85 | 60014.2 | 3.0 | 0.26 | 4 | — | — | — | — | — | — |
| LYD79 | 60021.1 | — | — | — | 9.1 | 0.23 | 2 | — | — | — |
| LYD79 | 60021.4 | — | — | — | — | — | — | 60.5 | 0.25 | 19 |
| LYD76 | 60288.4 | — | — | — | 9.5 | 0.22 | 6 | 70.0 | 0.29 | 38 |
| LYD76 | 60289.3 | 3.7 | L | 27 | 10.1 | 0.13 | 12 | 71.4 | L | 41 |
| LYD76 | 60290.1 | 3.1 | 0.07 | 7 | 9.4 | 0.16 | 5 | 55.1 | 0.05 | 9 |
| LYD76 | 60291.3 | 3.1 | 0.25 | 5 | — | — | — | — | — | — |
| LYD6 | 60090.2 | — | — | — | 9.6 | 0.02 | 8 | 59.9 | 0.22 | 18 |
| LYD6 | 60093.1 | — | — | — | 9.2 | 0.14 | 3 | — | — | — |
| LYD6 | 60094.3 | — | — | — | 9.2 | 0.14 | 3 | — | — | — |
| LYD55 | 60175.4 | — | — | — | 9.2 | 0.18 | 3 | 60.0 | 0.19 | 18 |
| LYD53 | 60205.1 | 3.1 | 0.26 | 8 | 9.6 | 0.27 | 7 | — | — | — |
| LYD53 | 60206.2 | — | — | — | — | — | — | 53.0 | 0.24 | 5 |
| LYD53 | 60207.2 | — | — | — | 9.2 | 0.14 | 3 | 56.5 | 0.05 | 11 |
| LYD53 | 60207.3 | — | — | — | 9.6 | 0.02 | 8 | — | — | — |
| LYD44 | 60248.2 | — | — | — | 9.5 | L | 6 | — | — | — |
| LYD44 | 60249.1 | — | — | — | 9.1 | 0.23 | 2 | — | — | — |
| LYD4 | 60096.2 | 3.3 | L | 13 | — | — | — | 56.6 | 0.02 | 12 |
| LYD4 | 60098.2 | — | — | — | 9.2 | 0.18 | 3 | — | — | — |
| LYD33 | 60160.2 | 3.1 | 0.22 | 7 | 9.3 | 0.04 | 4 | — | — | — |
| LYD275 | 60000.3 | — | — | — | 9.4 | 0.16 | 5 | — | — | — |
| LYD275 | 60002.3 | 3.1 | 0.09 | 7 | — | — | — | 54.1 | 0.10 | 7 |
| LYD275 | 60003.5 | 3.1 | 0.29 | 5 | 9.8 | 0.01 | 9 | 57.6 | 0.14 | 14 |
| LYD246 | 60212.4 | 3.4 | 0.21 | 16 | 9.8 | 0.01 | 9 | 67.6 | 0.11 | 33 |
| LYD246 | 60214.2 | — | — | — | 9.3 | 0.04 | 4 | — | — | — |
| LYD234 | 60181.3 | — | — | — | 9.6 | 0.02 | 8 | 71.6 | 0.22 | 41 |
| LYD234 | 60181.4 | 3.2 | 0.01 | 10 | — | — | — | 57.1 | 0.02 | 13 |
| LYD234 | 60181.8 | 3.4 | 0.29 | 16 | 9.4 | 0.01 | 5 | 57.0 | 0.29 | 12 |
| LYD23 | 60216.1 | 3.5 | 0.03 | 19 | — | — | — | 62.3 | L | 23 |
| LYD23 | 60216.2 | — | — | — | — | — | — | 58.6 | 0.27 | 16 |
| LYD23 | 60217.2 | 3.1 | 0.26 | 6 | — | — | — | 54.9 | 0.08 | 8 |
| LYD224 | 60038.1 | — | — | — | 9.6 | 0.27 | 7 | — | — | — |
| LYD224 | 60040.1 | — | — | — | — | — | — | 65.4 | 0.19 | 29 |
| LYD224 | 60040.8 | 3.3 | 0.01 | 15 | — | — | — | 59.4 | 0.25 | 17 |
| LYD220 | 60222.2 | — | — | — | 9.8 | 0.25 | 9 | 56.2 | 0.02 | 11 |
| LYD220 | 60223.1 | 3.2 | 0.25 | 9 | 9.1 | 0.23 | 2 | 56.3 | 0.14 | 11 |
| LYD220 | 60223.2 | 3.2 | 0.14 | 11 | 9.3 | 0.25 | 4 | 59.5 | 0.03 | 17 |
| LYD220 | 60224.1 | 3.7 | 0.14 | 26 | 9.8 | 0.14 | 9 | 68.6 | 0.21 | 35 |
| LYD220 | 60224.2 | 3.2 | 0.02 | 10 | 9.2 | 0.14 | 3 | 55.1 | 0.06 | 9 |
| LYD217 | 60051.2 | 3.3 | 0.13 | 13 | — | — | — | — | — | — |
| LYD217 | 60052.3 | 3.3 | 0.05 | 13 | — | — | — | 61.0 | 0.23 | 20 |
| LYD213 | 60054.4 | 3.1 | 0.18 | 5 | 9.4 | 0.01 | 5 | 55.3 | 0.04 | 9 |
| LYD213 | 60055.4 | 3.1 | 0.15 | 5 | — | — | — | 57.6 | L | 14 |
| LYD213 | 60056.3 | 3.4 | L | 16 | 10.2 | 0.15 | 14 | 64.1 | 0.03 | 26 |
| LYD213 | 60058.3 | 3.2 | 0.10 | 9 | — | — | — | 56.3 | 0.03 | 11 |
| LYD208 | 60064.1 | — | — | — | 9.2 | 0.14 | 3 | — | — | — |
| LYD208 | 60064.8 | 3.2 | 0.02 | 10 | 9.2 | 0.14 | 3 | 58.6 | L | 16 |
| LYD20 | 60066.2 | — | — | — | 9.6 | 0.17 | 8 | — | — | — |
| LYD20 | 60067.1 | — | — | — | — | — | — | 57.7 | L | 14 |
| LYD20 | 60070.2 | — | — | — | 9.2 | 0.14 | 3 | — | — | — |
| LYD194 | 60084.4 | 3.6 | L | 23 | 10.3 | 0.10 | 15 | 68.4 | L | 35 |
| LYD194 | 60085.2 | 3.1 | 0.21 | 5 | — | — | — | 53.2 | 0.29 | 5 |
| LYD194 | 60086.2 | — | — | — | 9.3 | 0.04 | 4 | — | — | — |
| LYD190 | 60241.3 | — | — | — | 9.3 | 0.04 | 4 | — | — | — |
| LYD190 | 60244.1 | — | — | — | 9.6 | 0.11 | 7 | — | — | — |
| LYD186 | 60237.4 | 3.5 | 0.18 | 21 | 9.4 | 0.16 | 5 | 64.2 | 0.25 | 27 |
| LYD186 | 60238.4 | 3.3 | 0.30 | 12 | 9.6 | 0.11 | 7 | — | — | — |
| LYD184 | 60228.3 | — | — | — | 9.5 | L | 6 | 54.0 | 0.20 | 7 |
| LYD184 | 60229.1 | 3.3 | 0.05 | 14 | 9.2 | 0.14 | 3 | 57.6 | 0.04 | 14 |
| LYD173 | 60139.3 | — | — | — | 9.3 | 0.04 | 4 | — | — | — |
| LYD146 | 60026.2 | — | — | — | 9.2 | 0.14 | 3 | — | — | — |
| LYD14 | 60120.2 | — | — | — | 9.6 | L | 8 | — | — | — |
| LYD14 | 60123.8 | — | — | — | 9.4 | 0.01 | 5 | — | — | — |
| LYD13 | 60193.4 | 3.5 | 0.01 | 18 | 9.7 | 0.08 | 8 | 63.0 | 0.04 | 24 |
| LYD13 | 60195.2 | 3.2 | 0.07 | 9 | — | — | — | 55.4 | 0.03 | 9 |
| LYD13 | 60195.4 | 3.3 | L | 13 | 9.4 | 0.08 | 5 | 57.6 | 0.10 | 14 |
| LYD122 | 60199.2 | 3.3 | 0.03 | 13 | 9.2 | 0.18 | 3 | 58.6 | 0.29 | 16 |
| LYD122 | 60199.4 | 3.3 | 0.04 | 13 | — | — | — | 58.9 | L | 16 |
| LYD122 | 60200.2 | 3.6 | 0.17 | 24 | — | — | — | 63.7 | L | 26 |
| LYD122 | 60201.1 | — | — | — | 9.7 | L | 8 | — | — | — |

TABLE 41-continued

Genes showing improved plant performance at Normal growth conditions under regulation of 6669 promoter

| Gene | | Leaf Blade Area [cm2] | | | Leaf Number | | | Plot Coverage [cm2] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYD122 | 60201.3 | — | — | — | 9.4 | 0.16 | 5 | — | — | — |
| LYD117 | 60033.5 | 3.3 | 0.27 | 12 | 9.7 | 0.08 | 8 | 60.9 | 0.13 | 20 |
| LYD117 | 60033.6 | 3.3 | 0.25 | 13 | 9.4 | 0.01 | 5 | 60.3 | 0.18 | 19 |
| LYD117 | 60034.4 | 3.2 | 0.14 | 8 | — | — | — | — | — | — |
| LYD11 | 60009.3 | 3.2 | 0.05 | 9 | — | — | — | — | — | — |
| LYD11 | 60010.2 | 3.5 | L | 20 | 9.4 | 0.08 | 5 | 64.5 | L | 27 |
| LYD101 | 60072.4 | 3.1 | 0.07 | 7 | — | — | — | 55.5 | 0.08 | 9 |
| LYD101 | 60075.3 | — | — | — | 9.6 | 0.17 | 8 | — | — | — |
| LYD10 | 60132.2 | 3.8 | 0.03 | 29 | 10.4 | 0.06 | 16 | 71.2 | 0.11 | 40 |
| CONT. | — | 2.9 | — | — | 9.0 | — | — | 50.7 | — | — |
| LYD43 | 60611.2 | — | — | — | 12.3 | 0.20 | 3 | — | — | — |
| LYD27 | 60542.1 | — | — | — | — | — | — | 106.7 | 0.25 | 15 |
| LYD257 | 60562.4 | 5.0 | 0.02 | 16 | — | — | — | 103.9 | 0.04 | 12 |
| LYD253 | 60841.4 | 4.8 | 0.07 | 10 | 12.4 | 0.19 | 4 | 104.7 | 0.03 | 13 |
| LYD245 | 60646.1 | — | — | — | 12.3 | 0.20 | 3 | — | — | — |
| LYD240 | 60968.2 | — | — | — | — | — | — | 104.8 | 0.18 | 13 |
| LYD235 | 60929.3 | 4.9 | 0.02 | 14 | — | — | — | 107.9 | L | 16 |
| LYD219 | 60673.1 | 4.7 | 0.27 | 9 | — | — | — | 102.2 | 0.12 | 10 |
| LYD201 | 60172.1 | — | — | — | — | — | — | 100.0 | 0.12 | 8 |
| LYD174 | 60816.4 | 4.9 | 0.26 | 12 | — | — | — | 105.9 | 0.10 | 14 |
| LYD153 | 60697.3 | — | — | — | 12.6 | 0.15 | 5 | — | — | — |
| LYD153 | 60700.3 | 5.6 | 0.11 | 29 | — | — | — | 121.7 | 0.19 | 31 |
| LYD144 | 60866.4 | 4.9 | 0.18 | 13 | — | — | — | 109.6 | 0.22 | 18 |
| LYD144 | 60866.5 | 5.2 | 0.20 | 21 | 12.4 | 0.17 | 3 | 109.5 | 0.17 | 18 |
| LYD129 | 60792.1 | — | — | — | — | — | — | 116.6 | 0.28 | 26 |
| LYD129 | 60794.2 | 4.7 | 0.28 | 9 | — | — | — | — | — | — |
| LYD125 | 60823.3 | 5.7 | L | 31 | — | — | — | 121.4 | 0.16 | 31 |
| LYD125 | 60825.1 | 4.7 | 0.12 | 9 | — | — | — | — | — | — |
| LYD12 | 60936.4 | 5.6 | L | 29 | — | — | — | 118.8 | 0.02 | 28 |
| LYD12 | 60938.2 | — | — | — | — | — | — | 108.1 | 0.02 | 17 |
| LYD104 | 60952.1 | 5.0 | L | 16 | — | — | — | 104.2 | 0.03 | 12 |
| LYD104 | 60956.1 | 5.4 | L | 26 | — | — | — | 119.6 | 0.13 | 29 |
| LYD103 | 60259.4 | — | — | — | — | — | — | 112.6 | 0.29 | 21 |
| LYD102 | 60959.1 | 4.8 | 0.08 | 11 | — | — | — | 100.0 | 0.17 | 8 |
| LYD102 | 60961.2 | 5.1 | L | 19 | — | — | — | 109.6 | 0.03 | 18 |
| CONT. | — | 4.3 | — | — | 12.0 | — | — | 92.8 | — | — |
| LYD82 | 61058.2 | 3.0 | L | 28 | — | — | — | 57.2 | L | 45 |
| LYD82 | 61058.3 | 3.2 | L | 33 | 9.7 | L | 11 | 55.6 | L | 41 |
| LYD82 | 61061.3 | 2.9 | 0.16 | 22 | — | — | — | 49.9 | 0.12 | 27 |
| LYD82 | 61061.4 | 2.5 | 0.27 | 6 | 9.4 | 0.07 | 8 | 47.1 | 0.01 | 20 |
| LYD81 | 60940.3 | 2.7 | 0.15 | 12 | — | — | — | 48.0 | 0.18 | 22 |
| LYD81 | 60943.4 | 3.1 | L | 30 | — | — | — | 53.2 | L | 35 |
| LYD81 | 60944.1 | 2.9 | 0.16 | 23 | 9.3 | 0.11 | 6 | 52.8 | L | 34 |
| LYD81 | 60944.4 | 2.7 | 0.11 | 13 | 9.1 | 0.16 | 4 | 47.4 | L | 21 |
| LYD81 | 60944.8 | 3.1 | L | 30 | 9.1 | 0.16 | 4 | 56.5 | L | 44 |
| LYD80 | 61049.1 | 2.7 | 0.01 | 15 | 9.2 | 0.06 | 5 | 47.6 | 0.16 | 21 |
| LYD80 | 61049.4 | — | — | — | 9.0 | 0.24 | 3 | — | — | — |
| LYD80 | 61050.1 | — | — | — | 9.2 | 0.07 | 6 | 44.2 | 0.06 | 12 |
| LYD70 | 60853.3 | 2.9 | L | 24 | — | — | — | 49.1 | L | 25 |
| LYD70 | 60853.4 | — | — | — | — | — | — | 44.2 | 0.06 | 12 |
| LYD70 | 60854.3 | 3.6 | L | 54 | — | — | — | 67.1 | L | 71 |
| LYD70 | 60856.4 | 2.7 | 0.02 | 13 | — | — | — | 44.9 | 0.04 | 14 |
| LYD7 | 60667.1 | 2.8 | L | 17 | 9.6 | L | 9 | 50.7 | L | 29 |
| LYD7 | 60668.1 | 3.3 | 0.13 | 38 | — | — | — | 60.8 | 0.19 | 54 |
| LYD7 | 60670.2 | — | — | — | — | — | — | 51.0 | 0.27 | 30 |
| LYD7 | 60671.2 | — | — | — | — | — | — | 45.1 | 0.03 | 15 |
| LYD7 | 60671.3 | — | — | — | 9.0 | 0.24 | 3 | 50.4 | 0.19 | 28 |
| LYD69 | 61028.1 | 2.9 | L | 23 | 9.3 | 0.02 | 6 | 51.6 | L | 31 |
| LYD69 | 61028.5 | 2.6 | 0.08 | 9 | 9.4 | 0.07 | 8 | 48.5 | L | 23 |
| LYD69 | 61029.4 | 2.6 | 0.14 | 9 | — | — | — | 45.6 | 0.04 | 16 |
| LYD67 | 60633.4 | 3.0 | 0.20 | 27 | — | — | — | 53.5 | 0.20 | 36 |
| LYD67 | 60635.3 | — | — | — | — | — | — | 44.9 | 0.13 | 14 |
| LYD59 | 61010.1 | 2.6 | 0.19 | 8 | 9.0 | 0.24 | 3 | 43.9 | 0.29 | 12 |
| LYD59 | 61011.2 | 3.0 | L | 26 | 9.2 | 0.04 | 6 | 53.0 | L | 35 |
| LYD58 | 61102.1 | 2.6 | 0.05 | 11 | — | — | — | — | — | — |
| LYD51 | 60266.5 | 2.9 | L | 21 | — | — | — | 49.6 | L | 26 |
| LYD51 | 60266.6 | 3.0 | 0.20 | 27 | 9.2 | 0.06 | 5 | 51.5 | 0.14 | 31 |
| LYD51 | 60269.1 | 2.9 | 0.17 | 21 | 9.4 | 0.07 | 8 | 49.9 | 0.04 | 27 |
| LYD51 | 60269.3 | 3.2 | L | 35 | 9.6 | L | 9 | 58.3 | L | 48 |
| LYD51 | 60269.6 | 2.9 | 0.26 | 23 | 9.2 | 0.06 | 5 | 49.3 | 0.25 | 25 |
| LYD5 | 61087.2 | 2.7 | 0.11 | 15 | — | — | — | 47.4 | 0.10 | 21 |
| LYD5 | 61087.3 | 2.8 | 0.04 | 20 | — | — | — | 47.9 | 0.04 | 22 |
| LYD5 | 61089.3 | 3.0 | 0.02 | 26 | 9.4 | 0.03 | 7 | 52.4 | L | 33 |

TABLE 41-continued

Genes showing improved plant performance at Normal growth conditions under regulation of 6669 promoter

| Gene Name | Event # | Leaf Blade Area [cm2] | | | Leaf Number | | | Plot Coverage [cm2] | | |
|---|---|---|---|---|---|---|---|---|---|---|
| | | Ave. | P-Val. | % Incr. | Ave. | P-Val. | % Incr. | Ave. | P-Val. | % Incr. |
| LYD5 | 61090.2 | — | — | — | 9.6 | 0.04 | 9 | — | — | — |
| LYD49 | 60710.2 | 2.7 | 0.21 | 14 | — | — | — | 47.7 | 0.26 | 21 |
| LYD49 | 60714.1 | 3.2 | 0.07 | 34 | 9.4 | 0.21 | 8 | 56.4 | 0.02 | 43 |
| LYD48 | 61034.2 | 2.8 | 0.01 | 17 | 9.2 | 0.06 | 5 | 49.0 | L | 25 |
| LYD48 | 61035.3 | 2.8 | L | 18 | 9.4 | 0.01 | 7 | 51.7 | 0.01 | 31 |
| LYD48 | 61035.4 | 2.6 | 0.09 | 9 | — | — | — | 45.3 | 0.03 | 15 |
| LYD48 | 61036.3 | — | — | — | 9.3 | 0.02 | 6 | 49.7 | 0.27 | 26 |
| LYD36 | 60980.1 | — | — | — | — | — | — | 57.4 | 0.29 | 46 |
| LYD36 | 60980.2 | 3.2 | 0.20 | 35 | — | — | — | 61.4 | 0.18 | 56 |
| LYD36 | 60980.3 | 2.9 | 0.15 | 24 | — | — | — | — | — | — |
| LYD36 | 60982.1 | 3.2 | L | 36 | 9.2 | 0.19 | 5 | 57.0 | L | 45 |
| LYD34 | 60270.4 | — | — | — | — | — | — | 54.7 | 0.06 | 39 |
| LYD34 | 60270.6 | 3.4 | 0.05 | 45 | — | — | — | 60.0 | 0.04 | 53 |
| LYD34 | 60271.2 | — | — | — | — | — | — | 49.7 | 0.08 | 26 |
| LYD34 | 60271.3 | — | — | — | — | — | — | 50.4 | L | 28 |
| LYD34 | 60272.5 | 3.2 | L | 36 | 9.5 | 0.25 | 9 | 58.7 | L | 49 |
| LYD276 | 61016.1 | 3.4 | L | 42 | — | — | — | 58.3 | L | 48 |
| LYD276 | 61016.3 | 2.7 | L | 15 | 9.1 | 0.09 | 4 | 45.0 | 0.03 | 14 |
| LYD276 | 61016.4 | 3.2 | L | 34 | 9.2 | 0.19 | 5 | 55.5 | L | 41 |
| LYD276 | 61020.4 | 2.6 | 0.08 | 9 | — | — | — | 43.7 | 0.08 | 11 |
| LYD253 | 60840.2 | — | — | — | — | — | — | 44.5 | 0.13 | 13 |
| LYD253 | 60841.3 | 3.8 | L | 61 | 9.1 | 0.15 | 4 | 68.2 | L | 73 |
| LYD253 | 60842.1 | 3.6 | L | 51 | 9.8 | 0.11 | 12 | 63.3 | 0.04 | 61 |
| LYD253 | 60842.3 | 3.4 | 0.25 | 43 | — | — | — | 62.4 | 0.26 | 59 |
| LYD235 | 60929.3 | 3.3 | 0.24 | 41 | — | — | — | 62.0 | 0.27 | 57 |
| LYD235 | 60930.3 | — | — | — | — | — | — | 43.1 | 0.12 | 10 |
| LYD235 | 60930.6 | 3.0 | 0.15 | 27 | — | — | — | 51.4 | 0.14 | 31 |
| LYD235 | 60931.2 | 3.2 | 0.18 | 36 | — | — | — | 55.0 | 0.15 | 40 |
| LYD204 | 60704.2 | 3.0 | 0.08 | 26 | 9.4 | 0.03 | 7 | 51.8 | 0.02 | 32 |
| LYD204 | 60704.4 | 3.0 | L | 25 | 9.6 | L | 10 | 52.4 | L | 33 |
| LYD204 | 60707.2 | 2.9 | L | 23 | — | — | — | 47.5 | L | 21 |
| LYD202 | 60421.2 | 3.4 | L | 46 | 9.2 | 0.06 | 5 | 59.7 | L | 52 |
| LYD202 | 60421.3 | 3.0 | L | 25 | — | — | — | 49.4 | L | 26 |
| LYD202 | 60422.2 | 2.7 | 0.16 | 13 | — | — | — | 44.0 | 0.25 | 12 |
| LYD202 | 60422.4 | 2.7 | L | 15 | — | — | — | 44.8 | 0.04 | 14 |
| LYD202 | 60425.2 | 3.0 | 0.19 | 25 | — | — | — | 48.8 | 0.26 | 24 |
| LYD197 | 60988.2 | 2.7 | 0.02 | 15 | — | — | — | 46.7 | L | 19 |
| LYD197 | 60988.4 | 2.6 | 0.12 | 11 | — | — | — | 44.2 | 0.18 | 12 |
| LYD197 | 60990.3 | 2.9 | 0.03 | 23 | — | — | — | 50.8 | 0.02 | 29 |
| LYD195 | 60252.1 | 2.7 | 0.20 | 13 | — | — | — | 45.4 | 0.08 | 15 |
| LYD195 | 60253.2 | 2.8 | L | 18 | — | — | — | 50.1 | L | 27 |
| LYD195 | 60255.2 | 3.1 | 0.05 | 30 | — | — | — | 52.5 | 0.09 | 33 |
| LYD195 | 60256.1 | 3.0 | 0.04 | 25 | — | — | — | 49.7 | 0.10 | 26 |
| LYD195 | 60257.2 | 2.9 | L | 24 | — | — | — | 50.2 | L | 28 |
| LYD180 | 60462.2 | 2.7 | 0.18 | 12 | — | — | — | 45.1 | 0.23 | 15 |
| LYD180 | 60464.4 | 2.8 | L | 20 | — | — | — | 48.2 | L | 22 |
| LYD180 | 60465.2 | 2.7 | 0.25 | 13 | 9.4 | 0.07 | 8 | 45.2 | 0.29 | 15 |
| LYD180 | 60465.4 | — | — | — | — | — | — | 43.6 | 0.08 | 11 |
| LYD176 | 61040.2 | 3.4 | L | 42 | 9.5 | L | 9 | 63.4 | L | 61 |
| LYD176 | 61041.1 | 3.3 | L | 38 | — | — | — | 59.4 | L | 51 |
| LYD176 | 61043.1 | 3.8 | 0.11 | 62 | 9.4 | 0.21 | 8 | 69.3 | 0.13 | 76 |
| LYD172 | 61064.2 | 2.9 | 0.30 | 21 | 9.8 | L | 11 | 52.7 | 0.21 | 34 |
| LYD172 | 61065.3 | 3.6 | L | 52 | — | — | — | 64.6 | 0.16 | 64 |
| LYD172 | 61066.3 | — | — | — | 9.1 | 0.09 | 4 | 59.8 | 0.18 | 52 |
| LYD172 | 61066.4 | 3.6 | 0.02 | 50 | — | — | — | 60.7 | 0.03 | 54 |
| LYD172 | 61067.3 | 2.6 | 0.10 | 11 | — | — | — | 46.1 | 0.02 | 17 |
| LYD166 | 60998.3 | 3.5 | L | 50 | — | — | — | 61.6 | 0.09 | 56 |
| LYD166 | 60998.4 | 3.7 | 0.09 | 55 | — | — | — | 64.1 | L | 63 |
| LYD166 | 60999.1 | 3.4 | 0.16 | 42 | — | — | — | 61.0 | L | 55 |
| LYD166 | 61000.2 | 3.5 | 0.13 | 47 | — | — | — | 59.5 | 0.12 | 51 |
| LYD166 | 61000.4 | — | — | — | 9.4 | 0.01 | 7 | 57.9 | 0.29 | 47 |
| LYD16 | 60314.1 | 3.2 | 0.29 | 34 | — | — | — | 54.1 | 0.29 | 38 |
| LYD16 | 60314.4 | 3.2 | 0.20 | 34 | 9.1 | 0.15 | 4 | 55.0 | 0.16 | 40 |
| LYD16 | 60315.1 | 3.0 | 0.28 | 27 | — | — | — | 51.6 | 0.30 | 31 |
| LYD16 | 60315.3 | 3.0 | 0.26 | 25 | — | — | — | 50.7 | 0.22 | 29 |
| LYD159 | 60662.6 | 3.6 | 0.06 | 53 | 9.3 | 0.11 | 6 | 63.1 | 0.07 | 60 |
| LYD159 | 60665.5 | 2.8 | 0.03 | 17 | — | — | — | 45.4 | 0.02 | 15 |
| LYD159 | 60666.2 | 2.6 | 0.30 | 9 | 9.4 | 0.16 | 7 | — | — | — |
| LYD129 | 60792.1 | — | — | — | — | — | — | 61.9 | 0.11 | 57 |
| LYD129 | 60793.2 | — | — | — | — | — | — | 58.9 | L | 50 |
| LYD129 | 60794.1 | 3.4 | L | 45 | — | — | — | 57.6 | L | 46 |
| LYD129 | 60794.2 | 3.1 | L | 29 | 9.5 | 0.12 | 9 | 56.6 | L | 44 |
| LYD129 | 60796.1 | — | — | — | 9.4 | 0.03 | 7 | 58.9 | 0.26 | 50 |

TABLE 41-continued

Genes showing improved plant performance at Normal growth conditions under regulation of 6669 promoter

| Gene Name | Event # | Leaf Blade Area [cm2] Ave. | P-Val. | % Incr. | Leaf Number Ave. | P-Val. | % Incr. | Plot Coverage [cm2] Ave. | P-Val. | % Incr. |
|---|---|---|---|---|---|---|---|---|---|---|
| LYD127 | 60681.1 | 3.2 | 0.23 | 35 | 9.1 | 0.16 | 4 | 53.5 | 0.29 | 36 |
| LYD127 | 60682.2 | 3.3 | 0.08 | 37 | — | — | — | 55.3 | 0.17 | 41 |
| LYD127 | 60682.3 | 3.2 | 0.04 | 35 | — | — | — | 55.4 | 0.04 | 41 |
| LYD127 | 60683.1 | 3.2 | 0.13 | 36 | — | — | — | 54.4 | 0.10 | 38 |
| LYD123 | 60786.3 | 3.7 | 0.08 | 56 | 9.7 | 0.13 | 11 | 68.0 | L | 73 |
| LYD123 | 60788.1 | 4.1 | 0.05 | 72 | 9.7 | 0.13 | 11 | 74.8 | 0.10 | 90 |
| LYD123 | 60788.4 | 3.7 | L | 55 | 9.1 | 0.15 | 4 | 64.2 | L | 63 |
| LYD123 | 60789.1 | 3.4 | L | 42 | 9.2 | 0.07 | 6 | 60.5 | L | 54 |
| LYD123 | 60789.2 | 3.7 | L | 57 | 9.4 | 0.03 | 7 | 67.5 | L | 72 |
| LYD12 | 60936.2 | 2.9 | L | 22 | — | — | — | 48.6 | L | 24 |
| LYD12 | 60936.4 | 3.1 | 0.02 | 32 | 9.5 | 0.02 | 9 | 56.2 | L | 43 |
| LYD12 | 60937.1 | 3.4 | 0.01 | 45 | 9.6 | 0.09 | 10 | 60.9 | L | 55 |
| LYD12 | 60938.2 | — | — | — | 9.3 | 0.11 | 6 | — | — | — |
| LYD119 | 61004.2 | 2.8 | 0.06 | 18 | — | — | — | 46.7 | 0.04 | 19 |
| LYD119 | 61005.4 | 2.5 | 0.26 | 7 | — | — | — | 42.2 | 0.27 | 7 |
| LYD119 | 61008.3 | 2.7 | 0.13 | 13 | 9.4 | L | 8 | 46.6 | 0.20 | 19 |
| LYD105 | 60652.2 | 3.0 | 0.05 | 27 | — | — | — | 50.6 | 0.05 | 29 |
| LYD105 | 60652.4 | 3.6 | 0.10 | 51 | — | — | — | 64.8 | 0.15 | 65 |
| LYD105 | 60653.2 | 3.5 | L | 46 | 9.1 | 0.15 | 4 | 57.6 | L | 46 |
| LYD104 | 60952.1 | 3.0 | L | 25 | — | — | — | 51.0 | L | 30 |
| LYD104 | 60953.2 | 3.5 | 0.03 | 48 | — | — | — | 59.2 | 0.08 | 50 |
| LYD104 | 60955.1 | — | — | — | — | — | — | 47.5 | 0.16 | 21 |
| LYD104 | 60956.1 | 3.1 | L | 31 | 9.7 | 0.03 | 11 | 54.9 | L | 40 |
| LYD104 | 60957.2 | 2.8 | 0.07 | 18 | 9.4 | 0.03 | 7 | 49.4 | 0.01 | 26 |
| LYD102 | 60958.3 | 3.0 | 0.23 | 26 | — | — | — | 50.2 | 0.26 | 28 |
| LYD102 | 60959.1 | — | — | — | 9.6 | L | 10 | — | — | — |
| LYD102 | 60960.1 | — | — | — | 9.4 | 0.03 | 7 | 53.3 | 0.19 | 35 |
| LYD102 | 60961.3 | 3.3 | L | 39 | 9.4 | 0.07 | 8 | 59.7 | L | 52 |
| CONT. | — | 2.4 | — | — | 8.8 | — | — | 39.4 | — | — |

Table 41.
"CONT."—Control;
"Ave."—Average;
"% Incr." = % increment;
"p-val."—p-value,
L—p < 0.01.

TABLE 42

Genes showing improved plant performance at Normal growth conditions under regulation of 6669 promoter

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| LYD97 | 60078.4 | 0.7 | 0.18 | 20 | — | — | — | — | — | — |
| LYD97 | 60082.1 | 0.7 | 0.06 | 26 | — | — | — | — | — | — |
| LYD87 | 60150.3 | — | — | — | 8.5 | 0.06 | 27 | — | — | — |
| LYD85 | 60015.1 | 0.7 | 0.07 | 28 | 7.9 | 0.19 | 19 | — | — | — |
| LYD79 | 60021.4 | 0.7 | 0.27 | 17 | 8.0 | 0.16 | 19 | 0.5 | 0.21 | 9 |
| LYD76 | 60288.3 | 0.7 | 0.18 | 20 | — | — | — | — | — | — |
| LYD76 | 60288.4 | — | — | — | 9.3 | 0.01 | 39 | 0.5 | 0.05 | 15 |
| LYD76 | 60289.3 | 0.7 | 0.14 | 20 | 9.4 | L | 41 | 0.5 | 0.03 | 15 |
| LYD6 | 60090.2 | 0.7 | 0.12 | 22 | 7.9 | 0.19 | 18 | — | — | — |
| LYD6 | 60093.4 | — | — | — | 7.9 | 0.21 | 18 | — | — | — |
| LYD6 | 60094.3 | — | — | — | — | — | — | 0.5 | 0.29 | 8 |
| LYD55 | 60175.4 | — | — | — | 7.9 | 0.21 | 17 | — | — | — |
| LYD53 | 60207.2 | — | — | — | — | — | — | 0.5 | 0.19 | 9 |
| LYD53 | 60207.3 | 0.7 | 0.30 | 15 | — | — | — | — | — | — |
| LYD4 | 60096.6 | 0.7 | 0.30 | 15 | — | — | — | — | — | — |
| LYD33 | 60160.2 | 0.7 | 0.24 | 18 | — | — | — | — | — | — |
| LYD275 | 60003.5 | 0.7 | 0.14 | 21 | 7.7 | 0.28 | 15 | 0.5 | 0.03 | 16 |
| LYD246 | 60212.4 | 0.7 | 0.18 | 19 | 9.1 | 0.02 | 35 | 0.5 | 0.12 | 11 |
| LYD234 | 60181.3 | 0.7 | 0.10 | 24 | 9.5 | L | 41 | 0.5 | 0.02 | 18 |
| LYD234 | 60181.4 | — | — | — | — | — | — | 0.5 | 0.05 | 14 |
| LYD234 | 60181.8 | 0.7 | 0.18 | 19 | — | — | — | — | — | — |
| LYD23 | 60216.1 | — | — | — | 8.2 | 0.10 | 23 | 0.5 | 0.07 | 13 |
| LYD23 | 60216.2 | — | — | — | 7.7 | 0.28 | 15 | — | — | — |

TABLE 42-continued

Genes showing improved plant performance at Normal growth conditions under regulation of 6669 promoter

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| LYD224 | 60038.1 | — | — | — | 7.8 | 0.22 | 17 | — | — | — |
| LYD224 | 60040.1 | — | — | — | 8.5 | 0.06 | 27 | 0.5 | 0.29 | 8 |
| LYD224 | 60040.8 | 0.7 | 0.17 | 23 | 7.9 | 0.22 | 17 | — | — | — |
| LYD220 | 60222.2 | 0.7 | 0.15 | 21 | — | — | — | — | — | — |
| LYD220 | 60223.2 | — | — | — | 7.8 | 0.23 | 17 | — | — | — |
| LYD220 | 60224.1 | 0.7 | 0.27 | 15 | 9.0 | 0.02 | 34 | 0.5 | 0.29 | 8 |
| LYD22 | 60043.4 | 0.7 | 0.11 | 25 | 8.4 | 0.09 | 25 | 0.5 | 0.06 | 14 |
| LYD22 | 60044.1 | 0.7 | 0.23 | 16 | — | — | — | 0.5 | 0.07 | 14 |
| LYD217 | 60051.2 | — | — | — | 7.8 | 0.25 | 16 | 0.5 | 0.14 | 11 |
| LYD217 | 60052.3 | — | — | — | 8.1 | 0.14 | 20 | — | — | — |
| LYD213 | 60055.4 | 0.7 | 0.20 | 17 | 7.7 | 0.29 | 15 | 0.5 | 0.24 | 8 |
| LYD213 | 60056.3 | 0.8 | 0.01 | 36 | 8.5 | 0.07 | 26 | 0.5 | 0.27 | 8 |
| LYD213 | 60058.3 | 0.7 | 0.17 | 18 | — | — | — | — | — | — |
| LYD208 | 60064.8 | — | — | — | 7.8 | 0.23 | 16 | 0.5 | 0.18 | 9 |
| LYD20 | 60066.2 | 0.7 | 0.13 | 21 | — | — | — | — | — | — |
| LYD194 | 60084.4 | 0.7 | 0.04 | 30 | 9.0 | 0.02 | 35 | 0.5 | 0.12 | 11 |
| LYD190 | 60244.1 | 0.7 | 0.13 | 21 | — | — | — | — | — | — |
| LYD186 | 60237.4 | 0.7 | 0.30 | 15 | 8.5 | 0.06 | 27 | 0.5 | 0.18 | 9 |
| LYD186 | 60238.4 | — | — | — | 8.0 | 0.19 | 19 | 0.5 | 0.27 | 8 |
| LYD184 | 60228.3 | 0.7 | 0.16 | 19 | — | — | — | — | — | — |
| LYD173 | 60139.3 | 0.7 | 0.14 | 20 | — | — | — | — | — | — |
| LYD173 | 60141.1 | 0.7 | 0.30 | 15 | — | — | — | — | — | — |
| LYD14 | 60120.2 | 0.7 | 0.14 | 20 | — | — | — | — | — | — |
| LYD14 | 60122.2 | 0.7 | 0.30 | 15 | — | — | — | — | — | — |
| LYD14 | 60123.8 | 0.7 | 0.09 | 24 | — | — | — | — | — | — |
| LYD13 | 60193.4 | 0.7 | 0.25 | 16 | 8.3 | 0.08 | 24 | 0.5 | 0.21 | 9 |
| LYD122 | 60199.2 | — | — | — | 7.8 | 0.22 | 17 | 0.5 | 0.06 | 13 |
| LYD122 | 60199.4 | — | — | — | 7.7 | 0.26 | 15 | — | — | — |
| LYD122 | 60200.2 | — | — | — | 8.4 | 0.08 | 25 | 0.5 | 0.11 | 11 |
| LYD122 | 60201.1 | 0.7 | 0.24 | 16 | — | — | — | — | — | — |
| LYD117 | 60033.5 | 0.7 | 0.21 | 17 | 8.1 | 0.14 | 21 | 0.5 | 0.14 | 11 |
| LYD117 | 60033.6 | — | — | — | 8.0 | 0.15 | 20 | 0.5 | 0.08 | 12 |
| LYD117 | 60034.4 | — | — | — | 7.8 | 0.25 | 16 | — | — | — |
| LYD11 | 60007.1 | 0.7 | 0.22 | 17 | — | — | — | — | — | — |
| LYD11 | 60007.4 | 0.7 | 0.26 | 16 | — | — | — | — | — | — |
| LYD11 | 60010.2 | — | — | — | 8.5 | 0.06 | 27 | 0.5 | 0.13 | 11 |
| LYD101 | 60075.3 | — | — | — | 8.1 | 0.16 | 20 | — | — | — |
| LYD10 | 60132.2 | 0.7 | 0.15 | 20 | 9.4 | L | 40 | 0.5 | 0.03 | 16 |
| CONT. | — | 0.6 | — | — | 6.7 | — | — | 0.5 | — | — |
| LYD81 | 60944.1 | — | — | — | — | — | — | 0.5 | 0.25 | 9 |
| LYD279 | 60556.1 | 0.8 | 0.23 | 12 | — | — | — | — | — | — |
| LYD27 | 60542.1 | 0.9 | 0.10 | 17 | 12.9 | 0.22 | 15 | — | — | — |
| LYD257 | 60560.4 | 0.8 | 0.30 | 11 | — | — | — | — | — | — |
| LYD257 | 60562.4 | — | — | — | 12.8 | 0.23 | 15 | — | — | — |
| LYD253 | 60841.4 | — | — | — | 12.6 | 0.30 | 13 | — | — | — |
| LYD253 | 60842.3 | — | — | — | 13.7 | 0.10 | 22 | 0.5 | 0.09 | 14 |
| LYD245 | 60646.2 | 0.8 | 0.25 | 12 | — | — | — | — | — | — |
| LYD235 | 60929.3 | 0.8 | 0.27 | 11 | 13.4 | 0.13 | 19 | 0.5 | 0.04 | 15 |
| LYD219 | 60674.4 | — | — | — | 12.9 | 0.28 | 15 | 0.5 | 0.30 | 9 |
| LYD201 | 60172.1 | — | — | — | — | — | — | 0.5 | 0.30 | 8 |
| LYD200 | 60481.3 | 0.8 | 0.27 | 11 | — | — | — | — | — | — |
| LYD153 | 60697.3 | 0.8 | 0.24 | 13 | 13.0 | 0.22 | 16 | 0.5 | 0.21 | 11 |
| LYD153 | 60698.7 | 0.8 | 0.24 | 13 | — | — | — | — | — | — |
| LYD153 | 60700.3 | — | — | — | 14.9 | 0.02 | 33 | 0.5 | 0.02 | 20 |
| LYD144 | 60866.4 | — | — | — | 13.3 | 0.13 | 19 | 0.5 | 0.21 | 9 |
| LYD144 | 60866.5 | — | — | — | 13.4 | 0.12 | 20 | 0.5 | 0.04 | 16 |
| LYD129 | 60792.1 | — | — | — | 14.3 | 0.04 | 27 | 0.5 | 0.08 | 15 |
| LYD125 | 60823.3 | — | — | — | 15.0 | 0.01 | 34 | 0.5 | 0.01 | 19 |
| LYD12 | 60936.4 | — | — | — | 14.5 | 0.02 | 29 | 0.5 | 0.05 | 15 |
| LYD12 | 60938.2 | — | — | — | 13.1 | 0.17 | 17 | — | — | — |
| LYD104 | 60956.1 | — | — | — | 14.3 | 0.03 | 28 | — | — | — |
| LYD103 | 60259.4 | — | — | — | 13.7 | 0.09 | 23 | 0.5 | 0.28 | 9 |
| LYD103 | 60261.6 | — | — | — | 13.4 | 0.16 | 19 | 0.5 | 0.29 | 9 |
| LYD102 | 60961.2 | — | — | — | 13.3 | 0.13 | 19 | — | — | — |
| CONT. | — | 0.7 | — | — | 11.2 | — | — | 0.4 | — | — |
| LYD82 | 61058.2 | — | — | — | 9.2 | L | 50 | 0.5 | 0.05 | 27 |
| LYD82 | 61058.3 | — | — | — | 8.8 | L | 44 | 0.5 | 0.05 | 26 |
| LYD82 | 61061.3 | — | — | — | 8.0 | 0.03 | 30 | 0.5 | 0.11 | 22 |
| LYD82 | 61061.4 | — | — | — | 7.4 | 0.13 | 20 | — | — | — |
| LYD81 | 60940.3 | — | — | — | 7.2 | 0.21 | 17 | — | — | — |
| LYD81 | 60943.4 | — | — | — | 8.3 | L | 35 | 0.4 | 0.17 | 18 |

TABLE 42-continued

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD81 | 60944.1 | — | — | — | 8.4 | L | 37 | 0.5 | 0.13 | 21 |
| LYD81 | 60944.4 | — | — | — | 7.3 | 0.15 | 19 | — | — | — |
| LYD81 | 60944.8 | — | — | — | 8.9 | L | 45 | 0.5 | 0.14 | 20 |
| LYD80 | 61049.1 | — | — | — | 7.5 | 0.10 | 22 | — | — | — |
| LYD70 | 60853.3 | — | — | — | 7.6 | 0.07 | 24 | 0.4 | 0.16 | 19 |
| LYD70 | 60854.3 | — | — | — | 10.4 | L | 70 | 0.5 | 0.01 | 36 |
| LYD70 | 60856.2 | — | — | — | 7.5 | 0.16 | 22 | — | — | — |
| LYD7 | 60667.1 | — | — | — | 7.9 | 0.03 | 29 | — | — | — |
| LYD7 | 60668.1 | — | — | — | 9.1 | L | 49 | 0.4 | 0.25 | 16 |
| LYD7 | 60670.2 | — | — | — | 7.8 | 0.06 | 27 | — | — | — |
| LYD7 | 60671.2 | — | — | — | 7.0 | 0.30 | 14 | — | — | — |
| LYD7 | 60671.3 | — | — | — | 7.6 | 0.09 | 24 | — | — | — |
| LYD69 | 61028.1 | — | — | — | 8.0 | 0.02 | 30 | — | — | — |
| LYD69 | 61028.5 | — | — | — | 7.4 | 0.13 | 20 | — | — | — |
| LYD69 | 61029.4 | — | — | — | 7.1 | 0.23 | 16 | — | — | — |
| LYD69 | 61030.3 | — | — | — | 7.3 | 0.26 | 18 | — | — | — |
| LYD69 | 61030.5 | — | — | — | 7.6 | 0.12 | 24 | — | — | — |
| LYD67 | 60633.4 | — | — | — | 8.3 | 0.02 | 36 | — | — | — |
| LYD59 | 61011.2 | — | — | — | 8.0 | 0.03 | 30 | — | — | — |
| LYD58 | 61098.4 | — | — | — | 7.5 | 0.16 | 22 | — | — | — |
| LYD58 | 61102.1 | — | — | — | 7.1 | 0.26 | 15 | — | — | — |
| LYD51 | 60266.5 | — | — | — | 7.6 | 0.07 | 24 | — | — | — |
| LYD51 | 60266.6 | — | — | — | 7.8 | 0.06 | 27 | — | — | — |
| LYD51 | 60269.1 | — | — | — | 7.7 | 0.07 | 25 | — | — | — |
| LYD51 | 60269.3 | — | — | — | 9.0 | L | 47 | 0.5 | 0.13 | 21 |
| LYD51 | 60269.6 | — | — | — | 7.8 | 0.06 | 27 | 0.4 | 0.22 | 18 |
| LYD5 | 61087.2 | — | — | — | 7.1 | 0.21 | 16 | — | — | — |
| LYD5 | 61087.3 | — | — | — | 7.5 | 0.09 | 23 | 0.4 | 0.21 | 17 |
| LYD5 | 61089.3 | — | — | — | 8.2 | 0.01 | 34 | 0.4 | 0.22 | 16 |
| LYD5 | 61090.2 | — | — | — | 8.0 | 0.14 | 30 | — | — | — |
| LYD49 | 60710.2 | — | — | — | 7.3 | 0.16 | 20 | — | — | — |
| LYD49 | 60712.1 | — | — | — | 7.7 | 0.11 | 26 | — | — | — |
| LYD49 | 60713.2 | — | — | — | 7.5 | 0.13 | 22 | — | — | — |
| LYD49 | 60714.1 | — | — | — | 8.8 | L | 43 | 0.5 | 0.07 | 24 |
| LYD48 | 61034.2 | — | — | — | 7.4 | 0.12 | 20 | — | — | — |
| LYD48 | 61035.3 | — | — | — | 8.2 | 0.02 | 33 | — | — | — |
| LYD48 | 61036.3 | — | — | — | 7.6 | 0.08 | 25 | — | — | — |
| LYD36 | 60980.1 | — | — | — | 8.4 | 0.04 | 36 | — | — | — |
| LYD36 | 60980.2 | — | — | — | 9.5 | L | 55 | — | — | — |
| LYD36 | 60980.3 | — | — | — | 7.5 | 0.14 | 22 | — | — | — |
| LYD36 | 60980.4 | — | — | — | 7.5 | 0.13 | 23 | — | — | — |
| LYD36 | 60982.1 | — | — | — | 8.7 | L | 42 | — | — | — |
| LYD34 | 60270.4 | — | — | — | 8.2 | 0.02 | 34 | 0.4 | 0.25 | 16 |
| LYD34 | 60270.6 | — | — | — | 9.3 | L | 51 | 0.5 | 0.08 | 24 |
| LYD34 | 60271.2 | — | — | — | 7.6 | 0.08 | 24 | — | — | — |
| LYD34 | 60271.3 | — | — | — | 7.5 | 0.10 | 22 | — | — | — |
| LYD34 | 60272.5 | — | — | — | 9.1 | L | 48 | 0.4 | 0.18 | 18 |
| LYD276 | 61016.1 | — | — | — | 8.9 | L | 44 | 0.5 | 0.13 | 20 |
| LYD276 | 61016.4 | — | — | — | 8.6 | L | 41 | 0.4 | 0.22 | 16 |
| LYD253 | 60841.3 | — | — | — | 10.5 | L | 70 | 0.5 | 0.03 | 31 |
| LYD253 | 60841.4 | — | — | — | 7.7 | 0.13 | 26 | — | — | — |
| LYD253 | 60842.1 | — | — | — | 9.6 | L | 56 | 0.5 | 0.08 | 24 |
| LYD253 | 60842.3 | — | — | — | 9.8 | L | 59 | 0.5 | 0.04 | 34 |
| LYD235 | 60929.3 | — | — | — | 9.7 | L | 57 | 0.5 | 0.09 | 26 |
| LYD235 | 60930.6 | — | — | — | 7.8 | 0.05 | 27 | — | — | — |
| LYD235 | 60931.2 | — | — | — | 8.5 | L | 39 | — | — | — |
| LYD204 | 60704.2 | — | — | — | 8.3 | 0.01 | 36 | 0.4 | 0.16 | 19 |
| LYD204 | 60704.4 | — | — | — | 8.0 | 0.03 | 30 | — | — | — |
| LYD204 | 60707.2 | — | — | — | 7.6 | 0.07 | 24 | 0.5 | 0.14 | 20 |
| LYD202 | 60421.2 | — | — | — | 9.4 | L | 53 | 0.5 | 0.06 | 26 |
| LYD202 | 60421.3 | — | — | — | 7.9 | 0.03 | 28 | 0.4 | 0.17 | 18 |
| LYD202 | 60422.4 | — | — | — | 7.1 | 0.25 | 15 | — | — | — |
| LYD202 | 60425.2 | — | — | — | 7.8 | 0.06 | 27 | 0.5 | 0.12 | 22 |
| LYD197 | 60988.2 | — | — | — | 7.2 | 0.17 | 18 | — | — | — |
| LYD197 | 60988.4 | — | — | — | 7.0 | 0.28 | 14 | — | — | — |
| LYD197 | 60989.4 | — | — | — | 9.0 | 0.01 | 47 | 0.5 | 0.07 | 28 |
| LYD197 | 60990.3 | — | — | — | 8.0 | 0.03 | 30 | 0.4 | 0.23 | 16 |
| LYD195 | 60252.1 | — | — | — | 7.1 | 0.24 | 15 | — | — | — |
| LYD195 | 60253.2 | — | — | — | 8.0 | 0.03 | 30 | — | — | — |
| LYD195 | 60255.2 | — | — | — | 8.1 | 0.02 | 33 | 0.4 | 0.19 | 17 |
| LYD195 | 60256.1 | — | — | — | 7.6 | 0.08 | 23 | — | — | — |

TABLE 42-continued

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD195 | 60257.2 | — | — | — | 8.0 | 0.02 | 30 | 0.4 | 0.16 | 19 |
| LYD180 | 60462.2 | — | — | — | 7.2 | 0.21 | 17 | — | — | — |
| LYD180 | 60464.4 | — | — | — | 7.5 | 0.08 | 23 | 0.4 | 0.30 | 14 |
| LYD180 | 60465.2 | — | — | — | 7.3 | 0.17 | 18 | — | — | — |
| LYD176 | 61040.2 | — | — | — | 9.7 | L | 57 | 0.4 | 0.21 | 17 |
| LYD176 | 61041.1 | — | — | — | 9.3 | L | 51 | 0.5 | 0.13 | 20 |
| LYD176 | 61043.1 | — | — | — | 10.9 | L | 77 | 0.5 | 0.09 | 25 |
| LYD172 | 61064.2 | 0.8 | 0.19 | 32 | 8.4 | 0.01 | 36 | — | — | — |
| LYD172 | 61065.3 | — | — | — | 9.9 | L | 61 | 0.4 | 0.19 | 19 |
| LYD172 | 61066.3 | — | — | — | 9.2 | L | 50 | 0.4 | 0.22 | 18 |
| LYD172 | 61066.4 | — | — | — | 9.1 | L | 49 | 0.5 | 0.15 | 20 |
| LYD172 | 61067.3 | — | — | — | 7.0 | 0.29 | 13 | — | — | — |
| LYD166 | 60998.3 | — | — | — | 9.4 | L | 54 | 0.5 | 0.06 | 26 |
| LYD166 | 60998.4 | — | — | — | 9.9 | L | 61 | 0.5 | 0.03 | 30 |
| LYD166 | 60999.1 | — | — | — | 9.3 | L | 51 | 0.4 | 0.24 | 16 |
| LYD166 | 61000.2 | — | — | — | 9.1 | L | 48 | 0.5 | 0.07 | 26 |
| LYD166 | 61000.4 | — | — | — | 9.3 | L | 51 | 0.4 | 0.29 | 16 |
| LYD16 | 60314.1 | — | — | — | 8.4 | 0.02 | 36 | 0.4 | 0.26 | 15 |
| LYD16 | 60314.4 | — | — | — | 8.7 | L | 41 | 0.5 | 0.10 | 24 |
| LYD16 | 60315.1 | — | — | — | 8.0 | 0.04 | 30 | — | — | — |
| LYD16 | 60315.3 | — | — | — | 7.7 | 0.08 | 25 | — | — | — |
| LYD159 | 60662.6 | — | — | — | 9.9 | L | 61 | 0.5 | 0.03 | 32 |
| LYD159 | 60665.5 | — | — | — | 7.1 | 0.25 | 15 | — | — | — |
| LYD159 | 60666.2 | 0.8 | 0.20 | 30 | — | — | — | — | — | — |
| LYD129 | 60792.1 | — | — | — | 9.4 | L | 53 | 0.5 | 0.07 | 28 |
| LYD129 | 60793.2 | — | — | — | 8.9 | L | 45 | 0.4 | 0.19 | 17 |
| LYD129 | 60794.1 | — | — | — | 8.7 | L | 41 | 0.5 | 0.15 | 19 |
| LYD129 | 60794.2 | — | — | — | 8.7 | L | 41 | — | — | — |
| LYD129 | 60796.1 | — | — | — | 8.9 | 0.01 | 45 | — | — | — |
| LYD127 | 60681.1 | — | — | — | 8.4 | 0.02 | 38 | 0.5 | 0.15 | 21 |
| LYD127 | 60682.2 | — | — | — | 8.8 | L | 43 | 0.5 | 0.15 | 19 |
| LYD127 | 60682.3 | — | — | — | 8.5 | L | 38 | — | — | — |
| LYD127 | 60683.1 | — | — | — | 8.7 | L | 42 | 0.4 | 0.17 | 19 |
| LYD123 | 60786.3 | — | — | — | 10.6 | L | 73 | 0.5 | 0.02 | 32 |
| LYD123 | 60788.1 | — | — | — | 11.5 | L | 88 | 0.5 | 0.01 | 36 |
| LYD123 | 60788.4 | — | — | — | 9.9 | L | 62 | 0.5 | 0.03 | 30 |
| LYD123 | 60789.1 | — | — | — | 9.0 | L | 46 | — | — | — |
| LYD123 | 60789.2 | — | — | — | 10.5 | L | 72 | 0.5 | 0.04 | 28 |
| LYD12 | 60936.2 | — | — | — | 7.3 | 0.14 | 19 | — | — | — |
| LYD12 | 60936.4 | — | — | — | 8.7 | L | 41 | — | — | — |
| LYD12 | 60937.1 | — | — | — | 9.5 | L | 54 | 0.5 | 0.09 | 23 |
| LYD12 | 60938.2 | — | — | — | 7.8 | 0.09 | 27 | — | — | — |
| LYD119 | 61004.2 | — | — | — | 7.3 | 0.15 | 19 | — | — | — |
| LYD119 | 61008.3 | — | — | — | 7.4 | 0.13 | 21 | — | — | — |
| LYD105 | 60652.2 | — | — | — | 8.3 | 0.01 | 35 | 0.5 | 0.12 | 21 |
| LYD105 | 60652.4 | — | — | — | 10.0 | L | 63 | 0.5 | 0.07 | 26 |
| LYD105 | 60653.2 | — | — | — | 8.6 | L | 40 | 0.4 | 0.17 | 18 |
| LYD104 | 60952.1 | — | — | — | 7.6 | 0.08 | 23 | — | — | — |
| LYD104 | 60953.2 | — | — | — | 9.3 | L | 51 | 0.5 | 0.08 | 24 |
| LYD104 | 60955.1 | — | — | — | 7.2 | 0.18 | 18 | — | — | — |
| LYD104 | 60956.1 | — | — | — | 8.5 | L | 38 | 0.4 | 0.20 | 17 |
| LYD104 | 60957.2 | — | — | — | 7.6 | 0.07 | 24 | — | — | — |
| LYD102 | 60958.3 | — | — | — | 7.7 | 0.08 | 25 | — | — | — |
| LYD102 | 60959.1 | 0.8 | 0.18 | 34 | — | — | — | — | — | — |
| LYD102 | 60960.1 | — | — | — | 8.0 | 0.03 | 31 | — | — | — |
| LYD102 | 60961.2 | — | — | — | 7.5 | 0.15 | 23 | — | — | — |
| LYD102 | 60961.3 | — | — | — | 9.1 | L | 48 | 0.4 | 0.24 | 16 |
| CONT. | — | 0.6 | — | — | 6.1 | — | — | 0.4 | — | — |

Table 42.
"CONT."—Control;
"Ave."—Average;
"% Incr." = % increment;
"p-val."—p-value, L-p < 0.01.

TABLE 43

Genes showing improved plant performance at Normal growth conditions under regulation of 6669 promoter

| Gene Name | Event # | Harvest Index Ave. | Harvest Index P-Val. | Harvest Index % Incr. | Rosette Area [cm2] Ave. | Rosette Area [cm2] P-Val. | Rosette Area [cm2] % Incr. | Rosette Diameter [cm] Ave. | Rosette Diameter [cm] P-Val. | Rosette Diameter [cm] % Incr. |
|---|---|---|---|---|---|---|---|---|---|---|
| LYD97 | 60080.1 | 0.4 | 0.10 | 21 | — | — | — | — | — | — |
| LYD87 | 60150.2 | 0.4 | 0.02 | 30 | — | — | — | — | — | — |
| LYD87 | 60150.3 | — | — | — | 8.2 | 0.21 | 29 | — | — | — |
| LYD85 | 60014.2 | 0.4 | 0.24 | 23 | — | — | — | — | — | — |
| LYD85 | 60014.4 | 0.4 | 0.02 | 30 | — | — | — | — | — | — |
| LYD85 | 60015.1 | 0.4 | L | 40 | — | — | — | — | — | — |
| LYD85 | 60016.3 | 0.5 | L | 47 | — | — | — | — | — | — |
| LYD79 | 60018.2 | 0.4 | 0.04 | 25 | — | — | — | — | — | — |
| LYD79 | 60018.3 | 0.4 | 0.09 | 21 | — | — | — | 4.9 | 0.22 | 7 |
| LYD79 | 60021.4 | — | — | — | 7.6 | 0.25 | 19 | 5.1 | 0.28 | 11 |
| LYD76 | 60288.4 | — | — | — | 8.7 | 0.29 | 38 | 5.3 | 0.20 | 15 |
| LYD76 | 60289.3 | — | — | — | 8.9 | L | 41 | 5.3 | L | 17 |
| LYD76 | 60290.1 | 0.4 | 0.29 | 31 | 6.9 | 0.05 | 9 | 4.7 | 0.13 | 4 |
| LYD76 | 60291.3 | — | — | — | — | — | — | 4.8 | 0.22 | 5 |
| LYD6 | 60090.2 | — | — | — | 7.5 | 0.22 | 18 | — | — | — |
| LYD6 | 60093.1 | 0.4 | 0.18 | 21 | — | — | — | — | — | — |
| LYD6 | 60094.3 | 0.4 | 0.06 | 36 | — | — | — | — | — | — |
| LYD55 | 60174.1 | 0.4 | 0.11 | 21 | — | — | — | — | — | — |
| LYD55 | 60175.1 | 0.4 | 0.14 | 28 | — | — | — | — | — | — |
| LYD55 | 60175.4 | — | — | — | 7.5 | 0.19 | 18 | 5.1 | 0.27 | 11 |
| LYD53 | 60205.1 | — | — | — | — | — | — | 4.8 | 0.18 | 5 |
| LYD53 | 60206.2 | — | — | — | 6.6 | 0.24 | 5 | 4.8 | 0.28 | 4 |
| LYD53 | 60207.2 | — | — | — | 7.1 | 0.05 | 11 | 5.0 | 0.06 | 8 |
| LYD44 | 60248.2 | 0.4 | 0.15 | 16 | — | — | — | 4.8 | 0.04 | 5 |
| LYD44 | 60249.1 | 0.3 | 0.26 | 13 | — | — | — | — | — | — |
| LYD4 | 60096.2 | — | — | — | 7.1 | 0.02 | 12 | 4.9 | L | 7 |
| LYD4 | 60096.6 | 0.4 | 0.11 | 46 | — | — | — | — | — | — |
| LYD33 | 60159.3 | 0.4 | 0.11 | 22 | — | — | — | — | — | — |
| LYD33 | 60160.4 | 0.4 | 0.27 | 19 | — | — | — | — | — | — |
| LYD275 | 60000.3 | 0.4 | 0.11 | 32 | — | — | — | — | — | — |
| LYD275 | 60002.3 | — | — | — | 6.8 | 0.10 | 7 | 4.7 | 0.10 | 4 |
| LYD275 | 60003.5 | — | — | — | 7.2 | 0.14 | 14 | 5.0 | 0.01 | 10 |
| LYD246 | 60212.3 | 0.4 | 0.06 | 23 | — | — | — | — | — | — |
| LYD246 | 60212.4 | — | — | — | 8.5 | 0.11 | 33 | 5.1 | 0.06 | 11 |
| LYD246 | 60214.2 | 0.4 | 0.14 | 20 | — | — | — | — | — | — |
| LYD234 | 60180.3 | 0.4 | 0.02 | 30 | — | — | — | — | — | — |
| LYD234 | 60181.3 | 0.4 | 0.11 | 36 | 8.9 | 0.22 | 41 | 5.4 | 0.22 | 18 |
| LYD234 | 60181.4 | 0.4 | 0.20 | 23 | 7.1 | 0.02 | 13 | 5.1 | 0.04 | 11 |
| LYD234 | 60181.8 | 0.4 | 0.09 | 20 | 7.1 | 0.29 | 12 | — | — | — |
| LYD23 | 60216.1 | 0.4 | 0.06 | 22 | 7.8 | L | 23 | 5.2 | L | 14 |
| LYD23 | 60216.2 | — | — | — | 7.3 | 0.27 | 16 | 4.9 | 0.28 | 7 |
| LYD23 | 60217.2 | 0.4 | 0.22 | 24 | 6.9 | 0.08 | 8 | — | — | — |
| LYD224 | 60038.1 | — | — | — | — | — | — | 5.0 | 0.21 | 9 |
| LYD224 | 60040.1 | — | — | — | 8.2 | 0.19 | 29 | 5.2 | 0.11 | 14 |
| LYD224 | 60040.8 | — | — | — | 7.4 | 0.25 | 17 | 4.9 | 0.25 | 7 |
| LYD220 | 60222.2 | 0.4 | 0.04 | 31 | 7.0 | 0.02 | 11 | — | — | — |
| LYD220 | 60223.1 | — | — | — | 7.0 | 0.14 | 11 | 4.8 | 0.28 | 6 |
| LYD220 | 60223.2 | — | — | — | 7.4 | 0.03 | 17 | 5.0 | L | 9 |
| LYD220 | 60224.1 | — | — | — | 8.6 | 0.21 | 35 | 5.2 | 0.14 | 14 |
| LYD220 | 60224.2 | — | — | — | 6.9 | 0.06 | 9 | 4.7 | 0.14 | 4 |
| LYD22 | 60043.1 | 0.4 | 0.03 | 29 | — | — | — | — | — | — |
| LYD22 | 60043.4 | — | — | — | — | — | — | 5.1 | 0.20 | 13 |
| LYD22 | 60044.1 | — | — | — | 7.8 | L | 22 | 5.2 | L | 14 |
| LYD217 | 60051.2 | 0.4 | 0.07 | 25 | — | — | — | 5.1 | 0.24 | 11 |
| LYD217 | 60052.3 | 0.4 | 0.26 | 33 | 7.6 | 0.23 | 20 | 5.0 | 0.15 | 9 |
| LYD213 | 60054.1 | 0.4 | 0.25 | 30 | — | — | — | — | — | — |
| LYD213 | 60054.4 | — | — | — | 6.9 | 0.04 | 9 | 4.7 | 0.29 | 3 |
| LYD213 | 60055.4 | — | — | — | 7.2 | L | 14 | 4.8 | 0.16 | 6 |
| LYD213 | 60056.3 | — | — | — | 8.0 | 0.03 | 26 | 5.1 | L | 11 |
| LYD213 | 60058.3 | — | — | — | 7.0 | 0.03 | 11 | 4.8 | 0.05 | 4 |
| LYD208 | 60064.1 | 0.4 | 0.28 | 15 | — | — | — | — | — | — |
| LYD208 | 60064.2 | 0.4 | 0.17 | 18 | — | — | — | — | — | — |
| LYD208 | 60064.8 | 0.4 | 0.30 | 28 | 7.3 | L | 16 | 5.0 | 0.19 | 9 |
| LYD20 | 60067.1 | — | — | — | 7.2 | L | 14 | 4.9 | 0.01 | 7 |
| LYD20 | 60070.2 | 0.4 | 0.09 | 19 | — | — | — | — | — | — |
| LYD2 | 60102.2 | 0.4 | 0.03 | 32 | — | — | — | — | — | — |
| LYD2 | 60103.4 | 0.4 | 0.11 | 18 | — | — | — | — | — | — |
| LYD2 | 60104.4 | 0.4 | 0.10 | 24 | — | — | — | — | — | — |
| LYD194 | 60084.4 | 0.4 | 0.12 | 19 | 8.6 | L | 35 | 5.3 | L | 15 |
| LYD194 | 60085.2 | — | — | — | 6.6 | 0.29 | 5 | 4.8 | 0.21 | 6 |
| LYD190 | 60242.2 | 0.3 | 0.28 | 14 | — | — | — | — | — | — |

TABLE 43-continued

Genes showing improved plant performance at Normal growth conditions under regulation of 6669 promoter

| Gene Name | Event # | Harvest Index | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD186 | 60237.4 | — | — | — | 8.0 | 0.25 | 27 | 5.1 | 0.13 | 11 |
| LYD186 | 60238.4 | — | — | — | — | — | — | 5.0 | 0.30 | 9 |
| LYD184 | 60228.3 | — | — | — | 6.8 | 0.20 | 7 | — | — | — |
| LYD184 | 60229.1 | 0.4 | 0.08 | 21 | 7.2 | 0.04 | 14 | 4.8 | 0.04 | 5 |
| LYD184 | 60230.1 | 0.4 | 0.05 | 24 | — | — | — | — | — | — |
| LYD146 | 60025.3 | 0.4 | 0.13 | 21 | — | — | — | — | — | — |
| LYD14 | 60120.2 | 0.4 | 0.14 | 23 | — | — | — | — | — | — |
| LYD14 | 60122.3 | 0.4 | 0.27 | 16 | — | — | — | — | — | — |
| LYD134 | 60109.2 | 0.4 | 0.20 | 18 | — | — | — | — | — | — |
| LYD134 | 60110.1 | 0.4 | 0.23 | 30 | — | — | — | — | — | — |
| LYD134 | 60110.4 | 0.4 | 0.03 | 27 | — | — | — | — | — | — |
| LYD134 | 60110.5 | 0.4 | 0.09 | 31 | — | — | — | — | — | — |
| LYD13 | 60193.4 | 0.4 | 0.06 | 23 | 7.9 | 0.04 | 24 | 5.1 | 0.10 | 12 |
| LYD13 | 60195.2 | — | — | — | 6.9 | 0.03 | 9 | 4.8 | 0.11 | 4 |
| LYD13 | 60195.4 | — | — | — | 7.2 | 0.10 | 14 | 4.9 | 0.13 | 7 |
| LYD122 | 60199.2 | — | — | — | 7.3 | 0.29 | 16 | 5.1 | 0.02 | 11 |
| LYD122 | 60199.4 | — | — | — | 7.4 | L | 16 | 4.8 | 0.26 | 5 |
| LYD122 | 60200.2 | 0.4 | 0.14 | 17 | 8.0 | L | 26 | 5.2 | L | 13 |
| LYD122 | 60201.1 | 0.4 | L | 43 | — | — | — | — | — | — |
| LYD117 | 60033.5 | — | — | — | 7.6 | 0.13 | 20 | 5.0 | 0.02 | 8 |
| LYD117 | 60033.6 | — | — | — | 7.5 | 0.18 | 19 | 5.0 | 0.15 | 9 |
| LYD117 | 60034.4 | 0.4 | 0.02 | 39 | — | — | — | — | — | — |
| LYD11 | 60009.3 | — | — | — | — | — | — | 4.8 | 0.06 | 6 |
| LYD11 | 60010.2 | — | — | — | 8.1 | L | 27 | 5.2 | L | 14 |
| LYD101 | 60072.4 | — | — | — | 6.9 | 0.08 | 9 | — | — | — |
| LYD101 | 60075.3 | 0.4 | 0.20 | 15 | — | — | — | — | — | — |
| LYD10 | 60132.2 | — | — | — | 8.9 | 0.11 | 40 | 5.4 | 0.07 | 17 |
| LYD10 | 60134.4 | 0.3 | 0.29 | 12 | — | — | — | — | — | — |
| CONT. | — | 0.3 | — | — | 6.3 | — | — | 4.6 | — | — |
| LYD9 | 60595.1 | 0.4 | 0.09 | 7 | — | — | — | — | — | — |
| LYD9 | 60598.4 | 0.4 | 0.20 | 7 | — | — | — | — | — | — |
| LYD86 | 61671.3 | 0.4 | L | 12 | — | — | — | — | — | — |
| LYD81 | 60944.1 | — | — | — | 13.8 | 0.26 | 19 | 6.0 | L | 11 |
| LYD75 | 60657.1 | 0.3 | 0.27 | 3 | — | — | — | — | — | — |
| LYD45 | 60694.2 | 0.4 | L | 8 | — | — | — | — | — | — |
| LYD38 | 60531.4 | 0.4 | 0.12 | 8 | — | — | — | — | — | — |
| LYD35 | 60949.1 | 0.3 | 0.29 | 5 | — | — | — | — | — | — |
| LYD27 | 60542.1 | — | — | — | 13.3 | 0.25 | 15 | 5.7 | 0.16 | 7 |
| LYD257 | 60562.4 | — | — | — | 13.0 | 0.04 | 12 | 5.7 | 0.28 | 6 |
| LYD253 | 60841.4 | 0.4 | 0.02 | 7 | 13.1 | 0.03 | 13 | 5.9 | L | 9 |
| LYD244 | 61648.2 | 0.4 | 0.02 | 11 | — | — | — | — | — | — |
| LYD240 | 60968.2 | 0.3 | 0.16 | 3 | 13.1 | 0.18 | 13 | — | — | — |
| LYD235 | 60929.3 | 0.4 | L | 9 | 13.5 | L | 16 | 5.8 | L | 8 |
| LYD219 | 60673.1 | — | — | — | 12.8 | 0.12 | 10 | 5.6 | 0.29 | 4 |
| LYD201 | 60172.1 | — | — | — | 12.5 | 0.12 | 8 | 5.6 | 0.06 | 4 |
| LYD180 | 60464.4 | 0.4 | 0.12 | 17 | — | — | — | — | — | — |
| LYD180 | 60465.4 | 0.4 | 0.02 | 8 | — | — | — | — | — | — |
| LYD174 | 60816.4 | — | — | — | 13.2 | 0.10 | 14 | 5.7 | 0.12 | 6 |
| LYD153 | 60700.3 | — | — | — | 15.2 | 0.19 | 31 | 6.2 | 0.28 | 15 |
| LYD144 | 60866.4 | — | — | — | 13.7 | 0.22 | 18 | 5.9 | 0.04 | 9 |
| LYD144 | 60866.5 | — | — | — | 13.7 | 0.17 | 18 | 6.1 | 0.03 | 13 |
| LYD144 | 60868.4 | 0.4 | 0.08 | 11 | — | — | — | — | — | — |
| LYD14 | 60123.9 | 0.4 | 0.07 | 11 | — | — | — | — | — | — |
| LYD129 | 60792.1 | — | — | — | 14.6 | 0.28 | 26 | 6.1 | 0.29 | 14 |
| LYD129 | 60794.2 | — | — | — | — | — | — | 5.7 | 0.23 | 6 |
| LYD125 | 60823.3 | 0.3 | 0.27 | 5 | 15.2 | 0.16 | 31 | 6.2 | 0.10 | 14 |
| LYD12 | 60936.4 | 0.4 | 0.25 | 16 | 14.9 | 0.02 | 28 | 6.1 | L | 14 |
| LYD12 | 60938.2 | — | — | — | 13.5 | 0.02 | 17 | 5.8 | 0.22 | 7 |
| LYD104 | 60952.1 | — | — | — | 13.0 | 0.03 | 12 | 5.6 | 0.10 | 4 |
| LYD104 | 60956.1 | — | — | — | 14.9 | 0.13 | 29 | 5.9 | 0.01 | 9 |
| LYD103 | 60259.4 | — | — | — | 14.1 | 0.29 | 21 | 5.9 | 0.24 | 9 |
| LYD102 | 60959.1 | — | — | — | 12.5 | 0.17 | 8 | 5.6 | 0.25 | 3 |
| LYD102 | 60961.2 | 0.4 | L | 9 | 13.7 | 0.03 | 18 | 5.7 | 0.04 | 5 |
| CONT. | — | 0.3 | — | — | 11.6 | — | — | 5.4 | — | — |
| LYD82 | 61058.2 | — | — | — | 7.1 | L | 45 | 4.8 | L | 21 |
| LYD82 | 61058.3 | — | — | — | 7.0 | L | 41 | 4.8 | L | 22 |
| LYD82 | 61061.3 | — | — | — | 6.2 | 0.12 | 27 | 4.5 | 0.02 | 14 |
| LYD82 | 61061.4 | — | — | — | 5.9 | 0.01 | 20 | 4.2 | 0.13 | 6 |
| LYD81 | 60940.3 | — | — | — | 6.0 | 0.18 | 22 | 4.3 | 0.26 | 9 |
| LYD81 | 60943.4 | — | — | — | 6.6 | L | 35 | 4.6 | L | 16 |
| LYD81 | 60944.1 | — | — | — | 6.6 | L | 34 | 4.5 | 0.05 | 16 |

TABLE 43-continued

Genes showing improved plant performance at Normal growth conditions under regulation of 6669 promoter

| Gene Name | Event # | Harvest Index | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD81 | 60944.4 | — | — | — | 5.9 | L | 21 | 4.4 | L | 12 |
| LYD81 | 60944.8 | — | — | — | 7.1 | L | 44 | 4.7 | L | 19 |
| LYD80 | 61049.1 | — | — | — | 6.0 | 0.16 | 21 | 4.4 | 0.02 | 12 |
| LYD80 | 61050.1 | — | — | — | 5.5 | 0.06 | 12 | 4.3 | 0.07 | 9 |
| LYD70 | 60853.3 | — | — | — | 6.1 | L | 25 | 4.5 | L | 15 |
| LYD70 | 60853.4 | — | — | — | 5.5 | 0.06 | 12 | 4.2 | 0.09 | 6 |
| LYD70 | 60854.3 | 0.3 | 0.28 | 23 | 8.4 | L | 71 | 5.2 | L | 32 |
| LYD70 | 60856.4 | — | — | — | 5.6 | 0.04 | 14 | 4.2 | 0.04 | 8 |
| LYD7 | 60667.1 | — | — | — | 6.3 | L | 29 | 4.4 | L | 11 |
| LYD7 | 60668.1 | — | — | — | 7.6 | 0.19 | 54 | 4.9 | 0.04 | 24 |
| LYD7 | 60670.2 | — | — | — | 6.4 | 0.27 | 30 | 4.6 | 0.17 | 17 |
| LYD7 | 60671.2 | — | — | — | 5.6 | 0.03 | 15 | 4.2 | 0.05 | 7 |
| LYD7 | 60671.3 | — | — | — | 6.3 | 0.19 | 28 | 4.5 | 0.04 | 15 |
| LYD69 | 61028.1 | — | — | — | 6.4 | L | 31 | 4.4 | L | 13 |
| LYD69 | 61028.5 | — | — | — | 6.1 | L | 23 | 4.2 | 0.06 | 7 |
| LYD69 | 61029.4 | — | — | — | 5.7 | 0.04 | 16 | 4.3 | 0.09 | 9 |
| LYD67 | 60633.4 | — | — | — | 6.7 | 0.20 | 36 | 4.5 | 0.19 | 15 |
| LYD67 | 60635.3 | — | — | — | 5.6 | 0.13 | 14 | 4.4 | 0.03 | 11 |
| LYD59 | 61010.1 | — | — | — | 5.5 | 0.29 | 12 | 4.1 | 0.18 | 5 |
| LYD59 | 61011.2 | — | — | — | 6.6 | L | 35 | 4.5 | L | 14 |
| LYD58 | 61102.1 | — | — | — | — | — | — | 4.3 | 0.16 | 9 |
| LYD51 | 60266.5 | — | — | — | 6.2 | L | 26 | 4.4 | 0.01 | 13 |
| LYD51 | 60266.6 | — | — | — | 6.4 | 0.14 | 31 | 4.4 | 0.20 | 13 |
| LYD51 | 60269.1 | — | — | — | 6.2 | 0.04 | 27 | 4.5 | 0.06 | 14 |
| LYD51 | 60269.3 | — | — | — | 7.3 | L | 48 | 4.8 | L | 22 |
| LYD51 | 60269.6 | — | — | — | 6.2 | 0.25 | 25 | 4.5 | 0.30 | 14 |
| LYD5 | 61087.2 | — | — | — | 5.9 | 0.10 | 21 | 4.3 | 0.11 | 10 |
| LYD5 | 61087.3 | — | — | — | 6.0 | 0.04 | 22 | 4.4 | L | 12 |
| LYD5 | 61089.3 | — | — | — | 6.5 | L | 33 | 4.6 | L | 16 |
| LYD49 | 60710.2 | — | — | — | 6.0 | 0.26 | 21 | 4.4 | 0.16 | 11 |
| LYD49 | 60712.1 | — | — | — | — | — | — | 4.4 | 0.24 | 13 |
| LYD49 | 60714.1 | — | — | — | 7.1 | 0.02 | 43 | 4.8 | L | 22 |
| LYD48 | 61034.2 | — | — | — | 6.1 | L | 25 | 4.3 | 0.03 | 8 |
| LYD48 | 61035.3 | — | — | — | 6.5 | 0.01 | 31 | 4.5 | L | 14 |
| LYD48 | 61035.4 | — | — | — | 5.7 | 0.03 | 15 | 4.2 | 0.07 | 6 |
| LYD48 | 61036.3 | — | — | — | 6.2 | 0.27 | 26 | — | — | — |
| LYD36 | 60980.1 | — | — | — | 7.2 | 0.29 | 46 | 4.8 | 0.27 | 22 |
| LYD36 | 60980.2 | — | — | — | 7.7 | 0.18 | 56 | 4.7 | 0.15 | 19 |
| LYD36 | 60982.1 | — | — | — | 7.1 | L | 45 | 4.6 | L | 17 |
| LYD34 | 60270.4 | — | — | — | 6.8 | 0.06 | 39 | 4.7 | 0.08 | 18 |
| LYD34 | 60270.6 | — | — | — | 7.5 | 0.04 | 53 | 4.9 | 0.02 | 24 |
| LYD34 | 60271.2 | — | — | — | 6.2 | 0.08 | 26 | 4.5 | 0.11 | 14 |
| LYD34 | 60271.3 | — | — | — | 6.3 | L | 28 | 4.6 | L | 16 |
| LYD34 | 60272.5 | — | — | — | 7.3 | L | 49 | 4.8 | 0.03 | 23 |
| LYD276 | 61016.1 | — | — | — | 7.3 | L | 48 | 4.9 | L | 25 |
| LYD276 | 61016.3 | — | — | — | 5.6 | 0.03 | 14 | 4.2 | 0.08 | 7 |
| LYD276 | 61016.4 | — | — | — | 6.9 | L | 41 | 4.6 | L | 17 |
| LYD276 | 61017.1 | 0.3 | 0.14 | 15 | — | — | — | — | — | — |
| LYD276 | 61020.4 | — | — | — | 5.5 | 0.08 | 11 | 4.2 | 0.17 | 7 |
| LYD253 | 60840.2 | — | — | — | 5.6 | 0.13 | 13 | 4.3 | 0.23 | 10 |
| LYD253 | 60841.3 | — | — | — | 8.5 | L | 73 | 5.3 | L | 34 |
| LYD253 | 60841.4 | — | — | — | — | — | — | 4.6 | 0.27 | 16 |
| LYD253 | 60842.1 | — | — | — | 7.9 | 0.04 | 61 | 5.1 | 0.01 | 29 |
| LYD253 | 60842.3 | — | — | — | 7.8 | 0.26 | 59 | 5.0 | 0.17 | 28 |
| LYD235 | 60929.3 | — | — | — | 7.7 | 0.27 | 57 | 5.0 | 0.12 | 27 |
| LYD235 | 60930.2 | — | — | — | — | — | — | 4.1 | 0.16 | 5 |
| LYD235 | 60930.3 | — | — | — | 5.4 | 0.12 | 10 | — | — | — |
| LYD235 | 60930.6 | — | — | — | 6.4 | 0.14 | 31 | 4.5 | 0.21 | 14 |
| LYD235 | 60931.2 | — | — | — | 6.9 | 0.15 | 40 | 4.6 | 0.12 | 16 |
| LYD204 | 60704.2 | — | — | — | 6.5 | 0.02 | 32 | 4.5 | L | 16 |
| LYD204 | 60704.4 | — | — | — | 6.6 | L | 33 | 4.5 | L | 14 |
| LYD204 | 60707.1 | 0.3 | 0.17 | 11 | — | — | — | — | — | — |
| LYD204 | 60707.2 | — | — | — | 5.9 | L | 21 | 4.4 | L | 12 |
| LYD202 | 60421.2 | — | — | — | 7.5 | L | 52 | 4.8 | L | 22 |
| LYD202 | 60421.3 | — | — | — | 6.2 | L | 26 | 4.5 | L | 13 |
| LYD202 | 60422.2 | — | — | — | 5.5 | 0.25 | 12 | 4.2 | 0.17 | 7 |
| LYD202 | 60422.4 | — | — | — | 5.6 | 0.04 | 14 | 4.2 | 0.08 | 6 |
| LYD202 | 60425.2 | — | — | — | 6.1 | 0.26 | 24 | 4.5 | 0.22 | 13 |
| LYD197 | 60988.2 | — | — | — | 5.8 | L | 19 | 4.3 | 0.02 | 9 |
| LYD197 | 60988.4 | — | — | — | 5.5 | 0.18 | 12 | 4.2 | 0.13 | 7 |
| LYD197 | 60989.4 | — | — | — | — | — | — | 4.8 | 0.21 | 21 |

TABLE 43-continued

Genes showing improved plant performance at Normal growth conditions under regulation of 6669 promoter

| Gene Name | Event # | Harvest Index Ave. | P-Val. | % Incr. | Rosette Area [cm2] Ave. | P-Val. | % Incr. | Rosette Diameter [cm] Ave. | P-Val. | % Incr. |
|---|---|---|---|---|---|---|---|---|---|---|
| LYD197 | 60990.3 | — | — | — | 6.4 | 0.02 | 29 | 4.4 | L | 13 |
| LYD195 | 60252.1 | — | — | — | 5.7 | 0.08 | 15 | 4.3 | 0.19 | 8 |
| LYD195 | 60253.2 | — | — | — | 6.3 | L | 27 | 4.4 | L | 13 |
| LYD195 | 60255.2 | — | — | — | 6.6 | 0.09 | 33 | 4.6 | 0.01 | 17 |
| LYD195 | 60256.1 | — | — | — | 6.2 | 0.10 | 26 | 4.4 | L | 11 |
| LYD195 | 60257.2 | — | — | — | 6.3 | L | 28 | 4.5 | L | 14 |
| LYD180 | 60462.2 | — | — | — | 5.6 | 0.23 | 15 | 4.2 | 0.24 | 6 |
| LYD180 | 60464.4 | — | — | — | 6.0 | L | 22 | 4.4 | L | 12 |
| LYD180 | 60465.2 | — | — | — | 5.6 | 0.29 | 15 | 4.2 | 0.27 | 7 |
| LYD180 | 60465.4 | — | — | — | 5.4 | 0.08 | 11 | 4.1 | 0.17 | 5 |
| LYD176 | 61040.2 | — | — | — | 7.9 | L | 61 | 5.0 | L | 27 |
| LYD176 | 61041.1 | — | — | — | 7.4 | L | 51 | 4.9 | L | 25 |
| LYD176 | 61043.1 | — | — | — | 8.7 | 0.13 | 76 | 5.1 | 0.07 | 30 |
| LYD172 | 61064.2 | — | — | — | 6.6 | 0.21 | 34 | 4.6 | 0.18 | 16 |
| LYD172 | 61065.3 | — | — | — | 8.1 | 0.16 | 64 | 5.0 | 0.11 | 27 |
| LYD172 | 61066.3 | — | — | — | 7.5 | 0.18 | 52 | 4.9 | 0.19 | 24 |
| LYD172 | 61066.4 | — | — | — | 7.6 | 0.03 | 54 | 5.0 | L | 26 |
| LYD172 | 61067.3 | — | — | — | 5.8 | 0.02 | 17 | 4.3 | 0.02 | 9 |
| LYD166 | 60998.3 | — | — | — | 7.7 | 0.09 | 56 | 5.0 | L | 28 |
| LYD166 | 60998.4 | — | — | — | 8.0 | L | 63 | 5.1 | L | 30 |
| LYD166 | 60999.1 | — | — | — | 7.6 | L | 55 | 4.9 | 0.02 | 26 |
| LYD166 | 61000.2 | — | — | — | 7.4 | 0.12 | 51 | 5.1 | 0.05 | 28 |
| LYD166 | 61000.4 | — | — | — | 7.2 | 0.29 | 47 | 4.7 | 0.23 | 19 |
| LYD16 | 60314.1 | — | — | — | 6.8 | 0.29 | 38 | 4.7 | 0.12 | 20 |
| LYD16 | 60314.4 | — | — | — | 6.9 | 0.16 | 40 | 4.8 | 0.12 | 22 |
| LYD16 | 60315.1 | — | — | — | 6.4 | 0.30 | 31 | — | — | — |
| LYD16 | 60315.3 | — | — | — | 6.3 | 0.22 | 29 | 4.6 | 0.29 | 16 |
| LYD159 | 60662.6 | — | — | — | 7.9 | 0.07 | 60 | 5.2 | 0.09 | 33 |
| LYD159 | 60665.5 | — | — | — | 5.7 | 0.02 | 15 | 4.3 | 0.01 | 10 |
| LYD159 | 60666.2 | — | — | — | — | — | — | 4.1 | 0.29 | 4 |
| LYD129 | 60792.1 | — | — | — | 7.7 | 0.11 | 57 | 5.1 | 0.14 | 28 |
| LYD129 | 60793.2 | — | — | — | 7.4 | L | 50 | 4.8 | L | 22 |
| LYD129 | 60794.1 | — | — | — | 7.2 | L | 46 | 4.9 | L | 25 |
| LYD129 | 60794.2 | — | — | — | 7.1 | L | 44 | 4.6 | L | 17 |
| LYD129 | 60796.1 | — | — | — | 7.4 | 0.26 | 50 | 4.8 | 0.26 | 21 |
| LYD127 | 60681.1 | — | — | — | 6.7 | 0.29 | 36 | 4.6 | 0.25 | 16 |
| LYD127 | 60682.2 | — | — | — | 6.9 | 0.17 | 41 | 4.7 | L | 20 |
| LYD127 | 60682.3 | — | — | — | 6.9 | 0.04 | 41 | 4.7 | 0.05 | 20 |
| LYD127 | 60683.1 | — | — | — | 6.8 | 0.10 | 38 | 4.6 | 0.06 | 18 |
| LYD123 | 60786.3 | — | — | — | 8.5 | L | 73 | 5.1 | L | 30 |
| LYD123 | 60788.1 | — | — | — | 9.3 | 0.10 | 90 | 5.4 | L | 38 |
| LYD123 | 60788.4 | — | — | — | 8.0 | L | 63 | 5.1 | L | 30 |
| LYD123 | 60789.1 | — | — | — | 7.6 | L | 54 | 4.8 | 0.02 | 23 |
| LYD123 | 60789.2 | — | — | — | 8.4 | L | 72 | 5.1 | L | 29 |
| LYD12 | 60936.2 | — | — | — | 6.1 | L | 24 | 4.4 | L | 13 |
| LYD12 | 60936.4 | — | — | — | 7.0 | L | 43 | 4.6 | L | 17 |
| LYD12 | 60937.1 | 0.3 | 0.23 | 18 | 7.6 | L | 55 | 4.9 | L | 25 |
| LYD119 | 61004.2 | — | — | — | 5.8 | 0.04 | 19 | 4.3 | 0.05 | 9 |
| LYD119 | 61005.4 | — | — | — | 5.3 | 0.27 | 7 | 4.1 | 0.19 | 5 |
| LYD119 | 61008.3 | — | — | — | 5.8 | 0.20 | 19 | 4.2 | 0.25 | 8 |
| LYD105 | 60652.2 | — | — | — | 6.3 | 0.05 | 29 | 4.6 | L | 16 |
| LYD105 | 60652.4 | — | — | — | 8.1 | 0.15 | 65 | 5.1 | 0.05 | 29 |
| LYD105 | 60653.2 | — | — | — | 7.2 | L | 46 | 4.8 | L | 23 |
| LYD104 | 60952.1 | — | — | — | 6.4 | L | 30 | 4.4 | L | 13 |
| LYD104 | 60953.2 | — | — | — | 7.4 | 0.08 | 50 | 4.8 | 0.02 | 23 |
| LYD104 | 60955.1 | — | — | — | 5.9 | 0.16 | 21 | 4.2 | 0.21 | 6 |
| LYD104 | 60956.1 | — | — | — | 6.9 | L | 40 | 4.6 | L | 17 |
| LYD104 | 60957.2 | — | — | — | 6.2 | 0.01 | 26 | 4.4 | L | 12 |
| LYD102 | 60958.3 | — | — | — | 6.3 | 0.26 | 28 | 4.4 | 0.18 | 13 |
| LYD102 | 60960.1 | — | — | — | 6.7 | 0.19 | 35 | 4.5 | 0.16 | 15 |
| LYD102 | 60961.3 | — | — | — | 7.5 | L | 52 | 4.8 | L | 21 |
| CONT. | — | 0.3 | — | — | 4.9 | — | — | 3.9 | — | — |
| LYD142* | 60972.2 | 0.36 | 0.04 | 9 | — | — | — | — | — | — |

TABLE 43-continued

Genes showing improved plant performance at Normal growth conditions under regulation of 6669 promoter

| Gene Name | Event # | Harvest Index Ave. | P-Val. | % Incr. | Rosette Area [cm2] Ave. | P-Val. | % Incr. | Rosette Diameter [cm] Ave. | P-Val. | % Incr. |
|---|---|---|---|---|---|---|---|---|---|---|
| LYD142* | 60973.3 | 0.34 | 0.26 | 3 | — | — | — | — | — | — |
| LYD142* | 60971.2 | 0.31 | 0.13 | 12 | — | — | — | — | — | — |

Table 43.
"CONT."—Control;
"Ave."—Average;
"% Incr." = % increment;
"p-val."—p-value, L-p < 0.01.
*was regulated by 35S promoter (SEQ ID NO: 8094).

TABLE 44

Genes showing improved plant performance at Normal growth conditions under regulation of 6669 promoter

| Gene Name | Event # | Seed Yield [mg] Ave. | P-Val. | % Incr. | 1000 Seed Weight [mg] Ave. | P-Val | % Incr. |
|---|---|---|---|---|---|---|---|
| LYD87 | 60150.2 | 356.5 | 0.30 | 25 | 22.1 | 0.18 | 3 |
| LYD85 | 60016.3 | 395.8 | L | 38 | 24.6 | L | 15 |
| LYD76 | 60289.3 | — | — | — | 23.2 | L | 8 |
| LYD6 | 60094.3 | 372.4 | 0.12 | 30 | — | — | — |
| LYD55 | 60175.1 | — | — | — | 23.2 | 0.29 | 8 |
| LYD55 | 60175.4 | 324.8 | 0.16 | 14 | — | — | — |
| LYD55 | 60177.2 | — | — | — | 22.4 | 0.17 | 4 |
| LYD53 | 60204.3 | — | — | — | 22.9 | 0.13 | 6 |
| LYD4 | 60096.6 | — | — | — | 24.7 | 0.22 | 15 |
| LYD4 | 60098.1 | — | — | — | 27.3 | 0.28 | 27 |
| LYD33 | 60160.4 | 358.9 | 0.07 | 26 | — | — | — |
| LYD275 | 60000.2 | 321.9 | 0.25 | 13 | 22.4 | 0.11 | 4 |
| LYD275 | 60000.3 | — | — | — | 23.0 | 0.17 | 7 |
| LYD246 | 60212.3 | — | — | — | 22.4 | 0.05 | 4 |
| LYD246 | 60212.4 | — | — | — | 23.4 | 0.23 | 9 |
| LYD234 | 60181.3 | — | — | — | 22.6 | 0.02 | 5 |
| LYD234 | 60181.8 | — | — | — | 22.2 | 0.25 | 3 |
| LYD224 | 60040.8 | — | — | — | 21.9 | 0.30 | 2 |
| LYD22 | 60043.1 | 333.4 | 0.10 | 17 | — | — | — |
| LYD217 | 60050.2 | 432.5 | L | 51 | — | — | — |
| LYD217 | 60051.2 | 377.4 | 0.12 | 32 | 22.7 | 0.12 | 6 |
| LYD2 | 60102.2 | 353.6 | 0.09 | 24 | — | — | — |
| LYD190 | 60241.2 | — | — | — | 23.7 | 0.15 | 10 |
| LYD190 | 60242.2 | — | — | — | 23.3 | L | 8 |
| LYD186 | 60238.1 | 315.3 | 0.27 | 10 | 22.5 | 0.02 | 5 |
| LYD146 | 60026.2 | — | — | — | 22.8 | 0.25 | 6 |
| LYD14 | 60120.2 | 333.7 | 0.10 | 17 | — | — | — |
| LYD122 | 60201.1 | 433.8 | 0.22 | 52 | 23.0 | 0.23 | 7 |
| LYD117 | 60034.3 | — | — | — | 22.9 | 0.12 | 6 |
| LYD117 | 60034.4 | — | — | — | 22.0 | 0.22 | 2 |
| LYD11 | 60009.3 | — | — | — | 22.1 | 0.18 | 3 |
| LYD11 | 60010.2 | — | — | — | 23.3 | 0.07 | 8 |
| LYD11 | 60010.3 | — | — | — | 22.6 | 0.23 | 5 |
| LYD10 | 60132.2 | — | — | — | 22.7 | 0.01 | 5 |
| LYD10 | 60132.3 | — | — | — | 23.1 | L | 7 |
| LYD10 | 60134.4 | — | — | — | 23.5 | 0.07 | 9 |
| CONT. | — | 285.8 | — | — | 21.5 | — | — |
| LYD94 | 61678.3 | — | — | — | 2234.9 | L | 21 |
| LYD90 | 60828.1 | — | — | — | 1977.0 | 0.26 | 7 |
| LYD9 | 60597.1 | — | — | — | 2181.2 | 0.07 | 18 |
| LYD86 | 61671.3 | 314.7 | 0.23 | 15 | 2549.8 | 0.07 | 38 |
| LYD75 | 60655.8 | 300.7 | 0.19 | 10 | — | — | — |
| LYD75 | 60657.1 | — | — | — | 2004.3 | 0.21 | 9 |
| LYD74 | 60621.3 | — | — | — | 2040.3 | 0.05 | 11 |
| LYD74 | 60621.4 | — | — | — | 2308.1 | 0.28 | 25 |
| LYD49 | 60712.1 | — | — | — | 2023.9 | 0.19 | 10 |
| LYD49 | 60713.2 | — | — | — | 2036.7 | 0.05 | 10 |
| LYD45 | 60694.8 | — | — | — | 2189.2 | L | 19 |
| LYD45 | 60695.4 | — | — | — | 2006.5 | 0.28 | 9 |
| LYD43 | 60610.1 | — | — | — | 2054.3 | 0.04 | 11 |
| LYD43 | 60611.4 | 301.5 | 0.09 | 10 | 1986.2 | 0.14 | 8 |
| LYD38 | 60531.4 | — | — | — | 2195.4 | L | 19 |
| LYD38 | 60534.2 | — | — | — | 2455.2 | 0.19 | 33 |
| LYD38 | 60535.4 | — | — | — | 2216.7 | 0.09 | 20 |
| LYD35 | 60947.5 | — | — | — | 2056.9 | 0.04 | 11 |
| LYD35 | 60949.1 | 337.2 | 0.28 | 23 | — | — | — |
| LYD279 | 60556.1 | — | — | — | 2202.7 | 0.28 | 19 |
| LYD279 | 60556.3 | 314.9 | L | 15 | — | — | — |
| LYD27 | 60542.1 | — | — | — | 2198.8 | 0.19 | 19 |
| LYD257 | 60562.4 | 306.1 | L | 11 | 2194.6 | 0.17 | 19 |
| LYD253 | 60840.2 | — | — | — | 1960.6 | 0.21 | 6 |
| LYD253 | 60841.4 | 327.6 | L | 19 | — | — | — |
| LYD253 | 60842.1 | — | — | — | 2031.2 | 0.07 | 10 |
| LYD245 | 60646.1 | — | — | — | 1989.6 | 0.14 | 8 |
| LYD244 | 61647.3 | 318.8 | 0.08 | 16 | — | — | — |
| LYD244 | 61648.2 | 295.9 | 0.01 | 8 | — | — | — |
| LYD240 | 60968.2 | — | — | — | 2234.8 | L | 21 |
| LYD219 | 60673.1 | 315.5 | L | 15 | — | — | — |
| LYD219 | 60674.4 | — | — | — | 2185.2 | 0.26 | 18 |
| LYD212 | 60522.3 | — | — | — | 2040.1 | 0.10 | 11 |
| LYD209 | 60294.4 | — | — | — | 2037.3 | 0.06 | 10 |
| LYD209 | 60295.4 | — | — | — | 2026.5 | 0.19 | 10 |
| LYD201 | 60172.1 | 307.9 | L | 12 | — | — | — |
| LYD200 | 60481.2 | — | — | — | 2119.7 | 0.19 | 15 |
| LYD200 | 60485.3 | 294.4 | 0.01 | 7 | 2056.7 | 0.11 | 11 |
| LYD180 | 60464.4 | 368.9 | 0.20 | 34 | — | — | — |
| LYD180 | 60465.2 | — | — | — | 2650.5 | 0.28 | 44 |
| LYD174 | 60817.3 | — | — | — | 2253.4 | L | 22 |
| LYD144 | 60866.4 | — | — | — | 2073.9 | 0.03 | 12 |
| LYD144 | 60868.4 | 314.5 | 0.09 | 15 | — | — | — |
| LYD14 | 60122.2 | — | — | — | 2501.4 | 0.05 | 36 |
| LYD14 | 60123.1 | — | — | — | 2510.4 | L | 36 |
| LYD14 | 60123.9 | 334.6 | 0.15 | 22 | 2501.4 | L | 36 |
| LYD129 | 60794.2 | 290.4 | 0.04 | 6 | — | — | — |
| LYD125 | 60823.3 | — | — | — | 1999.5 | 0.13 | 8 |
| LYD12 | 60934.1 | — | — | — | 2325.2 | 0.27 | 26 |
| LYD12 | 60936.4 | 368.3 | 0.10 | 34 | — | — | — |
| LYD12 | 60937.1 | — | — | — | 2479.5 | 0.22 | 34 |
| LYD12 | 60938.2 | — | — | — | 2399.6 | L | 30 |
| LYD104 | 60952.1 | 291.0 | 0.04 | 6 | — | — | — |
| LYD104 | 60956.1 | — | — | — | 2371.4 | L | 28 |
| LYD104 | 60957.2 | — | — | — | 2041.5 | 0.05 | 11 |
| LYD103 | 60259.4 | 316.0 | L | 15 | 2089.9 | 0.14 | 13 |
| LYD103 | 60261.7 | 326.4 | 0.27 | 19 | — | — | — |
| LYD102 | 60958.3 | — | — | — | 2297.1 | 0.30 | 24 |
| LYD102 | 60961.2 | — | — | — | 2087.7 | 0.18 | 13 |
| CONT. | — | 274.6 | — | — | 1845.6 | — | — |
| LYD82 | 61061.3 | — | — | — | 21.1 | 0.25 | 5 |

TABLE 44-continued

Genes showing improved plant performance at Normal growth conditions under regulation of 6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val | % Incr. |
| LYD70 | 60854.3 | 251.4 | 0.24 | 23 | — | — | — |
| LYD7 | 60668.1 | 240.3 | 0.23 | 17 | — | — | — |
| LYD67 | 60633.4 | — | — | — | 29.1 | L | 45 |
| LYD67 | 60633.7 | — | — | — | 22.5 | L | 12 |
| LYD49 | 60712.1 | 275.3 | 0.16 | 35 | — | — | — |
| LYD49 | 60714.1 | — | — | — | 21.2 | 0.29 | 6 |
| LYD276 | 61016.1 | 239.4 | 0.16 | 17 | — | — | — |
| LYD253 | 60841.3 | 268.3 | L | 31 | — | — | — |
| LYD253 | 60842.1 | 285.2 | 0.14 | 39 | — | — | — |
| LYD253 | 60842.3 | 282.2 | 0.21 | 38 | — | — | — |
| LYD235 | 60931.2 | 231.6 | 0.17 | 13 | — | — | — |
| LYD204 | 60707.1 | 298.7 | 0.01 | 46 | — | — | — |
| LYD202 | 60421.2 | 242.0 | 0.06 | 18 | 24.1 | L | 20 |
| LYD202 | 60421.3 | 261.9 | 0.21 | 28 | — | — | — |
| LYD176 | 61040.2 | 315.4 | 0.12 | 54 | — | — | — |
| LYD176 | 61041.4 | 238.9 | 0.25 | 17 | — | — | — |
| LYD176 | 61043.1 | 242.0 | 0.05 | 18 | — | — | — |
| LYD172 | 61064.2 | 226.7 | 0.21 | 11 | — | — | — |
| LYD166 | 61000.2 | 240.5 | 0.06 | 18 | — | — | — |
| LYD16 | 60313.2 | 254.7 | 0.22 | 24 | — | — | — |
| LYD16 | 60314.4 | 303.1 | 0.22 | 48 | 21.5 | 0.21 | 7 |
| LYD159 | 60662.6 | 295.5 | 0.24 | 44 | 25.1 | 0.10 | 25 |
| LYD159 | 60665.5 | — | — | — | 22.0 | 0.16 | 9 |
| LYD129 | 60792.1 | 305.2 | L | 49 | — | — | — |
| LYD123 | 60786.3 | 249.0 | 0.16 | 22 | — | — | — |
| LYD123 | 60788.1 | 335.4 | 0.23 | 64 | — | — | — |
| LYD12 | 60937.1 | 314.4 | L | 54 | — | — | — |
| LYD119 | 61008.3 | — | — | — | 22.1 | 0.03 | 10 |
| LYD105 | 60652.4 | — | — | — | 23.4 | 0.14 | 17 |
| LYD105 | 60653.2 | — | — | — | 24.6 | L | 23 |
| LYD104 | 60956.1 | — | — | — | 22.7 | L | 13 |
| LYD102 | 60958.3 | 227.1 | 0.20 | 11 | — | — | — |
| CONT. | — | 204.7 | — | — | 20.1 | — | — |
| LYD142* | 60972.2 | 0.30 | 0.24 | 10 | 2.21 | 0.21 | 13 |
| LYD142* | 60973.3 | 0.29 | 0.09 | 4 | 2.06 | 0.23 | 5 |
| LYD142* | 60971.2 | 0.23 | 0.16 | 12 | — | — | — |
| LYD142* | 60973.3 | 0.24 | 0.27 | 15 | — | — | — |

Table 44.
"CONT."—Control;
"Ave."—Average;
"% Incr." = % increment;
"p-val."—p-value, L-p < 0.01.
*was regulated by 35S promoter.

Example 16

Evaluation of Transgenic *Arabidopsis* NUE, Yield and Plant Growth Rate Under Low or Normal Nitrogen Fertilization in Greenhouse Assay Assay 2: Nitrogen Use efficiency measured until bolting stage: plant biomass and plant growth rate at limited and optimal nitrogen concentration under greenhouse conditions—This assay follows the plant biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the 35S promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega to Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area.

Vegetative growth rate: the relative growth rate (RGR) of leaf number (Formula XI, described above), rosette area (Formula XVI described above) and plot coverage (Formula XVII, described above) are calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

The genes listed in Tables 45-48 improved plant NUE when grown at normal nitrogen concentration levels. These genes produced larger plants with a larger photosynthetic area, biomass (fresh weight, dry weight, rosette diameter, rosette area and plot coverage) when grown under normal nitrogen conditions. The genes were cloned under the regulation of a constitutive (At6669; SEQ ID NO:8096) and root preferred promoter (RootP). The evaluation of each gene was performed by testing the performance of different number of events. Event with p-value <0.1 was considered statistically significant

TABLE 45

Genes showing improved plant performance at Normal growth conditions under regulation of 6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD84 | 61134.3 | 316.9 | L | 19 | 3462.5 | L | 26 | 12.1 | 0.04 | 16 |
| LYD84 | 61134.4 | — | — | — | 2906.2 | 0.13 | 6 | — | — | — |
| LYD72 | 61164.1 | 326.2 | 0.01 | 22 | 3037.5 | 0.08 | 11 | — | — | — |
| LYD72 | 61164.3 | — | — | — | — | — | — | 10.8 | 0.29 | 3 |
| LYD62 | 60810.2 | — | — | — | — | — | — | 11.5 | 0.28 | 10 |
| LYD62 | 60813.3 | — | — | — | — | — | — | 11.4 | 0.04 | 9 |
| LYD41 | 60757.2 | — | — | — | 3018.8 | 0.24 | 10 | — | — | — |
| LYD41 | 60759.3 | — | — | — | 2925.0 | 0.26 | 7 | — | — | — |
| LYD40 | 61210.1 | — | — | — | 2950.0 | 0.07 | 8 | — | — | — |
| LYD40 | 61211.2 | — | — | — | — | — | — | 10.9 | 0.01 | 4 |
| LYD40 | 61213.2 | 310.6 | 0.26 | 16 | 2887.5 | 0.26 | 5 | — | — | — |
| LYD40 | 61214.4 | — | — | — | 2925.0 | 0.07 | 7 | — | — | — |
| LYD37 | 60164.2 | — | — | — | 3131.2 | 0.12 | 14 | 10.8 | 0.29 | 3 |
| LYD35 | 60946.1 | — | — | — | — | — | — | 10.7 | 0.21 | 2 |
| LYD35 | 60950.2 | 388.8 | 0.02 | 45 | 3693.8 | 0.10 | 35 | — | — | — |
| LYD288 | 60763.3 | — | — | — | 2931.2 | 0.07 | 7 | — | — | — |
| LYD288 | 60766.4 | — | — | — | 3118.8 | 0.26 | 14 | 10.8 | 0.05 | 3 |
| LYD278 | 61026.3 | — | — | — | — | — | — | 10.9 | 0.01 | 4 |
| LYD276 | 61016.1 | 340.0 | L | 27 | 2912.5 | 0.20 | 6 | — | — | — |
| LYD26 | 61169.3 | — | — | — | 2887.5 | 0.14 | 5 | — | — | — |
| LYD256 | 60741.1 | — | — | — | 2981.2 | 0.18 | 9 | — | — | — |
| LYD256 | 60743.3 | 365.6 | 0.15 | 37 | — | — | — | — | — | — |
| LYD252 | 61052.4 | 363.8 | 0.29 | 36 | 3687.5 | 0.17 | 35 | 10.9 | 0.18 | 4 |
| LYD252 | 61052.5 | — | — | — | 3418.8 | L | 25 | — | — | — |
| LYD252 | 61054.1 | — | — | — | 3243.8 | 0.08 | 18 | — | — | — |
| LYD252 | 61055.3 | — | — | — | 2975.0 | 0.10 | 9 | — | — | — |
| LYD250 | 61224.3 | — | — | — | 3062.5 | 0.29 | 12 | — | — | — |
| LYD250 | 61225.4 | — | — | — | 3112.5 | L | 14 | — | — | — |
| LYD236 | 60187.6 | — | — | — | 3262.5 | 0.04 | 19 | — | — | — |
| LYD236 | 60188.4 | — | — | — | 2881.2 | 0.15 | 5 | 10.7 | 0.21 | 2 |
| LYD233 | 60733.1 | 322.5 | 0.07 | 21 | 3531.2 | L | 29 | 12.2 | 0.23 | 16 |
| LYD233 | 60733.2 | 338.1 | L | 27 | 3793.8 | L | 39 | — | — | — |
| LYD233 | 60735.3 | — | — | — | 3306.2 | 0.03 | 21 | — | — | — |
| LYD233 | 60735.4 | — | — | — | 3343.8 | 0.25 | 22 | — | — | — |
| LYD231 | 60715.3 | — | — | — | 2868.8 | 0.20 | 5 | — | — | — |
| LYD225 | 61083.1 | — | — | — | 3050.0 | 0.22 | 11 | — | — | — |
| LYD223 | 61194.2 | — | — | — | 3081.2 | 0.18 | 13 | 10.9 | 0.01 | 4 |
| LYD223 | 61194.4 | — | — | — | — | — | — | 12.4 | 0.09 | 18 |
| LYD223 | 61195.3 | — | — | — | 2918.8 | 0.11 | 7 | — | — | — |
| LYD18 | 61216.4 | — | — | — | 3268.8 | 0.21 | 19 | — | — | — |
| LYD18 | 61217.4 | 285.6 | 0.21 | 7 | — | — | — | — | — | — |
| LYD157 | 61156.1 | — | — | — | 2893.8 | 0.16 | 6 | — | — | — |
| LYD157 | 61158.1 | 318.8 | L | 19 | — | — | — | — | — | — |
| LYD157 | 61159.3 | — | — | — | 3137.5 | L | 15 | — | — | — |
| LYD133 | 61235.4 | — | — | — | — | — | — | 10.7 | 0.21 | 2 |
| LYD113 | 60782.4 | — | — | — | 2937.5 | 0.09 | 7 | — | — | — |
| LYD112 | 61144.1 | — | — | — | 2912.5 | 0.16 | 6 | — | — | — |
| LYD112 | 61147.1 | 310.6 | 0.22 | 16 | — | — | — | 10.9 | 0.10 | 4 |
| LYD109 | 61174.2 | — | — | — | 2981.2 | 0.08 | 9 | — | — | — |
| LYD109 | 61178.3 | 398.1 | 0.11 | 49 | 3456.2 | 0.01 | 26 | 10.8 | 0.29 | 3 |
| CONT. | — | 267.2 | — | — | 2737.5 | — | — | 10.5 | — | — |
| LYD96 | 60285.1 | — | — | — | — | — | — | 10.9 | 0.25 | 6 |
| LYD90 | 60828.1 | 192.5 | 0.29 | 10 | 2000.0 | 0.04 | 22 | — | — | — |
| LYD90 | 60831.5 | 237.5 | 0.26 | 36 | 2318.8 | 0.23 | 42 | 11.2 | 0.27 | 8 |
| LYD81 | 60940.3 | — | — | — | — | — | — | 11.2 | 0.27 | 8 |
| LYD81 | 60944.1 | — | — | — | — | — | — | 11.0 | 0.16 | 7 |
| LYD81 | 60944.8 | — | — | — | 2212.5 | 0.23 | 35 | 11.6 | 0.14 | 13 |
| LYD71 | 60638.1 | — | — | — | — | — | — | 11.4 | 0.08 | 10 |
| LYD71 | 60641.2 | 194.4 | 0.24 | 11 | — | — | — | — | — | — |
| LYD71 | 60641.3 | — | — | — | — | — | — | 10.8 | 0.01 | 5 |
| LYD70 | 60853.4 | 217.5 | 0.02 | 24 | 2068.8 | 0.02 | 27 | — | — | — |

TABLE 45-continued

Genes showing improved plant performance at Normal growth conditions under regulation of 6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD70 | 60854.3 | — | — | — | — | — | — | 10.8 | 0.08 | 4 |
| LYD7 | 60667.1 | — | — | — | — | — | — | 10.6 | 0.15 | 2 |
| LYD7 | 60668.1 | — | — | — | — | — | — | 11.2 | 0.17 | 8 |
| LYD7 | 60671.2 | — | — | — | 1825.0 | 0.24 | 12 | 11.2 | 0.29 | 9 |
| LYD65 | 60626.2 | 201.2 | 0.13 | 15 | 1862.5 | 0.17 | 14 | — | — | — |
| LYD65 | 60629.2 | — | — | — | — | — | — | 10.6 | 0.17 | 3 |
| LYD62 | 60813.3 | — | — | — | — | — | — | 10.5 | 0.24 | 2 |
| LYD49 | 60710.2 | — | — | — | — | — | — | 11.4 | 0.21 | 11 |
| LYD49 | 60714.1 | 211.9 | 0.04 | 21 | 1856.2 | 0.18 | 14 | 10.6 | 0.07 | 3 |
| LYD35 | 60946.1 | 233.8 | L | 33 | 2218.8 | 0.15 | 36 | 11.1 | 0.21 | 7 |
| LYD35 | 60946.6 | 289.4 | 0.27 | 65 | — | — | — | 11.4 | 0.03 | 11 |
| LYD35 | 60947.5 | 212.5 | 0.04 | 21 | 1918.8 | 0.27 | 17 | 11.7 | 0.17 | 13 |
| LYD35 | 60949.1 | 228.1 | 0.02 | 30 | 2306.2 | 0.06 | 41 | — | — | — |
| LYD35 | 60950.2 | 229.4 | 0.17 | 31 | 2293.8 | 0.17 | 40 | — | — | — |
| LYD287 | 60145.3 | — | — | — | — | — | — | 11.0 | 0.29 | 7 |
| LYD253 | 60841.3 | 212.5 | 0.05 | 21 | 2256.2 | L | 38 | 10.9 | 0.04 | 5 |
| LYD253 | 60841.4 | 223.8 | 0.21 | 28 | 2162.5 | 0.17 | 32 | — | — | — |
| LYD253 | 60842.1 | — | — | — | — | — | — | 11.1 | 0.21 | 7 |
| LYD240 | 60965.1 | 213.1 | 0.04 | 22 | 2118.8 | 0.02 | 30 | 10.8 | 0.08 | 4 |
| LYD240 | 60965.4 | — | — | — | — | — | — | 10.9 | 0.25 | 6 |
| LYD240 | 60968.2 | 199.4 | 0.26 | 14 | 1900.0 | 0.21 | 16 | 11.0 | 0.29 | 7 |
| LYD240 | 60968.4 | — | — | — | — | — | — | 10.7 | 0.05 | 4 |
| LYD232 | 61641.1 | 210.0 | 0.05 | 20 | 1900.0 | 0.12 | 16 | 11.9 | 0.17 | 15 |
| LYD228 | 60403.2 | — | — | — | — | — | — | 10.6 | 0.15 | 2 |
| LYD227 | 60547.3 | — | — | — | — | — | — | 10.9 | L | 6 |
| LYD227 | 60548.3 | — | — | — | — | — | — | 11.2 | 0.17 | 8 |
| LYD219 | 60673.2 | 261.9 | 0.28 | 49 | 2356.2 | 0.15 | 44 | 10.7 | 0.23 | 4 |
| LYD219 | 60673.4 | 238.8 | 0.11 | 36 | 2462.5 | 0.08 | 51 | 11.6 | 0.21 | 13 |
| LYD219 | 60674.4 | 254.4 | L | 45 | 2575.0 | 0.16 | 58 | 11.4 | 0.12 | 11 |
| LYD214 | 60127.5 | — | — | — | — | — | — | 10.8 | 0.26 | 5 |
| LYD211 | 60307.1 | — | — | — | 1806.2 | 0.29 | 11 | — | — | — |
| LYD211 | 60309.6 | — | — | — | — | — | — | 11.6 | 0.19 | 12 |
| LYD204 | 60703.1 | — | — | — | — | — | — | 11.2 | L | 8 |
| LYD204 | 60704.1 | 245.6 | 0.17 | 40 | 2431.2 | 0.06 | 49 | 10.9 | L | 5 |
| LYD193 | 60504.2 | — | — | — | — | — | — | 11.1 | 0.01 | 8 |
| LYD193 | 60505.2 | — | — | — | — | — | — | 11.2 | L | 9 |
| LYD193 | 60506.1 | — | — | — | — | — | — | 11.0 | L | 7 |
| LYD193 | 60506.4 | — | — | — | — | — | — | 11.6 | 0.25 | 12 |
| LYD180 | 60462.2 | 200.0 | 0.16 | 14 | 1950.0 | 0.09 | 19 | 10.9 | 0.25 | 6 |
| LYD180 | 60464.4 | 280.6 | 0.05 | 60 | 2656.2 | L | 63 | 10.9 | 0.10 | 6 |
| LYD180 | 60465.2 | 230.0 | L | 31 | 2225.0 | L | 36 | 11.1 | 0.01 | 8 |
| LYD180 | 60465.4 | — | — | — | — | — | — | 10.9 | L | 5 |
| LYD178 | 61689.2 | 219.8 | 0.24 | 25 | 2083.9 | 0.26 | 28 | 10.7 | 0.05 | 4 |
| LYD178 | 61690.1 | — | — | — | — | — | — | 10.7 | 0.23 | 4 |
| LYD178 | 61691.4 | — | — | — | — | — | — | 11.1 | 0.07 | 7 |
| LYD174 | 60816.4 | — | — | — | — | — | — | 11.7 | L | 13 |
| LYD174 | 60821.1 | — | — | — | — | — | — | 11.2 | 0.27 | 8 |
| LYD16 | 60315.3 | 201.9 | 0.14 | 15 | 1906.2 | 0.19 | 17 | 10.8 | 0.29 | 4 |
| LYD159 | 60662.6 | — | — | — | — | — | — | 11.3 | L | 10 |
| LYD159 | 60665.5 | — | — | — | — | — | — | 11.1 | 0.21 | 7 |
| LYD148 | 60432.4 | 257.1 | 0.03 | 47 | 2521.4 | 0.01 | 54 | — | — | — |
| LYD144 | 60864.2 | 260.6 | L | 49 | 2643.8 | 0.02 | 62 | 11.2 | L | 8 |
| LYD144 | 60866.1 | — | — | — | 2343.8 | 0.29 | 43 | — | — | — |
| LYD140 | 60382.3 | — | — | — | — | — | — | 11.4 | 0.08 | 10 |
| LYD140 | 60383.2 | — | — | — | — | — | — | 11.2 | 0.05 | 8 |
| LYD140 | 60384.2 | 191.9 | 0.30 | 9 | 1831.2 | 0.25 | 12 | — | — | — |
| LYD136 | 60444.1 | 249.4 | 0.06 | 42 | 2487.5 | 0.14 | 52 | — | — | — |
| LYD136 | 60444.3 | 239.4 | 0.05 | 37 | 2375.0 | 0.11 | 45 | — | — | — |
| LYD127 | 60683.1 | 201.9 | 0.20 | 15 | 1937.5 | 0.12 | 19 | — | — | — |
| LYD127 | 60683.4 | 220.6 | 0.18 | 26 | — | — | — | 10.9 | 0.21 | 5 |
| LYD125 | 60822.3 | 216.9 | 0.08 | 24 | 2081.2 | 0.02 | 27 | 11.4 | L | 10 |
| LYD125 | 60823.3 | 246.9 | 0.09 | 41 | 2562.5 | 0.03 | 57 | 11.3 | 0.14 | 10 |
| LYD123 | 60786.3 | 218.1 | 0.03 | 24 | 2125.0 | 0.01 | 30 | 11.2 | L | 9 |
| LYD123 | 60788.1 | — | — | — | — | — | — | 11.6 | L | 13 |
| LYD123 | 60788.4 | — | — | — | — | — | — | 10.8 | 0.29 | 4 |
| LYD123 | 60789.1 | 233.1 | 0.21 | 33 | 2368.8 | 0.06 | 45 | 12.1 | 0.07 | 17 |
| LYD110 | 60391.2 | — | — | — | — | — | — | 10.6 | 0.17 | 3 |
| CONT. | — | 175.2 | — | — | 1633.7 | — | — | 10.3 | — | — |
| LYD82 | 61058.3 | 258.1 | 0.26 | 14 | 2275.0 | 0.08 | 10 | — | — | — |
| LYD80 | 61048.3 | 251.2 | 0.09 | 11 | — | — | — | — | — | — |
| LYD69 | 61028.1 | 242.5 | 0.12 | 7 | — | — | — | — | — | — |
| LYD69 | 61028.5 | 249.4 | 0.07 | 10 | — | — | — | 11.8 | 0.21 | 7 |

TABLE 45-continued

Genes showing improved plant performance at Normal growth conditions under regulation of 6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD67 | 60632.1 | — | — | — | 2306.2 | 0.25 | 12 | 11.5 | 0.07 | 4 |
| LYD67 | 60633.7 | 248.8 | 0.23 | 10 | 2343.8 | 0.03 | 14 | 11.7 | 0.25 | 6 |
| LYD67 | 60634.1 | 286.2 | 0.27 | 26 | — | — | — | — | — | — |
| LYD67 | 60635.3 | 253.1 | 0.02 | 12 | — | — | — | — | — | — |
| LYD59 | 61010.1 | — | — | — | — | — | — | 11.5 | 0.28 | 4 |
| LYD59 | 61011.1 | 251.9 | 0.07 | 11 | 2300.0 | 0.09 | 12 | 11.4 | 0.14 | 3 |
| LYD59 | 61011.2 | 265.6 | L | 17 | — | — | — | — | — | — |
| LYD59 | 61013.4 | 246.9 | 0.13 | 9 | — | — | — | — | — | — |
| LYD58 | 61100.2 | — | — | — | — | — | — | 11.4 | 0.02 | 4 |
| LYD58 | 61100.3 | 282.5 | 0.13 | 25 | 2400.0 | 0.01 | 16 | — | — | — |
| LYD58 | 61101.3 | 271.9 | 0.14 | 20 | 2362.5 | 0.23 | 15 | — | — | — |
| LYD51 | 60266.6 | 245.0 | 0.12 | 8 | — | — | — | — | — | — |
| LYD51 | 60269.3 | — | — | — | — | — | — | 11.9 | L | 8 |
| LYD51 | 60269.6 | — | — | — | — | — | — | 12.0 | 0.29 | 9 |
| LYD5 | 61086.3 | — | — | — | — | — | — | 11.5 | 0.28 | 4 |
| LYD5 | 61087.2 | — | — | — | 2475.0 | 0.21 | 20 | — | — | — |
| LYD48 | 61034.2 | — | — | — | 2650.0 | 0.29 | 29 | — | — | — |
| LYD48 | 61035.3 | 255.6 | L | 13 | 2368.8 | 0.02 | 15 | — | — | — |
| LYD48 | 61038.2 | 298.1 | 0.03 | 32 | 2593.8 | L | 26 | 11.4 | 0.22 | 4 |
| LYD42 | 60729.2 | 267.5 | 0.22 | 18 | — | — | — | 11.5 | L | 4 |
| LYD42 | 60729.3 | 266.2 | 0.21 | 18 | 2368.8 | 0.02 | 15 | — | — | — |
| LYD42 | 60730.2 | — | — | — | 2441.1 | 0.03 | 18 | — | — | — |
| LYD42 | 60731.4 | 263.1 | 0.22 | 16 | — | — | — | — | — | — |
| LYD41 | 60757.2 | 248.1 | 0.06 | 10 | 2481.2 | 0.15 | 20 | — | — | — |
| LYD41 | 60758.3 | — | — | — | — | — | — | 11.4 | 0.03 | 3 |
| LYD41 | 60760.3 | 278.1 | 0.11 | 23 | — | — | — | — | — | — |
| LYD40 | 61213.2 | 286.2 | 0.02 | 26 | — | — | — | — | — | — |
| LYD36 | 60980.1 | — | — | — | — | — | — | 11.9 | 0.17 | 8 |
| LYD36 | 60980.2 | 290.0 | L | 28 | 2643.8 | L | 28 | 11.5 | 0.28 | 4 |
| LYD34 | 60270.4 | — | — | — | — | — | — | 11.5 | 0.28 | 4 |
| LYD34 | 60270.6 | — | — | — | — | — | — | 12.1 | 0.15 | 9 |
| LYD288 | 60764.1 | — | — | — | 2318.8 | 0.14 | 12 | — | — | — |
| LYD288 | 60764.2 | 260.0 | L | 15 | 2356.2 | 0.03 | 14 | — | — | — |
| LYD288 | 60766.2 | — | — | — | 2318.8 | 0.06 | 12 | — | — | — |
| LYD288 | 60766.4 | — | — | — | — | — | — | 11.5 | 0.28 | 4 |
| LYD285 | 60721.2 | 270.6 | 0.14 | 19 | 2443.8 | L | 19 | 11.9 | L | 7 |
| LYD285 | 60722.4 | — | — | — | 2275.0 | 0.08 | 10 | 11.4 | 0.14 | 3 |
| LYD285 | 60723.2 | 328.3 | L | 45 | 2637.5 | L | 28 | — | — | — |
| LYD285 | 60724.1 | 268.1 | 0.02 | 18 | 2406.2 | 0.14 | 17 | 12.0 | L | 9 |
| LYD278 | 61022.4 | — | — | — | — | — | — | 11.6 | 0.14 | 5 |
| LYD278 | 61024.2 | — | — | — | — | — | — | 11.4 | 0.03 | 3 |
| LYD278 | 61026.4 | — | — | — | — | — | — | 11.3 | 0.09 | 2 |
| LYD276 | 61016.1 | 287.5 | 0.06 | 27 | 2800.0 | 0.24 | 36 | 11.9 | L | 7 |
| LYD256 | 60741.1 | 256.9 | 0.02 | 13 | 2412.5 | 0.01 | 17 | 11.4 | 0.02 | 4 |
| LYD256 | 60741.2 | 275.6 | 0.01 | 22 | 2512.5 | 0.12 | 22 | 11.7 | 0.25 | 6 |
| LYD256 | 60742.1 | — | — | — | — | — | — | 11.6 | L | 5 |
| LYD256 | 60743.3 | 331.9 | L | 47 | 2712.5 | L | 32 | 11.9 | 0.13 | 7 |
| LYD256 | 60743.4 | 276.9 | 0.07 | 22 | — | — | — | — | — | — |
| LYD250 | 61224.2 | 316.2 | 0.25 | 40 | 2612.5 | 0.06 | 27 | 11.9 | 0.05 | 8 |
| LYD250 | 61224.7 | — | — | — | 2568.8 | 0.26 | 25 | — | — | — |
| LYD250 | 61225.4 | — | — | — | — | — | — | 11.7 | 0.25 | 6 |
| LYD221 | 60348.3 | — | — | — | — | — | — | 11.2 | 0.15 | 2 |
| LYD221 | 60351.3 | — | — | — | — | — | — | 12.0 | 0.10 | 9 |
| LYD197 | 60986.3 | — | — | — | 2418.8 | 0.24 | 17 | — | — | — |
| LYD197 | 60988.2 | 319.4 | 0.27 | 41 | 2606.2 | 0.13 | 26 | — | — | — |
| LYD197 | 60989.4 | — | — | — | — | — | — | 11.7 | L | 6 |
| LYD195 | 60252.1 | — | — | — | 2262.5 | 0.09 | 10 | — | — | — |
| LYD195 | 60253.2 | — | — | — | 2376.8 | 0.22 | 15 | — | — | — |
| LYD195 | 60256.1 | 282.5 | 0.26 | 25 | 2493.8 | 0.09 | 21 | 11.4 | 0.02 | 4 |
| LYD195 | 60257.2 | — | — | — | 2387.5 | 0.14 | 16 | — | — | — |
| LYD18 | 61216.2 | — | — | — | 2212.5 | 0.21 | 7 | — | — | — |
| LYD18 | 61216.4 | 257.5 | 0.02 | 14 | 2312.5 | 0.06 | 12 | — | — | — |
| LYD18 | 61217.4 | 318.8 | 0.07 | 41 | 2768.8 | L | 34 | 12.3 | 0.11 | 11 |
| LYD18 | 61218.6 | 275.0 | 0.18 | 21 | 2468.8 | 0.16 | 20 | — | — | — |
| LYD176 | 61040.2 | — | — | — | — | — | — | 11.3 | 0.09 | 2 |
| LYD176 | 61041.1 | — | — | — | — | — | — | 11.8 | 0.29 | 6 |
| LYD176 | 61041.4 | 278.8 | 0.20 | 23 | — | — | — | 11.9 | 0.05 | 8 |
| LYD176 | 61044.4 | 263.8 | 0.29 | 16 | — | — | — | 12.1 | L | 10 |
| LYD172 | 61066.4 | — | — | — | — | — | — | 11.6 | 0.03 | 5 |
| LYD172 | 61067.3 | — | — | — | — | — | — | 11.4 | 0.02 | 4 |
| LYD166 | 60998.3 | 306.7 | L | 35 | 2785.4 | L | 35 | 11.2 | 0.15 | 2 |
| LYD166 | 60999.1 | 256.2 | 0.11 | 13 | 2443.8 | 0.02 | 19 | — | — | — |

TABLE 45-continued

Genes showing improved plant performance at Normal growth conditions under regulation of 6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD166 | 61000.2 | 286.9 | L | 27 | 2625.0 | L | 27 | 11.7 | 0.10 | 6 |
| LYD166 | 61000.4 | 295.6 | 0.02 | 31 | 2437.5 | 0.02 | 18 | 11.4 | 0.22 | 4 |
| LYD139 | 60318.1 | 301.9 | 0.15 | 33 | 2493.8 | L | 21 | 11.8 | 0.02 | 6 |
| LYD139 | 60319.8 | 315.0 | L | 39 | 2643.8 | L | 28 | 11.5 | 0.07 | 4 |
| LYD139 | 60320.5 | 246.9 | 0.06 | 9 | 2212.5 | 0.20 | 7 | — | — | — |
| LYD139 | 60320.8 | 323.1 | 0.25 | 43 | — | — | — | — | — | — |
| LYD139 | 60321.6 | — | — | — | 2406.2 | L | 17 | — | — | — |
| LYD133 | 61234.1 | — | — | — | — | — | — | 12.4 | 0.06 | 12 |
| LYD133 | 61237.3 | — | — | — | — | — | — | 11.6 | 0.21 | 5 |
| LYD119 | 61004.2 | — | — | — | — | — | — | 12.0 | L | 9 |
| LYD119 | 61005.4 | — | — | — | — | — | — | 11.6 | 0.14 | 5 |
| LYD113 | 60782.1 | 281.2 | L | 24 | 2568.8 | L | 25 | — | — | — |
| LYD113 | 60782.4 | — | — | — | — | — | — | 11.4 | 0.03 | 3 |
| LYD105 | 60649.2 | 276.9 | L | 22 | 2500.0 | L | 21 | 11.6 | 0.21 | 5 |
| LYD105 | 60652.2 | 261.2 | 0.19 | 15 | 2387.5 | 0.01 | 16 | — | — | — |
| LYD105 | 60652.4 | 273.1 | 0.13 | 21 | 2487.5 | L | 21 | — | — | — |
| LYD105 | 60653.2 | — | — | — | 2257.1 | 0.12 | 9 | — | — | — |
| CONT. | — | 226.5 | — | — | 2061.7 | — | — | 11.0 | — | — |
| LYD97 | 60081.2 | 146.2 | 0.05 | 12 | 1768.8 | 0.19 | 16 | 10.8 | 0.25 | 6 |
| LYD97 | 60082.1 | — | — | — | 1662.5 | 0.24 | 9 | — | — | — |
| LYD76 | 60288.4 | 142.5 | 0.18 | 9 | — | — | — | 10.7 | 0.09 | 5 |
| LYD53 | 60206.2 | 141.9 | 0.03 | 9 | — | — | — | — | — | — |
| LYD44 | 60248.2 | 156.2 | 0.27 | 20 | 1875.0 | 0.28 | 23 | — | — | — |
| LYD246 | 60214.2 | — | — | — | 1706.2 | 0.24 | 12 | — | — | — |
| LYD234 | 60182.3 | 141.2 | 0.21 | 8 | — | — | — | — | — | — |
| LYD224 | 60040.1 | 156.2 | 0.20 | 20 | — | — | — | — | — | — |
| LYD220 | 60224.1 | 163.1 | 0.29 | 25 | 2075.0 | 0.20 | 36 | — | — | — |
| LYD22 | 60043.1 | — | — | — | 1768.8 | 0.26 | 16 | — | — | — |
| LYD22 | 60043.4 | — | — | — | 1637.5 | 0.24 | 8 | — | — | — |
| LYD217 | 60051.2 | 142.5 | 0.05 | 9 | — | — | — | — | — | — |
| LYD214 | 60126.1 | — | — | — | — | — | — | 10.6 | 0.16 | 4 |
| LYD208 | 60064.1 | — | — | — | 1837.5 | 0.01 | 21 | — | — | — |
| LYD208 | 60064.6 | 139.4 | 0.09 | 7 | — | — | — | — | — | — |
| LYD208 | 60064.8 | 141.9 | 0.08 | 9 | 1712.5 | 0.07 | 12 | — | — | — |
| LYD186 | 60237.1 | 148.1 | 0.23 | 13 | 1768.8 | 0.06 | 16 | — | — | — |
| LYD184 | 60229.1 | 155.0 | 0.17 | 19 | 2150.0 | 0.02 | 41 | 10.9 | 0.19 | 7 |
| LYD173 | 60140.1 | 147.5 | 0.01 | 13 | — | — | — | — | — | — |
| LYD146 | 60024.2 | 140.0 | 0.09 | 7 | 1737.5 | 0.25 | 14 | — | — | — |
| LYD13 | 60193.1 | 153.8 | L | 18 | 1687.5 | 0.14 | 11 | — | — | — |
| LYD13 | 60193.3 | 136.9 | 0.17 | 5 | — | — | — | — | — | — |
| LYD13 | 60193.4 | — | — | — | — | — | — | 10.8 | 0.10 | 6 |
| LYD117 | 60033.6 | — | — | — | 2125.0 | 0.07 | 40 | 11.9 | L | 17 |
| LYD101 | 60075.3 | 145.0 | 0.06 | 11 | 1700.0 | 0.09 | 12 | — | — | — |
| CONT. | — | 130.6 | — | — | 1522.9 | — | — | 10.2 | — | — |
| LYM104 | 12913.2 | 265.6 | 0.25 | 2 | — | — | — | — | — | — |
| LYD99 | 60328.6 | — | — | — | 2787.5 | 0.03 | 7 | — | — | — |
| LYD95 | 61199.1 | 280.0 | L | 8 | — | — | — | — | — | — |
| LYD84 | 61133.5 | 283.8 | 0.24 | 9 | — | — | — | — | — | — |
| LYD84 | 61134.3 | 304.4 | L | 17 | 3012.5 | 0.04 | 15 | 10.8 | L | 9 |
| LYD72 | 61164.1 | — | — | — | 2700.9 | 0.18 | 4 | — | — | — |
| LYD72 | 61164.3 | 281.9 | L | 9 | — | — | — | — | — | — |
| LYD72 | 61165.4 | — | — | — | 2731.2 | 0.16 | 5 | 10.4 | 0.11 | 4 |
| LYD63 | 61229.8 | 272.5 | 0.15 | 5 | — | — | — | 10.6 | 0.26 | 6 |
| LYD63 | 61230.2 | — | — | — | — | — | — | 11.4 | 0.18 | 14 |
| LYD63 | 61231.1 | — | — | — | 2712.5 | 0.16 | 4 | 10.3 | 0.11 | 4 |
| LYD58 | 61306.2 | — | — | — | — | — | — | 10.6 | 0.10 | 6 |
| LYD58 | 61307.3 | — | — | — | — | — | — | 10.5 | 0.21 | 5 |
| LYD58 | 61310.4 | — | — | — | — | — | — | 10.8 | 0.04 | 9 |
| LYD37 | 60162.3 | 285.0 | 0.01 | 10 | — | — | — | 10.8 | 0.11 | 8 |
| LYD286 | 61701.4 | 287.5 | 0.17 | 11 | 2775.0 | 0.15 | 6 | — | — | — |
| LYD283 | 61317.4 | — | — | — | — | — | — | 10.6 | 0.03 | 7 |
| LYD283 | 61319.3 | — | — | — | — | — | — | 10.4 | 0.04 | 5 |
| LYD270 | 61370.4 | — | — | — | — | — | — | 10.3 | 0.11 | 4 |
| LYD270 | 61374.2 | — | — | — | 2862.5 | 0.18 | 10 | — | — | — |
| LYD268 | 61152.3 | — | — | — | — | — | — | 10.4 | 0.04 | 5 |
| LYD260 | 61368.1 | 272.5 | 0.15 | 5 | — | — | — | — | — | — |
| LYD26 | 61168.1 | — | — | — | — | — | — | 10.4 | 0.04 | 5 |
| LYD26 | 61170.1 | 292.5 | 0.22 | 13 | — | — | — | 10.2 | 0.27 | 2 |
| LYD26 | 61171.1 | 294.6 | L | 13 | 2879.5 | 0.18 | 10 | — | — | — |
| LYD259 | 61300.3 | — | — | — | 2718.8 | 0.20 | 4 | — | — | — |
| LYD259 | 61301.1 | 277.5 | 0.08 | 7 | — | — | — | 10.4 | 0.16 | 5 |
| LYD259 | 61301.2 | 321.2 | 0.08 | 24 | 3056.2 | 0.25 | 17 | — | — | — |

TABLE 45-continued

Genes showing improved plant performance at Normal growth conditions under regulation of 6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD259 | 61302.3 | 292.5 | L | 13 | 3012.5 | 0.16 | 15 | 10.6 | 0.29 | 7 |
| LYD252 | 61054.3 | 290.0 | L | 12 | 2918.8 | 0.08 | 12 | — | — | — |
| LYD252 | 61055.2 | — | — | — | — | — | — | 10.3 | 0.11 | 4 |
| LYD252 | 61055.3 | 310.6 | L | 20 | 3156.2 | 0.10 | 21 | 10.2 | 0.23 | 3 |
| LYD236 | 60188.3 | — | — | — | — | — | — | 10.2 | 0.23 | 3 |
| LYD236 | 60188.4 | — | — | — | — | — | — | 11.0 | 0.26 | 10 |
| LYD230 | 61332.1 | — | — | — | 2885.7 | 0.11 | 11 | — | — | — |
| LYD230 | 61332.3 | 276.9 | 0.06 | 7 | — | — | — | — | — | — |
| LYD230 | 61333.4 | — | — | — | — | — | — | 10.8 | 0.16 | 9 |
| LYD230 | 61334.5 | 282.9 | 0.07 | 9 | — | — | — | — | — | — |
| LYD230 | 61335.2 | — | — | — | — | — | — | 10.4 | 0.04 | 5 |
| LYD223 | 61193.3 | — | — | — | 3106.2 | L | 19 | — | — | — |
| LYD223 | 61194.2 | 281.2 | 0.19 | 8 | 2718.8 | 0.20 | 4 | — | — | — |
| LYD223 | 61194.4 | 286.7 | 0.19 | 10 | — | — | — | — | — | — |
| LYD223 | 61195.3 | — | — | — | 2950.0 | 0.01 | 13 | — | — | — |
| LYD223 | 61196.3 | 312.5 | 0.13 | 20 | 3156.2 | 0.16 | 21 | — | — | — |
| LYD222 | 61328.1 | — | — | — | 3037.5 | L | 16 | — | — | — |
| LYD222 | 61329.1 | 281.9 | 0.25 | 9 | — | — | — | — | — | — |
| LYD222 | 61329.2 | 272.5 | 0.04 | 5 | — | — | — | — | — | — |
| LYD222 | 61329.3 | 273.1 | 0.11 | 5 | 2887.5 | 0.12 | 11 | — | — | — |
| LYD21 | 61359.1 | — | — | — | — | — | — | 10.2 | 0.23 | 3 |
| LYD187 | 61314.1 | 276.9 | 0.06 | 7 | — | — | — | — | — | — |
| LYD187 | 61314.2 | — | — | — | — | — | — | 10.6 | 0.10 | 6 |
| LYD187 | 61314.4 | — | — | — | — | — | — | 10.2 | 0.27 | 2 |
| LYD152 | 61352.1 | 271.9 | 0.13 | 5 | — | — | — | 11.8 | 0.02 | 18 |
| LYD152 | 61352.4 | 297.5 | L | 15 | — | — | — | 10.4 | 0.16 | 5 |
| LYD152 | 61353.1 | — | — | — | — | — | — | 11.0 | 0.26 | 10 |
| LYD152 | 61355.3 | — | — | — | — | — | — | 10.5 | 0.21 | 5 |
| LYD150 | 61323.2 | — | — | — | — | — | — | 10.8 | 0.01 | 8 |
| LYD150 | 61324.1 | — | — | — | — | — | — | 10.9 | L | 9 |
| LYD150 | 61324.2 | — | — | — | — | — | — | 11.7 | 0.17 | 17 |
| LYD150 | 61325.4 | — | — | — | — | — | — | 11.0 | L | 10 |
| LYD126 | 61377.3 | — | — | — | — | — | — | 10.6 | 0.02 | 6 |
| LYD126 | 61378.2 | — | — | — | — | — | — | 10.9 | 0.29 | 9 |
| LYD126 | 61380.4 | 267.4 | 0.16 | 3 | — | — | — | — | — | — |
| LYD118 | 60747.2 | 273.1 | 0.18 | 5 | — | — | — | 10.8 | 0.11 | 8 |
| LYD118 | 60749.1 | — | — | — | — | — | — | 11.8 | L | 18 |
| LYD118 | 60749.3 | — | — | — | — | — | — | 10.7 | L | 7 |
| LYD115 | 61350.3 | — | — | — | — | — | — | 10.6 | 0.03 | 7 |
| LYD114 | 61383.6 | — | — | — | — | — | — | 10.5 | 0.03 | 5 |
| LYD114 | 61384.2 | 305.6 | 0.05 | 18 | 2950.0 | 0.05 | 13 | 10.9 | L | 10 |
| LYD114 | 61385.2 | 293.1 | L | 13 | — | — | — | — | — | — |
| LYD112 | 61144.1 | — | — | — | — | — | — | 10.2 | 0.23 | 3 |
| LYD109 | 61177.4 | — | — | — | — | — | — | 10.3 | 0.11 | 4 |
| LYD109 | 61178.3 | 268.1 | 0.14 | 3 | — | — | — | 10.9 | 0.29 | 9 |
| LYD108 | 61294.1 | — | — | — | — | — | — | 11.1 | 0.11 | 11 |
| LYD108 | 61295.1 | — | — | — | — | — | — | 10.4 | 0.30 | 4 |
| LYD106 | 61140.2 | — | — | — | — | — | — | 10.5 | 0.05 | 5 |
| LYD106 | 61141.3 | 330.0 | 0.29 | 27 | — | — | — | — | — | — |
| CONT. | — | 259.6 | — | — | 2608.3 | — | — | 10.0 | — | — |
| LYM275 | 13193.17 | 332.5 | L | 28 | 3062.5 | L | 17 | — | — | — |
| LYD273* | — | — | — | — | — | — | — | 8 | L | 14 |

Table 45.

"CONT."—Control;

"Ave."—Average;

"% Incr." = % increment;

"p-val."—p-value, L-p < 0.01.

*measured at day 9 from planting

TABLE 46

Genes showing improved plant performance at Normal growth conditions under regulation of 6669 promoter

| Gene Name | Event # | Plot Coverage [cm2] | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD84 | 61134.3 | 77.5 | L | 29 | 9.7 | L | 29 | 5.2 | L | 12 |
| LYD63 | 61230.2 | — | — | — | — | — | — | 5.0 | 0.14 | 7 |
| LYD62 | 60812.4 | — | — | — | — | — | — | 5.2 | 0.24 | 12 |
| LYD62 | 60813.3 | 65.1 | 0.19 | 9 | 8.1 | 0.19 | 9 | 4.9 | 0.26 | 6 |
| LYD37 | 60164.2 | 69.2 | 0.19 | 16 | 8.6 | 0.19 | 16 | 5.0 | 0.25 | 8 |
| LYD35 | 60947.5 | 75.2 | 0.17 | 26 | 9.4 | 0.17 | 26 | 5.2 | 0.11 | 12 |
| LYD35 | 60950.2 | 68.8 | L | 15 | 8.6 | L | 15 | 4.9 | L | 7 |
| LYD268 | 61153.3 | 65.6 | 0.10 | 10 | 8.2 | 0.10 | 10 | 4.8 | 0.05 | 3 |
| LYD26 | 61168.1 | — | — | — | — | — | — | 4.7 | 0.26 | 2 |
| LYD252 | 61055.2 | 63.1 | 0.12 | 5 | 7.9 | 0.12 | 5 | 4.8 | 0.06 | 3 |
| LYD233 | 60733.1 | 72.6 | 0.11 | 21 | 9.1 | 0.11 | 21 | 5.1 | 0.04 | 10 |
| LYD223 | 61194.4 | 78.0 | L | 30 | 9.8 | L | 30 | 5.3 | L | 14 |
| LYD223 | 61195.3 | 66.7 | 0.30 | 11 | 8.3 | 0.30 | 11 | — | — | — |
| LYD113 | 60785.3 | 64.9 | 0.16 | 8 | 8.1 | 0.16 | 8 | 4.8 | 0.20 | 4 |
| LYD109 | 61174.2 | — | — | — | — | — | — | 4.9 | 0.09 | 6 |
| LYD109 | 61178.3 | 66.2 | 0.05 | 11 | 8.3 | 0.05 | 11 | 4.9 | 0.17 | 6 |
| LYD106 | 61140.2 | 66.8 | L | 12 | 8.3 | L | 12 | 4.9 | 0.07 | 6 |
| CONT. | — | 59.9 | — | — | 7.5 | — | — | 4.6 | — | — |
| LYD96 | 60285.1 | 63.9 | 0.08 | 22 | 8.0 | 0.08 | 22 | 4.5 | 0.16 | 11 |
| LYD90 | 60828.1 | 66.9 | L | 28 | 8.4 | L | 28 | 4.7 | 0.02 | 14 |
| LYD90 | 60831.5 | 85.2 | 0.04 | 63 | 10.7 | 0.04 | 63 | 5.2 | 0.03 | 29 |
| LYD81 | 60940.3 | 91.6 | 0.26 | 75 | 11.4 | 0.26 | 75 | 5.3 | 0.22 | 31 |
| LYD81 | 60944.4 | — | — | — | — | — | — | 5.3 | 0.26 | 30 |
| LYD81 | 60944.8 | 82.4 | 0.24 | 57 | 10.3 | 0.24 | 57 | 5.0 | 0.14 | 24 |
| LYD71 | 60641.2 | 63.8 | 0.10 | 22 | 8.0 | 0.10 | 22 | 4.5 | 0.06 | 11 |
| LYD70 | 60853.4 | 79.8 | L | 52 | 10.0 | L | 52 | 5.1 | L | 26 |
| LYD7 | 60668.1 | 71.0 | L | 36 | 8.9 | L | 36 | 4.8 | 0.02 | 17 |
| LYD7 | 60671.2 | 83.5 | L | 59 | 10.4 | L | 59 | 5.1 | L | 25 |
| LYD65 | 60626.2 | 66.5 | 0.04 | 27 | 8.3 | 0.04 | 27 | 4.7 | 0.04 | 15 |
| LYD62 | 60813.3 | 64.6 | 0.02 | 23 | 8.1 | 0.02 | 23 | 4.6 | 0.06 | 13 |
| LYD49 | 60710.2 | 84.8 | 0.29 | 62 | 10.6 | 0.29 | 62 | 5.3 | 0.19 | 30 |
| LYD49 | 60712.1 | 74.2 | L | 42 | 9.3 | L | 42 | 5.0 | L | 22 |
| LYD49 | 60713.2 | 63.4 | 0.18 | 21 | 7.9 | 0.18 | 21 | 4.6 | 0.03 | 12 |
| LYD49 | 60714.1 | 68.5 | 0.04 | 31 | 8.6 | 0.04 | 31 | 4.7 | L | 16 |
| LYD35 | 60946.1 | 88.3 | L | 69 | 11.0 | L | 69 | 5.3 | L | 31 |
| LYD35 | 60946.6 | — | — | — | — | — | — | 5.9 | 0.24 | 46 |
| LYD35 | 60947.5 | 78.4 | L | 50 | 9.8 | L | 50 | 5.0 | L | 23 |
| LYD35 | 60949.1 | 81.7 | 0.05 | 56 | 10.2 | 0.05 | 56 | 5.1 | L | 24 |
| LYD35 | 60950.2 | 84.9 | 0.13 | 62 | 10.6 | 0.13 | 62 | 5.2 | 0.02 | 28 |
| LYD287 | 60145.3 | 60.8 | 0.08 | 16 | 7.6 | 0.08 | 16 | 4.3 | 0.20 | 6 |
| LYD253 | 60841.3 | 76.6 | L | 46 | 9.6 | L | 46 | 5.0 | L | 23 |
| LYD253 | 60841.4 | 76.1 | 0.26 | 45 | 9.5 | 0.26 | 45 | 4.8 | 0.19 | 19 |
| LYD240 | 60965.1 | 76.1 | L | 45 | 9.5 | L | 45 | 5.0 | L | 23 |
| LYD240 | 60965.4 | — | — | — | — | — | — | 5.4 | 0.24 | 32 |
| LYD240 | 60968.2 | 65.9 | 0.19 | 26 | 8.2 | 0.19 | 26 | 4.6 | 0.19 | 14 |
| LYD240 | 60968.4 | 64.2 | 0.04 | 23 | 8.0 | 0.04 | 23 | 4.5 | 0.03 | 11 |
| LYD232 | 61641.1 | 80.8 | 0.24 | 54 | 10.1 | 0.24 | 54 | 5.1 | 0.12 | 25 |
| LYD228 | 60402.3 | 58.0 | 0.21 | 11 | 7.3 | 0.21 | 11 | 4.3 | 0.19 | 6 |
| LYD228 | 60403.2 | 69.9 | 0.20 | 34 | 8.7 | 0.20 | 34 | 4.7 | 0.16 | 15 |
| LYD227 | 60547.3 | 64.3 | 0.21 | 23 | 8.0 | 0.21 | 23 | 4.5 | 0.21 | 11 |
| LYD227 | 60548.3 | — | — | — | — | — | — | 5.0 | 0.27 | 23 |
| LYD219 | 60673.1 | — | — | — | — | — | — | 4.3 | 0.21 | 6 |
| LYD219 | 60673.2 | 80.7 | L | 54 | 10.1 | L | 54 | 5.0 | 0.02 | 23 |
| LYD219 | 60673.4 | 86.0 | 0.18 | 64 | 10.7 | 0.18 | 64 | 5.2 | 0.08 | 28 |
| LYD219 | 60674.4 | 94.6 | 0.12 | 81 | 11.8 | 0.12 | 81 | 5.4 | 0.05 | 34 |
| LYD219 | 60675.1 | 61.6 | 0.09 | 18 | 7.7 | 0.09 | 18 | 4.4 | 0.17 | 9 |
| LYD214 | 60127.5 | — | — | — | 7.6 | 0.09 | 16 | 4.6 | 0.05 | 14 |
| LYD211 | 60307.1 | 66.4 | 0.02 | 27 | 8.3 | 0.02 | 27 | 4.6 | 0.02 | 14 |
| LYD211 | 60309.6 | 62.6 | 0.05 | 20 | 7.8 | 0.05 | 20 | 4.5 | 0.08 | 10 |
| LYD204 | 60703.1 | 71.9 | 0.15 | 37 | 9.0 | 0.15 | 37 | 4.8 | 0.10 | 18 |
| LYD204 | 60704.1 | 89.8 | 0.11 | 72 | 11.2 | 0.11 | 72 | 5.5 | 0.02 | 34 |
| LYD202 | 60423.4 | — | — | — | — | — | — | 4.3 | 0.28 | 6 |
| LYD193 | 60504.2 | — | — | — | — | — | — | 5.3 | 0.29 | 30 |
| LYD193 | 60506.1 | 59.9 | 0.15 | 14 | 7.5 | 0.15 | 14 | 4.4 | 0.19 | 8 |
| LYD193 | 60506.4 | 75.2 | 0.26 | 44 | 9.4 | 0.26 | 44 | 5.0 | 0.25 | 24 |
| LYD180 | 60462.2 | 72.2 | L | 38 | 9.0 | L | 38 | 4.8 | L | 17 |
| LYD180 | 60464.4 | 94.1 | L | 80 | 11.8 | L | 80 | 5.5 | L | 36 |
| LYD180 | 60465.2 | 80.2 | L | 53 | 10.0 | L | 53 | 5.1 | 0.01 | 26 |
| LYD178 | 61689.2 | 79.4 | L | 52 | 9.9 | L | 52 | 5.1 | 0.01 | 24 |
| LYD178 | 61690.1 | 70.6 | L | 35 | 8.8 | L | 35 | 4.7 | L | 16 |
| LYD178 | 61691.2 | 65.7 | 0.29 | 25 | 8.2 | 0.29 | 25 | — | — | — |

TABLE 46-continued

Genes showing improved plant performance at Normal growth conditions under regulation of 6669 promoter

| Gene Name | Event # | Plot Coverage [cm2] | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD178 | 61691.4 | 77.7 | 0.16 | 48 | 9.7 | 0.16 | 48 | 4.9 | 0.16 | 20 |
| LYD174 | 60816.4 | 91.8 | 0.29 | 75 | 11.5 | 0.29 | 75 | 5.4 | 0.24 | 32 |
| LYD174 | 60817.3 | 66.2 | 0.02 | 26 | 8.3 | 0.02 | 26 | 4.6 | 0.03 | 14 |
| LYD174 | 60817.4 | 71.1 | 0.08 | 36 | 8.9 | 0.08 | 36 | 4.8 | 0.07 | 18 |
| LYD16 | 60314.1 | 59.9 | 0.11 | 14 | 7.5 | 0.11 | 14 | 4.4 | 0.09 | 8 |
| LYD16 | 60315.3 | 69.0 | 0.06 | 32 | 8.6 | 0.06 | 32 | 4.9 | 0.07 | 19 |
| LYD159 | 60665.5 | — | — | — | — | — | — | 4.9 | 0.29 | 21 |
| LYD148 | 60432.4 | 72.9 | L | 39 | 9.1 | L | 39 | 4.8 | L | 19 |
| LYD144 | 60864.2 | 89.2 | L | 70 | 11.2 | L | 70 | 5.5 | L | 34 |
| LYD144 | 60866.1 | — | — | — | — | — | — | 5.3 | 0.29 | 30 |
| LYD144 | 60866.5 | — | — | — | — | — | — | 5.2 | 0.18 | 27 |
| LYD140 | 60383.2 | 78.0 | 0.20 | 49 | 9.8 | 0.20 | 49 | 4.9 | 0.25 | 21 |
| LYD140 | 60383.3 | 65.1 | 0.03 | 24 | 8.1 | 0.03 | 24 | 4.6 | 0.02 | 13 |
| LYD140 | 60384.2 | 67.6 | 0.01 | 29 | 8.4 | 0.01 | 29 | 4.7 | L | 15 |
| LYD136 | 60444.1 | 90.3 | 0.17 | 72 | 11.3 | 0.17 | 72 | 5.4 | 0.09 | 32 |
| LYD136 | 60444.3 | 84.9 | 0.16 | 62 | 10.6 | 0.16 | 62 | 5.4 | 0.12 | 34 |
| LYD127 | 60681.1 | 61.7 | 0.21 | 18 | 7.7 | 0.21 | 18 | 4.4 | 0.29 | 9 |
| LYD127 | 60683.1 | 65.7 | 0.26 | 25 | 8.2 | 0.26 | 25 | 4.7 | 0.10 | 16 |
| LYD125 | 60822.3 | 88.1 | 0.01 | 68 | 11.0 | 0.01 | 68 | 5.2 | 0.02 | 29 |
| LYD125 | 60823.3 | 91.7 | 0.13 | 75 | 11.5 | 0.13 | 75 | 5.5 | 0.07 | 35 |
| LYD125 | 60826.2 | 87.4 | 0.25 | 67 | 10.9 | 0.25 | 67 | 5.2 | 0.20 | 27 |
| LYD123 | 60786.3 | 96.5 | 0.06 | 84 | 12.1 | 0.06 | 84 | 5.5 | L | 36 |
| LYD123 | 60788.4 | 72.0 | 0.26 | 38 | 9.0 | 0.26 | 38 | 4.9 | 0.24 | 21 |
| LYD123 | 60789.1 | 95.6 | 0.05 | 83 | 11.9 | 0.05 | 83 | 5.5 | L | 35 |
| LYD123 | 60789.2 | 64.3 | 0.05 | 23 | 8.0 | 0.05 | 23 | 4.6 | 0.09 | 13 |
| CONT. | — | 52.4 | — | — | 6.5 | — | — | 4.1 | — | — |
| LYD82 | 61058.3 | 89.9 | 0.04 | 10 | 11.2 | 0.04 | 10 | 5.5 | 0.02 | 7 |
| LYD80 | 61050.1 | 103.7 | 0.19 | 27 | 13.0 | 0.19 | 27 | 5.8 | 0.18 | 12 |
| LYD69 | 61028.1 | 86.7 | 0.12 | 7 | 10.8 | 0.12 | 7 | — | — | — |
| LYD69 | 61029.1 | — | — | — | — | — | — | 5.6 | 0.29 | 7 |
| LYD69 | 61030.3 | 87.2 | 0.09 | 7 | 10.9 | 0.09 | 7 | 5.4 | 0.14 | 4 |
| LYD69 | 61030.5 | 101.4 | 0.25 | 25 | 12.7 | 0.25 | 25 | — | — | — |
| LYD67 | 60633.7 | 95.4 | L | 17 | 11.9 | L | 17 | 5.5 | L | 6 |
| LYD67 | 60635.3 | 94.8 | 0.28 | 16 | 11.8 | 0.28 | 16 | — | — | — |
| LYD59 | 61011.2 | 101.7 | L | 25 | 12.7 | L | 25 | 5.9 | 0.02 | 14 |
| LYD59 | 61013.4 | 105.7 | 0.08 | 30 | 13.2 | 0.08 | 30 | 5.9 | 0.17 | 12 |
| LYD58 | 61100.3 | 97.2 | L | 19 | 12.2 | L | 19 | 5.7 | L | 10 |
| LYD58 | 61101.3 | 98.4 | L | 21 | 12.3 | L | 21 | 5.6 | 0.19 | 8 |
| LYD58 | 61102.1 | 90.3 | 0.21 | 11 | 11.3 | 0.21 | 11 | 5.4 | 0.23 | 3 |
| LYD51 | 60266.5 | 95.9 | 0.22 | 18 | 12.0 | 0.22 | 18 | — | — | — |
| LYD51 | 60266.6 | 98.6 | 0.08 | 21 | 12.3 | 0.08 | 21 | 5.7 | 0.08 | 9 |
| LYD51 | 60269.1 | 115.2 | 0.12 | 42 | 14.4 | 0.12 | 42 | 6.3 | L | 21 |
| LYD51 | 60269.3 | 111.4 | 0.28 | 37 | 13.9 | 0.28 | 37 | — | — | — |
| LYD51 | 60269.6 | 96.3 | 0.24 | 18 | 12.0 | 0.24 | 18 | 5.6 | 0.26 | 7 |
| LYD5 | 61086.3 | 95.9 | 0.15 | 18 | 12.0 | 0.15 | 18 | — | — | — |
| LYD48 | 61036.3 | 93.6 | 0.05 | 15 | 11.7 | 0.05 | 15 | 5.7 | 0.05 | 9 |
| LYD48 | 61038.2 | 105.9 | 0.18 | 30 | 13.2 | 0.18 | 30 | 5.9 | 0.11 | 13 |
| LYD40 | 61213.2 | 105.6 | 0.02 | 30 | 13.2 | 0.02 | 30 | 6.0 | 0.02 | 15 |
| LYD36 | 60980.2 | 125.9 | 0.29 | 55 | 15.7 | 0.29 | 55 | — | — | — |
| LYD36 | 60980.3 | 106.0 | L | 30 | 13.2 | L | 30 | 5.9 | L | 13 |
| LYD36 | 60982.1 | 106.9 | 0.28 | 31 | 13.4 | 0.28 | 31 | 5.9 | 0.19 | 13 |
| LYD34 | 60270.4 | 100.4 | 0.23 | 23 | 12.6 | 0.23 | 23 | — | — | — |
| LYD34 | 60270.6 | 107.9 | L | 33 | 13.5 | L | 33 | 5.8 | 0.06 | 12 |
| LYD34 | 60271.2 | 88.9 | 0.02 | 9 | 11.1 | 0.02 | 9 | 5.3 | 0.20 | 2 |
| LYD34 | 60271.3 | 106.9 | 0.26 | 31 | 13.4 | 0.26 | 31 | 6.0 | 0.15 | 15 |
| LYD34 | 60272.5 | 100.5 | 0.21 | 24 | 12.6 | 0.21 | 24 | — | — | — |
| LYD288 | 60763.3 | 101.7 | 0.19 | 25 | 12.7 | 0.19 | 25 | 5.8 | 0.18 | 11 |
| LYD288 | 60764.2 | — | — | — | — | — | — | 5.4 | 0.20 | 3 |
| LYD285 | 60721.2 | 109.9 | L | 35 | 13.7 | L | 35 | 5.9 | L | 13 |
| LYD285 | 60722.4 | 107.1 | 0.06 | 32 | 13.4 | 0.06 | 32 | 6.1 | 0.09 | 18 |
| LYD278 | 61022.4 | 99.2 | 0.24 | 22 | 12.4 | 0.24 | 22 | 5.6 | 0.14 | 8 |
| LYD278 | 61024.2 | 95.8 | L | 18 | 12.0 | L | 18 | 5.5 | 0.02 | 6 |
| LYD276 | 61016.1 | 120.5 | 0.12 | 48 | 15.1 | 0.12 | 48 | 6.3 | 0.13 | 22 |
| LYD276 | 61016.3 | 92.8 | L | 14 | 11.6 | L | 14 | 5.5 | 0.05 | 5 |
| LYD276 | 61020.4 | — | — | — | — | — | — | 5.4 | 0.28 | 3 |
| LYD256 | 60741.1 | 108.0 | 0.13 | 33 | 13.5 | 0.13 | 33 | 6.0 | 0.11 | 14 |
| LYD256 | 60741.2 | 116.7 | 0.03 | 43 | 14.6 | 0.03 | 43 | 6.1 | 0.03 | 17 |
| LYD256 | 60743.3 | 120.5 | 0.22 | 48 | 15.1 | 0.22 | 48 | 6.3 | 0.24 | 20 |
| LYD256 | 60743.4 | 100.6 | 0.26 | 24 | 12.6 | 0.26 | 24 | 5.6 | 0.28 | 8 |
| LYD250 | 61222.3 | 91.7 | 0.24 | 13 | 11.5 | 0.24 | 13 | 5.4 | 0.19 | 4 |
| LYD250 | 61224.3 | 92.0 | 0.23 | 13 | 11.5 | 0.23 | 13 | — | — | — |

TABLE 46-continued

Genes showing improved plant performance at Normal growth conditions under regulation of 6669 promoter

| Gene Name | Event # | Plot Coverage [cm2] | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD250 | 61224.7 | 112.1 | 0.11 | 38 | 14.0 | 0.11 | 38 | 6.0 | 0.03 | 15 |
| LYD233 | 60733.1 | 89.7 | 0.02 | 10 | 11.2 | 0.02 | 10 | 5.4 | 0.18 | 4 |
| LYD233 | 60733.2 | — | — | — | — | — | — | 5.4 | 0.14 | 5 |
| LYD228 | 60403.4 | 88.1 | 0.27 | 8 | 11.0 | 0.27 | 8 | 5.6 | L | 8 |
| LYD221 | 60351.3 | 98.8 | L | 21 | 12.4 | L | 21 | 5.8 | 0.16 | 11 |
| LYD197 | 60986.3 | 98.1 | 0.24 | 21 | 12.3 | 0.24 | 21 | 5.6 | 0.29 | 8 |
| LYD197 | 60988.2 | 116.1 | 0.06 | 43 | 14.5 | 0.06 | 43 | 6.2 | 0.14 | 19 |
| LYD197 | 60989.4 | 87.5 | 0.18 | 8 | 10.9 | 0.18 | 8 | — | — | — |
| LYD197 | 60990.3 | 111.1 | 0.16 | 37 | 13.9 | 0.16 | 37 | 5.9 | 0.24 | 14 |
| LYD195 | 60252.1 | 90.8 | 0.21 | 12 | 11.3 | 0.21 | 12 | 5.6 | 0.02 | 8 |
| LYD195 | 60253.2 | 89.1 | 0.02 | 9 | 11.1 | 0.02 | 9 | 5.4 | 0.07 | 3 |
| LYD195 | 60256.1 | 106.9 | L | 31 | 13.4 | L | 31 | 5.9 | 0.02 | 13 |
| LYD195 | 60257.2 | 115.6 | 0.25 | 42 | 14.5 | 0.25 | 42 | 6.4 | 0.23 | 23 |
| LYD18 | 61216.2 | 113.8 | 0.25 | 40 | 14.2 | 0.25 | 40 | 6.1 | 0.26 | 16 |
| LYD18 | 61216.4 | 105.2 | 0.04 | 29 | 13.1 | 0.04 | 29 | 6.0 | 0.07 | 15 |
| LYD18 | 61217.4 | 125.0 | 0.07 | 54 | 15.6 | 0.07 | 54 | 6.3 | 0.11 | 21 |
| LYD18 | 61218.1 | 97.3 | 0.28 | 20 | 12.2 | 0.28 | 20 | 5.7 | 0.21 | 10 |
| LYD18 | 61218.6 | 107.7 | 0.17 | 32 | 13.5 | 0.17 | 32 | 6.0 | 0.21 | 14 |
| LYD176 | 61040.2 | 99.6 | L | 22 | 12.4 | L | 22 | 5.7 | 0.07 | 9 |
| LYD176 | 61041.4 | 117.7 | L | 45 | 14.7 | L | 45 | 6.2 | L | 19 |
| LYD176 | 61043.1 | 85.7 | 0.13 | 5 | 10.7 | 0.13 | 5 | — | — | — |
| LYD176 | 61044.4 | 103.3 | 0.22 | 27 | 12.9 | 0.22 | 27 | 5.9 | 0.14 | 14 |
| LYD172 | 61066.3 | 93.0 | L | 14 | 11.6 | L | 14 | 5.5 | 0.15 | 5 |
| LYD172 | 61066.4 | 113.5 | 0.26 | 40 | 14.2 | 0.26 | 40 | — | — | — |
| LYD172 | 61067.3 | 95.6 | 0.27 | 17 | 11.9 | 0.27 | 17 | 5.6 | 0.06 | 8 |
| LYD166 | 60999.1 | 106.1 | L | 30 | 13.3 | L | 30 | 5.8 | 0.05 | 12 |
| LYD166 | 61000.2 | 111.0 | 0.05 | 36 | 13.9 | 0.05 | 36 | 6.0 | L | 15 |
| LYD166 | 61000.4 | 105.9 | L | 30 | 13.2 | L | 30 | 5.9 | 0.06 | 14 |
| LYD139 | 60318.1 | 102.5 | 0.16 | 26 | 12.8 | 0.16 | 26 | 6.0 | 0.11 | 15 |
| LYD139 | 60319.8 | 120.3 | L | 48 | 15.0 | L | 48 | 6.2 | L | 19 |
| LYD139 | 60321.6 | 103.2 | L | 27 | 12.9 | L | 27 | 5.8 | L | 11 |
| LYD133 | 61234.1 | 93.1 | 0.01 | 14 | 11.6 | 0.01 | 14 | 5.5 | L | 6 |
| LYD133 | 61237.2 | 84.4 | 0.29 | 4 | 10.5 | 0.29 | 4 | — | — | — |
| LYD133 | 61237.3 | 92.9 | 0.18 | 14 | 11.6 | 0.18 | 14 | 5.5 | 0.29 | 6 |
| LYD119 | 61005.4 | 99.3 | L | 22 | 12.4 | L | 22 | 5.7 | L | 9 |
| LYD119 | 61006.1 | 89.1 | 0.15 | 10 | 11.1 | 0.15 | 10 | 5.5 | L | 6 |
| LYD118 | 60745.4 | 91.8 | 0.05 | 13 | 11.5 | 0.05 | 13 | 5.4 | 0.25 | 4 |
| LYD113 | 60782.1 | 106.6 | L | 31 | 13.3 | L | 31 | 5.7 | L | 9 |
| LYD113 | 60785.3 | 91.3 | 0.09 | 12 | 11.4 | 0.09 | 12 | 5.3 | 0.30 | 2 |
| LYD105 | 60649.2 | 99.4 | L | 22 | 12.4 | L | 22 | 5.9 | L | 14 |
| LYD105 | 60652.2 | 98.5 | 0.23 | 21 | 12.3 | 0.23 | 21 | — | — | — |
| LYD105 | 60652.4 | 118.6 | 0.25 | 46 | 14.8 | 0.25 | 46 | 6.2 | 0.14 | 20 |
| LYD105 | 60653.2 | 102.0 | L | 25 | 13.7 | 0.16 | 34 | 6.0 | 0.22 | 15 |
| LYD105 | 60653.4 | 88.3 | 0.02 | 9 | 11.0 | 0.02 | 9 | 5.5 | L | 5 |
| CONT. | — | 81.4 | — | — | 10.2 | — | — | 5.2 | — | — |
| LYD97 | 60081.2 | 80.4 | 0.08 | 17 | 10.0 | 0.08 | 17 | 5.4 | 0.16 | 11 |
| LYD85 | 60014.4 | 75.6 | 0.04 | 10 | 9.5 | 0.04 | 10 | 5.3 | L | 8 |
| LYD76 | 60289.3 | 80.9 | 0.25 | 18 | 10.1 | 0.25 | 18 | 5.4 | 0.16 | 11 |
| LYD76 | 60291.3 | 77.1 | 0.28 | 12 | 9.6 | 0.28 | 12 | 5.4 | 0.26 | 12 |
| LYD55 | 60175.2 | — | — | — | — | — | — | 5.2 | 0.05 | 6 |
| LYD53 | 60206.2 | — | — | — | — | — | — | 5.1 | 0.07 | 4 |
| LYD224 | 60040.1 | — | — | — | — | — | — | 5.4 | 0.25 | 11 |
| LYD220 | 60223.1 | 76.1 | 0.18 | 11 | 9.5 | 0.18 | 11 | 5.2 | 0.01 | 6 |
| LYD220 | 60224.1 | 95.5 | 0.17 | 39 | 11.9 | 0.17 | 39 | 5.9 | 0.20 | 21 |
| LYD22 | 60043.1 | 80.4 | L | 17 | 10.0 | L | 17 | 5.4 | L | 11 |
| LYD217 | 60048.4 | — | — | — | — | — | — | 5.0 | 0.25 | 2 |
| LYD214 | 60126.1 | 76.3 | 0.07 | 11 | 9.5 | 0.07 | 11 | 5.2 | L | 7 |
| LYD213 | 60058.3 | 82.3 | 0.17 | 20 | 10.3 | 0.17 | 20 | 5.6 | 0.10 | 15 |
| LYD208 | 60064.1 | 87.5 | 0.10 | 27 | 10.9 | 0.10 | 27 | 5.8 | 0.15 | 19 |
| LYD208 | 60064.6 | 84.2 | 0.24 | 22 | 10.5 | 0.24 | 22 | 5.5 | 0.25 | 12 |
| LYD208 | 60064.8 | 85.3 | 0.09 | 24 | 10.7 | 0.09 | 24 | 5.6 | 0.21 | 15 |
| LYD20 | 60069.3 | 74.6 | 0.07 | 8 | 9.3 | 0.07 | 8 | 5.4 | L | 10 |
| LYD20 | 60070.1 | — | — | — | — | — | — | 5.1 | 0.28 | 6 |
| LYD190 | 60242.2 | 78.9 | 0.23 | 15 | 9.9 | 0.23 | 15 | 5.3 | L | 8 |
| LYD186 | 60237.1 | 80.9 | 0.16 | 18 | 10.1 | 0.16 | 18 | 5.4 | 0.16 | 10 |
| LYD186 | 60237.4 | — | — | — | — | — | — | 5.0 | 0.26 | 2 |
| LYD184 | 60229.1 | 91.2 | 0.17 | 33 | 11.4 | 0.17 | 33 | 5.7 | 0.16 | 16 |
| LYD146 | 60024.2 | — | — | — | — | — | — | 5.3 | 0.25 | 9 |
| LYD146 | 60024.3 | — | — | — | — | — | — | 5.0 | 0.28 | 2 |
| LYD13 | 60193.1 | 75.3 | 0.15 | 10 | 9.4 | 0.15 | 10 | 5.3 | L | 10 |
| LYD13 | 60193.3 | — | — | — | — | — | — | 5.0 | 0.23 | 3 |

TABLE 46-continued

Genes showing improved plant performance at Normal growth conditions under regulation of 6669 promoter

| Gene Name | Event # | Plot Coverage [cm2] | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD122 | 60201.3 | — | — | — | — | — | — | 5.2 | 0.03 | 6 |
| LYD117 | 60033.5 | — | — | — | — | — | — | 5.2 | L | 7 |
| LYD117 | 60033.6 | 108.6 | 0.09 | 58 | 13.6 | 0.09 | 58 | 6.4 | 0.08 | 31 |
| LYD101 | 60075.3 | 87.3 | 0.09 | 27 | 10.9 | 0.09 | 27 | 5.7 | L | 17 |
| CONT. | — | 68.8 | — | — | 8.6 | — | — | 4.9 | — | — |
| LYD99 | 60328.6 | 57.8 | 0.19 | 14 | 7.2 | 0.19 | 14 | 4.7 | 0.16 | 7 |
| LYD84 | 61134.3 | 61.0 | 0.03 | 20 | 7.6 | 0.03 | 20 | 4.7 | 0.11 | 7 |
| LYD84 | 61134.4 | 59.2 | 0.06 | 17 | 7.4 | 0.06 | 17 | 4.7 | 0.07 | 9 |
| LYD63 | 61230.2 | 68.6 | 0.24 | 36 | 8.6 | 0.24 | 36 | — | — | — |
| LYD58 | 61306.2 | 62.4 | 0.07 | 23 | 7.8 | 0.07 | 23 | 4.8 | 0.08 | 11 |
| LYD58 | 61306.6 | 61.2 | 0.19 | 21 | 7.7 | 0.19 | 21 | 4.8 | 0.11 | 11 |
| LYD37 | 60162.3 | 59.1 | 0.07 | 17 | 7.4 | 0.07 | 17 | 4.7 | 0.08 | 8 |
| LYD283 | 61317.4 | 61.3 | 0.08 | 21 | 7.7 | 0.08 | 21 | 4.8 | 0.06 | 10 |
| LYD270 | 61374.2 | — | — | — | — | — | — | 4.6 | 0.21 | 5 |
| LYD259 | 61302.3 | — | — | — | — | — | — | 4.6 | 0.18 | 5 |
| LYD252 | 61055.3 | 56.6 | 0.15 | 12 | 7.1 | 0.15 | 12 | 4.6 | 0.11 | 7 |
| LYD230 | 61333.4 | 60.0 | 0.19 | 19 | 7.5 | 0.19 | 19 | — | — | — |
| LYD222 | 61327.3 | — | — | — | — | — | — | 4.6 | 0.25 | 5 |
| LYD152 | 61352.1 | 73.4 | L | 45 | 9.2 | L | 45 | 5.1 | L | 18 |
| LYD152 | 61352.4 | 57.0 | 0.13 | 13 | 7.1 | 0.13 | 13 | — | — | — |
| LYD152 | 61355.3 | 61.7 | 0.03 | 22 | 7.7 | 0.03 | 22 | 4.8 | 0.04 | 11 |
| LYD150 | 61324.1 | 63.8 | 0.05 | 26 | 8.0 | 0.05 | 26 | 4.8 | 0.24 | 10 |
| LYD150 | 61325.4 | 58.8 | 0.13 | 16 | 7.4 | 0.13 | 16 | 4.7 | 0.06 | 9 |
| LYD150 | 61326.1 | 63.9 | 0.01 | 26 | 8.0 | 0.01 | 26 | 4.8 | 0.08 | 9 |
| LYD126 | 61376.1 | 58.3 | 0.22 | 15 | 7.3 | 0.22 | 15 | — | — | — |
| LYD126 | 61380.4 | 64.8 | 0.25 | 28 | 8.1 | 0.25 | 28 | 4.9 | 0.03 | 14 |
| LYD118 | 60747.2 | 61.3 | 0.04 | 21 | 7.7 | 0.04 | 21 | 4.8 | 0.04 | 10 |
| LYD118 | 60749.1 | 68.1 | 0.28 | 35 | 8.5 | 0.28 | 35 | 4.9 | 0.24 | 13 |
| LYD118 | 60749.3 | 61.1 | 0.16 | 21 | 7.6 | 0.16 | 21 | 4.7 | 0.23 | 8 |
| LYD118 | 60749.4 | 59.0 | 0.08 | 17 | 7.4 | 0.08 | 17 | 4.6 | 0.17 | 6 |
| LYD114 | 61383.3 | 58.0 | 0.11 | 15 | 7.2 | 0.11 | 15 | 4.7 | 0.08 | 8 |
| LYD114 | 61383.6 | 59.7 | 0.07 | 18 | 7.5 | 0.07 | 18 | 4.6 | 0.16 | 7 |
| LYD114 | 61384.2 | 58.3 | 0.28 | 15 | 7.3 | 0.28 | 15 | — | — | — |
| LYD112 | 61144.1 | 57.0 | 0.18 | 13 | 7.1 | 0.18 | 13 | 4.7 | 0.10 | 7 |
| LYD112 | 61147.1 | 59.5 | 0.05 | 18 | 7.4 | 0.05 | 18 | 4.6 | 0.17 | 6 |
| LYD112 | 61147.2 | — | — | — | — | — | — | 4.6 | 0.22 | 5 |
| LYD109 | 61175.3 | 58.3 | 0.09 | 15 | 7.3 | 0.09 | 15 | 4.7 | 0.09 | 7 |
| LYD109 | 61177.4 | 55.6 | 0.22 | 10 | 7.0 | 0.22 | 10 | — | — | — |
| LYD109 | 61178.3 | 61.3 | 0.03 | 21 | 7.7 | 0.03 | 21 | 4.8 | 0.03 | 10 |
| LYD108 | 61296.1 | 59.9 | 0.05 | 18 | 7.5 | 0.05 | 18 | 4.6 | 0.25 | 6 |
| LYD108 | 61297.2 | 57.2 | 0.28 | 13 | 7.2 | 0.28 | 13 | 4.6 | 0.23 | 6 |
| CONT. | — | 50.6 | — | — | 6.3 | — | — | 4.3 | — | — |

Table 46.
"CONT."—Control;
"Ave."—Average;
"% Incr." = % increment;
"p-val."—p-value, L-p < 0.01.

TABLE 47

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD84 | 61134.3 | 0.9 | L | 35 | 10.0 | 0.01 | 31 | 0.5 | 0.06 | 15 |
| LYD72 | 61165.4 | 0.8 | 0.23 | 16 | — | — | — | — | — | — |
| LYD63 | 61229.8 | — | — | — | 9.6 | 0.04 | 26 | — | — | — |
| LYD62 | 60810.2 | 0.8 | 0.08 | 22 | 9.0 | 0.14 | 18 | 0.5 | 0.14 | 12 |
| LYD62 | 60812.4 | 0.9 | 0.05 | 25 | 9.7 | 0.03 | 27 | 0.5 | 0.09 | 14 |
| LYD62 | 60813.3 | 0.8 | 0.13 | 20 | — | — | — | — | — | — |
| LYD40 | 61211.2 | 0.9 | 0.07 | 23 | — | — | — | — | — | — |
| LYD40 | 61213.2 | 0.8 | 0.26 | 14 | — | — | — | — | — | — |
| LYD37 | 60164.2 | 0.8 | 0.24 | 15 | 8.8 | 0.20 | 15 | 0.4 | 0.29 | 9 |

TABLE 47-continued

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD35 | 60947.5 | — | — | — | 9.6 | 0.03 | 26 | 0.5 | 0.12 | 13 |
| LYD35 | 60950.2 | — | — | — | 8.7 | 0.23 | 14 | — | — | — |
| LYD288 | 60766.4 | 0.8 | 0.18 | 17 | — | — | — | — | — | — |
| LYD278 | 61022.3 | 0.8 | 0.18 | 18 | — | — | — | — | — | — |
| LYD256 | 60741.2 | 0.8 | 0.26 | 15 | — | — | — | — | — | — |
| LYD233 | 60733.1 | 1.0 | L | 40 | 9.4 | 0.05 | 24 | 0.5 | 0.03 | 18 |
| LYD233 | 60733.2 | 0.8 | 0.08 | 23 | 9.2 | 0.09 | 21 | 0.5 | 0.08 | 14 |
| LYD225 | 61083.1 | 0.8 | 0.18 | 17 | — | — | — | — | — | — |
| LYD223 | 61194.4 | 1.0 | L | 40 | 10.0 | 0.01 | 31 | 0.5 | 0.06 | 16 |
| LYD223 | 61195.3 | 0.8 | 0.11 | 20 | — | — | — | — | — | — |
| LYD18 | 61218.6 | 0.9 | 0.07 | 23 | — | — | — | — | — | — |
| LYD113 | 60781.4 | — | — | — | — | — | — | 0.4 | 0.21 | 10 |
| LYD113 | 60782.4 | 0.8 | 0.13 | 20 | 8.6 | 0.29 | 13 | 0.5 | 0.17 | 11 |
| LYD112 | 61147.1 | 0.8 | 0.20 | 17 | — | — | — | — | — | — |
| LYD112 | 61148.1 | 0.8 | 0.22 | 16 | — | — | — | — | — | — |
| LYD109 | 61174.2 | 0.8 | 0.17 | 18 | 8.7 | 0.25 | 14 | 0.4 | 0.24 | 10 |
| LYD109 | 61178.2 | 0.8 | 0.23 | 15 | — | — | — | — | — | — |
| LYD109 | 61178.3 | 0.8 | 0.14 | 19 | — | — | — | — | — | — |
| LYD106 | 61140.2 | 0.8 | 0.22 | 16 | 8.6 | 0.27 | 13 | 0.4 | 0.22 | 10 |
| CONT. | — | 0.7 | — | — | 7.6 | — | — | 0.4 | — | — |
| LYD287 | 60146.1 | — | — | — | — | — | — | 0.2 | 0.27 | 185 |
| LYD253 | 60842.1 | — | — | — | 5.5 | 0.19 | 255 | 0.2 | 0.28 | 183 |
| LYD232 | 61641.1 | — | — | — | 5.3 | 0.22 | 242 | — | — | — |
| LYD204 | 60704.1 | — | — | — | 5.3 | 0.25 | 240 | — | — | — |
| LYD144 | 60866.1 | — | — | — | 6.5 | 0.12 | 318 | 0.3 | 0.16 | 246 |
| LYD140 | 60384.3 | — | — | — | 4.8 | 0.26 | 210 | 0.2 | 0.29 | 178 |
| LYD136 | 60444.3 | — | — | — | 5.5 | 0.21 | 256 | 0.3 | 0.27 | 197 |
| LYD125 | 60825.1 | — | — | — | 7.0 | 0.07 | 352 | 0.3 | 0.09 | 287 |
| LYD125 | 60826.2 | — | — | — | 6.1 | 0.15 | 292 | 0.2 | 0.29 | 184 |
| LYD123 | 60786.3 | — | — | — | 5.5 | 0.24 | 253 | — | — | — |
| LYD123 | 60789.1 | — | — | — | 5.0 | 0.30 | 223 | — | — | — |
| CONT. | — | — | — | — | 1.6 | — | — | 0.1 | — | — |
| LYD82 | 61058.3 | — | — | — | 10.9 | 0.26 | 12 | 0.5 | 0.13 | 12 |
| LYD82 | 61061.3 | — | — | — | — | — | — | 0.5 | 0.06 | 15 |
| LYD82 | 61061.4 | 0.8 | 0.18 | 13 | — | — | — | — | — | — |
| LYD80 | 61048.2 | — | — | — | — | — | — | 0.5 | 0.29 | 8 |
| LYD80 | 61049.4 | 0.8 | 0.17 | 13 | — | — | — | — | — | — |
| LYD80 | 61050.1 | — | — | — | 12.6 | L | 29 | 0.5 | 0.04 | 16 |
| LYD69 | 61028.5 | 0.8 | 0.12 | 15 | 11.1 | 0.19 | 14 | — | — | — |
| LYD69 | 61029.1 | — | — | — | 11.8 | 0.05 | 21 | — | — | — |
| LYD69 | 61030.3 | 0.7 | 0.24 | 12 | — | — | — | — | — | — |
| LYD69 | 61030.5 | 0.7 | 0.21 | 12 | 12.4 | 0.01 | 27 | 0.5 | 0.08 | 14 |
| LYD67 | 60632.1 | — | — | — | 12.1 | 0.03 | 24 | 0.5 | 0.12 | 12 |
| LYD67 | 60633.4 | — | — | — | 12.8 | L | 31 | 0.5 | 0.24 | 9 |
| LYD67 | 60633.7 | — | — | — | 11.5 | 0.09 | 18 | 0.5 | 0.27 | 8 |
| LYD67 | 60634.1 | 0.7 | 0.25 | 11 | — | — | — | — | — | — |
| LYD67 | 60635.3 | — | — | — | 11.3 | 0.15 | 15 | — | — | — |
| LYD59 | 61010.1 | — | — | — | 10.9 | 0.28 | 12 | — | — | — |
| LYD59 | 61011.2 | 0.7 | 0.29 | 10 | 12.5 | L | 28 | 0.5 | 0.01 | 20 |
| LYD59 | 61013.4 | — | — | — | 12.8 | L | 32 | 0.5 | 0.05 | 15 |
| LYD58 | 61100.2 | — | — | — | 12.8 | 0.02 | 31 | 0.5 | 0.03 | 20 |
| LYD58 | 61100.3 | — | — | — | 11.8 | 0.05 | 20 | 0.5 | 0.06 | 14 |
| LYD58 | 61101.3 | — | — | — | 11.9 | 0.04 | 22 | — | — | — |
| LYD58 | 61102.1 | — | — | — | 10.8 | 0.29 | 11 | — | — | — |
| LYD51 | 60266.5 | — | — | — | 11.8 | 0.05 | 21 | — | — | — |
| LYD51 | 60266.6 | — | — | — | 12.0 | 0.03 | 23 | 0.5 | 0.19 | 10 |
| LYD51 | 60269.1 | — | — | — | 13.8 | L | 41 | 0.5 | L | 21 |
| LYD51 | 60269.3 | — | — | — | 13.3 | L | 36 | 0.5 | 0.24 | 9 |
| LYD51 | 60269.6 | 0.7 | 0.29 | 10 | 11.5 | 0.09 | 18 | — | — | — |
| LYD5 | 61086.3 | — | — | — | 11.4 | 0.11 | 17 | — | — | — |
| LYD48 | 61036.3 | — | — | — | 11.6 | 0.07 | 19 | 0.5 | 0.05 | 15 |
| LYD48 | 61038.2 | — | — | — | 13.1 | L | 34 | 0.5 | L | 21 |
| LYD42 | 60729.3 | 0.7 | 0.28 | 10 | 11.7 | 0.07 | 20 | 0.5 | 0.02 | 19 |
| LYD42 | 60731.4 | — | — | — | 12.6 | 0.01 | 29 | 0.5 | 0.03 | 18 |
| LYD41 | 60758.2 | 0.8 | 0.03 | 22 | — | — | — | — | — | — |
| LYD40 | 61210.1 | — | — | — | — | — | — | 0.5 | 0.18 | 10 |
| LYD40 | 61211.2 | 0.8 | 0.20 | 12 | — | — | — | — | — | — |
| LYD40 | 61213.2 | — | — | — | 12.6 | L | 29 | 0.5 | 0.04 | 16 |
| LYD40 | 61214.4 | 0.8 | 0.15 | 15 | — | — | — | — | — | — |
| LYD36 | 60980.1 | 0.7 | 0.21 | 12 | — | — | — | — | — | — |
| LYD36 | 60980.2 | — | — | — | 15.4 | L | 58 | 0.6 | L | 26 |

TABLE 47-continued

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD36 | 60980.3 | — | — | — | 12.9 | L | 32 | 0.5 | 0.02 | 18 |
| LYD36 | 60982.1 | — | — | — | 12.9 | L | 32 | 0.5 | 0.10 | 13 |
| LYD34 | 60270.4 | — | — | — | 11.9 | 0.04 | 22 | — | — | — |
| LYD34 | 60270.6 | — | — | — | 12.7 | L | 30 | — | — | — |
| LYD34 | 60271.3 | — | — | — | 12.8 | L | 32 | 0.5 | 0.05 | 15 |
| LYD34 | 60272.5 | — | — | — | 12.3 | 0.01 | 26 | — | — | — |
| LYD288 | 60763.3 | — | — | — | 12.0 | 0.04 | 22 | — | — | — |
| LYD288 | 60766.2 | 0.8 | 0.07 | 17 | — | — | — | — | — | — |
| LYD288 | 60766.4 | — | — | — | 11.8 | 0.05 | 21 | — | — | — |
| LYD285 | 60721.2 | 0.8 | 0.13 | 15 | 13.3 | L | 36 | 0.5 | 0.05 | 15 |
| LYD285 | 60722.4 | — | — | — | 13.0 | L | 34 | 0.5 | L | 24 |
| LYD285 | 60724.1 | — | — | — | 14.1 | L | 45 | 0.6 | L | 25 |
| LYD278 | 61022.4 | — | — | — | 11.8 | 0.05 | 21 | 0.5 | 0.29 | 8 |
| LYD278 | 61024.2 | — | — | — | 11.6 | 0.08 | 18 | — | — | — |
| LYD278 | 61026.3 | — | — | — | 10.9 | 0.28 | 12 | — | — | — |
| LYD278 | 61026.4 | — | — | — | 11.2 | 0.16 | 15 | — | — | — |
| LYD276 | 61016.1 | 0.8 | 0.08 | 16 | 14.7 | L | 51 | 0.5 | L | 23 |
| LYD276 | 61016.3 | — | — | — | 11.1 | 0.17 | 14 | — | — | — |
| LYD256 | 60741.1 | 0.7 | 0.29 | 10 | 13.0 | L | 34 | 0.5 | 0.05 | 15 |
| LYD256 | 60741.2 | 0.8 | 0.08 | 17 | 14.1 | L | 44 | 0.5 | 0.02 | 18 |
| LYD256 | 60742.1 | 0.8 | 0.08 | 17 | 10.9 | 0.26 | 12 | — | — | — |
| LYD256 | 60743.3 | — | — | — | 14.8 | L | 52 | 0.5 | L | 23 |
| LYD256 | 60743.4 | — | — | — | 12.2 | 0.02 | 25 | 0.5 | 0.26 | 9 |
| LYD250 | 61222.3 | 0.8 | 0.18 | 13 | 10.9 | 0.26 | 12 | — | — | — |
| LYD250 | 61224.2 | — | — | — | 15.1 | L | 54 | 0.6 | L | 27 |
| LYD250 | 61224.3 | — | — | — | 10.9 | 0.24 | 12 | — | — | — |
| LYD250 | 61224.7 | 0.8 | 0.04 | 20 | 13.6 | L | 39 | 0.5 | 0.02 | 17 |
| LYD250 | 61225.4 | 0.8 | 0.02 | 23 | 11.0 | 0.23 | 13 | — | — | — |
| LYD233 | 60733.1 | — | — | — | 11.0 | 0.23 | 12 | — | — | — |
| LYD233 | 60733.2 | — | — | — | 10.9 | 0.28 | 11 | — | — | — |
| LYD228 | 60402.3 | — | — | — | 11.3 | 0.15 | 16 | 0.5 | 0.16 | 11 |
| LYD228 | 60403.2 | 0.7 | 0.29 | 10 | — | — | — | — | — | — |
| LYD228 | 60403.4 | — | — | — | — | — | — | 0.5 | 0.12 | 12 |
| LYD221 | 60348.1 | — | — | — | — | — | — | 0.5 | 0.22 | 9 |
| LYD221 | 60349.3 | 0.8 | 0.15 | 14 | — | — | — | — | — | — |
| LYD221 | 60350.2 | 0.8 | 0.20 | 13 | — | — | — | — | — | — |
| LYD221 | 60351.3 | 0.8 | 0.04 | 19 | 12.0 | 0.03 | 23 | 0.5 | 0.15 | 11 |
| LYD197 | 60986.3 | — | — | — | 11.8 | 0.05 | 21 | 0.5 | 0.18 | 10 |
| LYD197 | 60988.2 | — | — | — | 14.2 | L | 46 | 0.5 | L | 24 |
| LYD197 | 60990.3 | — | — | — | 13.3 | L | 37 | 0.5 | 0.08 | 14 |
| LYD195 | 60256.1 | — | — | — | 13.0 | L | 33 | 0.5 | 0.06 | 14 |
| LYD195 | 60257.2 | — | — | — | 13.9 | L | 42 | 0.6 | L | 27 |
| LYD18 | 61216.2 | 0.8 | 0.12 | 16 | 13.8 | L | 41 | 0.5 | 0.03 | 18 |
| LYD18 | 61216.4 | — | — | — | 12.5 | L | 28 | 0.5 | 0.05 | 15 |
| LYD18 | 61217.4 | 0.8 | 0.07 | 17 | 15.4 | L | 58 | 0.6 | L | 27 |
| LYD18 | 61218.1 | 0.8 | 0.06 | 18 | 11.6 | 0.08 | 19 | — | — | — |
| LYD18 | 61218.6 | — | — | — | 13.0 | L | 33 | 0.5 | 0.02 | 18 |
| LYD176 | 61040.2 | — | — | — | 11.9 | 0.04 | 22 | 0.5 | 0.22 | 9 |
| LYD176 | 61041.1 | 0.8 | 0.11 | 16 | 11.9 | 0.04 | 22 | 0.5 | 0.12 | 12 |
| LYD176 | 61041.4 | — | — | — | 14.3 | L | 46 | 0.5 | L | 21 |
| LYD176 | 61044.4 | 0.8 | 0.21 | 12 | 12.7 | L | 30 | 0.5 | 0.04 | 16 |
| LYD172 | 61066.3 | — | — | — | 11.2 | 0.15 | 15 | — | — | — |
| LYD172 | 61066.4 | 0.8 | 0.06 | 18 | 13.9 | L | 43 | 0.5 | L | 24 |
| LYD172 | 61067.3 | — | — | — | 11.5 | 0.10 | 18 | — | — | — |
| LYD166 | 60998.3 | 0.7 | 0.26 | 12 | 14.1 | L | 45 | 0.5 | 0.02 | 21 |
| LYD166 | 60998.4 | — | — | — | 11.5 | 0.12 | 18 | 0.5 | 0.14 | 12 |
| LYD166 | 60999.1 | 0.8 | 0.02 | 23 | 12.7 | L | 30 | 0.5 | 0.16 | 11 |
| LYD166 | 61000.2 | — | — | — | 13.5 | L | 38 | 0.5 | 0.01 | 20 |
| LYD166 | 61000.4 | — | — | — | 12.9 | L | 32 | 0.5 | 0.06 | 14 |
| LYD139 | 60318.1 | 0.7 | 0.25 | 11 | 12.2 | 0.02 | 25 | 0.5 | 0.08 | 14 |
| LYD139 | 60319.8 | — | — | — | 14.6 | L | 50 | 0.5 | L | 22 |
| LYD139 | 60320.5 | — | — | — | 11.9 | 0.05 | 22 | 0.5 | 0.10 | 13 |
| LYD139 | 60320.8 | 0.8 | 0.12 | 15 | 12.3 | 0.02 | 26 | 0.5 | 0.15 | 12 |
| LYD139 | 60321.6 | — | — | — | 12.5 | L | 28 | 0.5 | 0.06 | 15 |
| LYD133 | 61234.1 | 0.8 | 0.08 | 17 | 11.0 | 0.22 | 13 | — | — | — |
| LYD133 | 61237.2 | 0.8 | 0.10 | 16 | — | — | — | — | — | — |
| LYD133 | 61237.3 | 0.8 | 0.11 | 15 | 11.0 | 0.20 | 13 | — | — | — |
| LYD119 | 61005.4 | — | — | — | 11.8 | 0.05 | 21 | 0.5 | 0.28 | 8 |
| LYD118 | 60745.4 | 0.7 | 0.24 | 11 | 11.1 | 0.17 | 14 | — | — | — |
| LYD113 | 60780.2 | 0.8 | 0.14 | 14 | — | — | — | — | — | — |
| LYD113 | 60781.4 | 0.8 | 0.04 | 23 | 10.9 | 0.30 | 11 | — | — | — |

TABLE 47-continued

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD113 | 60782.1 | — | — | — | 12.8 | L | 31 | — | — | — |
| LYD113 | 60785.3 | 0.8 | 0.14 | 14 | 10.9 | 0.26 | 12 | — | — | — |
| LYD105 | 60649.2 | 0.7 | 0.28 | 10 | 12.0 | 0.03 | 23 | 0.5 | 0.02 | 18 |
| LYD105 | 60652.2 | 0.8 | 0.01 | 26 | 11.9 | 0.04 | 22 | 0.5 | 0.05 | 16 |
| LYD105 | 60652.4 | — | — | — | 14.5 | L | 49 | 0.5 | L | 22 |
| LYD105 | 60653.2 | — | — | — | 12.3 | 0.02 | 26 | 0.5 | 0.06 | 15 |
| CONT. | — | 0.7 | — | — | 9.8 | — | — | 0.4 | — | — |
| LYD97 | 60078.4 | 0.8 | 0.26 | 18 | — | — | — | — | — | — |
| LYD97 | 60081.2 | 0.8 | 0.23 | 17 | 10.6 | 0.17 | 19 | 0.5 | 0.03 | 13 |
| LYD97 | 60082.1 | 0.8 | 0.27 | 16 | — | — | — | 0.5 | 0.07 | 12 |
| LYD85 | 60016.3 | 0.8 | 0.29 | 14 | — | — | — | — | — | — |
| LYD79 | 60018.2 | — | — | — | — | — | — | 0.5 | 0.05 | 13 |
| LYD76 | 60288.4 | 0.8 | 0.30 | 14 | 10.7 | 0.16 | 19 | 0.5 | 0.12 | 11 |
| LYD76 | 60289.3 | — | — | — | 10.6 | 0.17 | 18 | 0.5 | 0.09 | 9 |
| LYD76 | 60291.3 | — | — | — | 10.2 | 0.29 | 14 | 0.5 | 0.01 | 16 |
| LYD55 | 60175.1 | — | — | — | — | — | — | 0.5 | 0.19 | 8 |
| LYD55 | 60175.2 | — | — | — | — | — | — | 0.5 | 0.13 | 9 |
| LYD53 | 60207.3 | 0.8 | 0.16 | 20 | — | — | — | — | — | — |
| LYD44 | 60248.2 | — | — | — | 12.9 | 0.01 | 44 | 0.6 | 0.07 | 21 |
| LYD33 | 60159.5 | — | — | — | — | — | — | 0.5 | 0.26 | 6 |
| LYD234 | 60181.4 | — | — | — | — | — | — | 0.5 | 0.08 | 13 |
| LYD234 | 60182.3 | — | — | — | — | — | — | 0.5 | 0.29 | 10 |
| LYD224 | 60040.1 | — | — | — | 10.3 | 0.27 | 15 | 0.5 | 0.12 | 11 |
| LYD224 | 60040.8 | — | — | — | — | — | — | 0.5 | 0.22 | 8 |
| LYD220 | 60224.1 | — | — | — | 12.6 | L | 40 | 0.6 | L | 23 |
| LYD220 | 60224.2 | — | — | — | — | — | — | 0.5 | 0.17 | 9 |
| LYD22 | 60043.1 | 0.8 | 0.21 | 18 | 10.5 | 0.20 | 17 | 0.5 | 0.07 | 10 |
| LYD22 | 60043.4 | — | — | — | — | — | — | 0.5 | 0.13 | 11 |
| LYD217 | 60048.4 | — | — | — | — | — | — | 0.5 | 0.13 | 8 |
| LYD214 | 60126.1 | — | — | — | — | — | — | 0.5 | 0.11 | 9 |
| LYD213 | 60058.3 | — | — | — | 10.9 | 0.13 | 21 | 0.6 | L | 20 |
| LYD208 | 60064.1 | — | — | — | 11.5 | 0.04 | 28 | 0.6 | L | 22 |
| LYD208 | 60064.6 | — | — | — | 11.1 | 0.09 | 24 | 0.5 | 0.02 | 15 |
| LYD208 | 60064.8 | — | — | — | 11.3 | 0.06 | 26 | 0.5 | 0.01 | 18 |
| LYD20 | 60069.3 | 0.8 | 0.24 | 17 | — | — | — | 0.5 | 0.03 | 13 |
| LYD20 | 60070.1 | — | — | — | — | — | — | 0.5 | 0.15 | 9 |
| LYD194 | 60086.2 | — | — | — | — | — | — | 0.5 | 0.27 | 9 |
| LYD190 | 60242.2 | 0.8 | 0.20 | 19 | 10.4 | 0.24 | 16 | 0.5 | 0.06 | 11 |
| LYD186 | 60237.1 | — | — | — | 10.7 | 0.16 | 19 | 0.5 | 0.02 | 14 |
| LYD186 | 60237.3 | — | — | — | — | — | — | 0.5 | 0.10 | 12 |
| LYD184 | 60229.1 | 0.8 | 0.18 | 18 | 12.1 | 0.02 | 35 | 0.6 | L | 23 |
| LYD184 | 60230.1 | — | — | — | — | — | — | 0.5 | 0.12 | 10 |
| LYD146 | 60024.2 | — | — | — | — | — | — | 0.5 | 0.03 | 13 |
| LYD13 | 60193.1 | — | — | — | — | — | — | 0.5 | 0.04 | 13 |
| LYD13 | 60193.4 | 0.8 | 0.27 | 16 | — | — | — | 0.5 | 0.05 | 16 |
| LYD122 | 60199.2 | — | — | — | — | — | — | 0.5 | 0.20 | 7 |
| LYD122 | 60201.1 | 0.8 | 0.13 | 21 | — | — | — | 0.5 | 0.08 | 10 |
| LYD122 | 60201.3 | — | — | — | — | — | — | 0.5 | 0.13 | 9 |
| LYD117 | 60033.5 | — | — | — | — | — | — | 0.5 | 0.19 | 7 |
| LYD117 | 60033.6 | 0.9 | 0.03 | 30 | 14.3 | L | 59 | 0.6 | L | 34 |
| LYD101 | 60072.8 | — | — | — | — | — | — | 0.5 | 0.16 | 9 |
| LYD101 | 60075.3 | — | — | — | 11.6 | 0.05 | 29 | 0.6 | L | 20 |
| CONT. | — | 0.7 | — | — | 9.0 | — | — | 0.5 | — | — |
| LYD99 | 60328.6 | — | — | — | 7.2 | 0.29 | 15 | — | — | — |
| LYD95 | 61202.3 | 0.7 | 0.27 | 13 | — | — | — | — | — | — |
| LYD84 | 61133.5 | 0.7 | 0.18 | 16 | — | — | — | — | — | — |
| LYD84 | 61134.3 | — | — | — | 7.5 | 0.16 | 20 | — | — | — |
| LYD84 | 61134.4 | — | — | — | 7.4 | 0.21 | 18 | — | — | — |
| LYD63 | 61230.2 | 0.8 | 0.08 | 24 | 8.5 | 0.03 | 35 | 0.4 | 0.19 | 14 |
| LYD58 | 61306.2 | — | — | — | 7.7 | 0.11 | 23 | — | — | — |
| LYD58 | 61306.6 | — | — | — | 7.6 | 0.15 | 21 | 0.4 | 0.17 | 14 |
| LYD58 | 61307.3 | 0.7 | 0.20 | 14 | — | — | — | — | — | — |
| LYD58 | 61310.4 | 0.8 | 0.11 | 19 | — | — | — | — | — | — |
| LYD37 | 60162.3 | 0.7 | 0.23 | 13 | 7.3 | 0.23 | 17 | — | — | — |
| LYD283 | 61317.4 | — | — | — | 7.6 | 0.15 | 21 | 0.4 | 0.25 | 12 |
| LYD270 | 61370.4 | 0.7 | 0.29 | 11 | — | — | — | — | — | — |
| LYD26 | 61169.2 | 0.7 | 0.28 | 13 | — | — | — | — | — | — |
| LYD259 | 61301.1 | 0.7 | 0.19 | 14 | — | — | — | — | — | — |
| LYD259 | 61302.3 | 0.7 | 0.15 | 16 | — | — | — | — | — | — |
| LYD252 | 61055.3 | 0.7 | 0.12 | 17 | — | — | — | 0.4 | 0.18 | 13 |
| LYD236 | 60188.1 | 0.7 | 0.25 | 14 | — | — | — | — | — | — |

TABLE 47-continued

Genes showing improved plant performance at Normal growth conditions under regulation of 6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD236 | 60188.4 | 0.7 | 0.15 | 17 | — | — | — | — | — | — |
| LYD231 | 60715.3 | 0.8 | 0.13 | 21 | — | — | — | — | — | — |
| LYD230 | 61333.4 | 0.8 | 0.07 | 20 | 7.4 | 0.21 | 18 | — | — | — |
| LYD230 | 61335.2 | 0.7 | 0.19 | 14 | — | — | — | — | — | — |
| LYD223 | 61195.3 | 0.7 | 0.17 | 16 | — | — | — | — | — | — |
| LYD187 | 61314.4 | — | — | — | — | — | — | 0.4 | 0.21 | 13 |
| LYD152 | 61352.1 | 0.8 | 0.08 | 22 | 9.1 | L | 45 | 0.4 | 0.13 | 16 |
| LYD152 | 61353.1 | 0.7 | 0.30 | 13 | 7.9 | 0.12 | 26 | — | — | — |
| LYD152 | 61355.3 | — | — | — | 7.6 | 0.13 | 21 | — | — | — |
| LYD150 | 61323.2 | 0.7 | 0.12 | 18 | — | — | — | — | — | — |
| LYD150 | 61324.1 | 0.7 | 0.18 | 15 | 7.9 | 0.07 | 27 | — | — | — |
| LYD150 | 61324.2 | 0.8 | 0.02 | 30 | 7.9 | 0.15 | 27 | — | — | — |
| LYD150 | 61325.4 | 0.7 | 0.13 | 17 | 7.2 | 0.29 | 15 | — | — | — |
| LYD150 | 61326.1 | 0.8 | 0.12 | 21 | 7.9 | 0.06 | 26 | — | — | — |
| LYD126 | 61376.1 | 0.7 | 0.22 | 14 | 7.2 | 0.28 | 15 | — | — | — |
| LYD126 | 61377.3 | 0.8 | 0.09 | 19 | — | — | — | — | — | — |
| LYD126 | 61378.2 | 0.7 | 0.13 | 18 | — | — | — | — | — | — |
| LYD126 | 61380.4 | — | — | — | 8.1 | 0.06 | 29 | — | — | — |
| LYD118 | 60747.2 | — | — | — | 7.5 | 0.18 | 19 | — | — | — |
| LYD118 | 60749.1 | 0.8 | 0.02 | 28 | 8.4 | 0.04 | 35 | 0.4 | 0.24 | 13 |
| LYD118 | 60749.3 | — | — | — | 7.5 | 0.17 | 20 | — | — | — |
| LYD118 | 60749.4 | — | — | — | 7.3 | 0.23 | 17 | — | — | — |
| LYD115 | 61349.1 | 0.7 | 0.14 | 17 | — | — | — | — | — | — |
| LYD114 | 61383.3 | 0.7 | 0.27 | 13 | 7.3 | 0.23 | 17 | — | — | — |
| LYD114 | 61383.6 | — | — | — | 7.4 | 0.21 | 18 | — | — | — |
| LYD114 | 61384.2 | 0.8 | 0.02 | 26 | 7.3 | 0.24 | 16 | — | — | — |
| LYD112 | 61147.1 | — | — | — | 7.3 | 0.23 | 17 | — | — | — |
| LYD109 | 61177.4 | 0.7 | 0.20 | 15 | — | — | — | — | — | — |
| LYD109 | 61178.3 | — | — | — | 7.5 | 0.17 | 19 | — | — | — |
| LYD108 | 61294.1 | 0.7 | 0.13 | 18 | 8.4 | 0.04 | 34 | 0.4 | 0.24 | 14 |
| LYD108 | 61295.1 | 0.7 | 0.19 | 15 | — | — | — | — | — | — |
| LYD108 | 61296.1 | 0.7 | 0.17 | 15 | 7.4 | 0.21 | 18 | — | — | — |
| LYD108 | 61297.2 | — | — | — | — | — | — | 0.4 | 0.25 | 12 |
| LYD106 | 61140.2 | 0.7 | 0.26 | 12 | — | — | — | — | — | — |
| LYD106 | 61140.4 | 0.7 | 0.18 | 15 | — | — | — | — | — | — |
| CONT. | — | 0.6 | — | — | 6.3 | — | — | 0.4 | — | — |

Table 47.
"CONT."—Control;
"Ave."—Average;
"% Incr." = % increment;
"p-val."—p-value, L-p < 0.01.

TABLE 48

Genes showing improved plant performance at Normal growth conditions under regulation of 6669 promoter

| Gene Name | Event # | Leaf Relative Area | | |
|---|---|---|---|---|
| | | Ave. | P-Val. | % Incr. |
| LYM275 | 13192.1 | 92.3 | 0.21 | 3 |

Table 48.
"CONT."—Control;
"Ave."—Average;
"% Incr." = % increment;
"p-val."—p-value, L-p < 0.01.

Example 17

Identification of a Novel Promoter from *Arabidopsis*

WO2004/081173 discloses the At6669 promoter (SEQ ID NO:8093 herein) which is capable of expressing a heterologous polynucleotide operably linked thereto in a host cell.

Experimental Procedures

Isolation of DNA regulatory elements (DREs): A high throughput method of cloning DNA regulating elements (DREs) using a single reaction tube, referred to herein as the "one-tube" method, was utilized in order to enable large scale production of DRE transformed plants. Accordingly, genomic DNA (gDNA) was extracted from leaves of *Arabidopsis thaliana* Col1 using DNAeasy Plant Mini Kit (Qiagen, Germany). Primers for PCR amplification of DREs were designed using PRIMER3© software and modified to contain restriction sites absent from the DRE sequence, for PCR product insertion into the pQYN plasmid.

Amplification of the novel AT6669 promoter sequence—The promoter was cloned from a genomic DNA of *Arabidopsis thaliana* using the following primers:

Forward primer (without any restriction site): 5'-TATAC-CAGTGGAGACGAAAGC (SEQ ID NO:8098); and Reverse primer (which includes a SalI restriction site): 5'-TAATAAATAGTCGACTCTTTGGGG (SEQ ID NO:8099).

Polymerase chain reaction analyses were performed using Taq Expand Long Template PCR kit (Roche), according to the manufacturer's instructions, using as thermal cycle: 92° C./2 min→10×[94° C./10 min→55° C./30 sec→68° C./5 min]→18×[94° C./10 min→55° C./30 sec→68° C./5 min (+20 sec each cycle)]→68° C./7 min The amplified PCR product was digested with the HindIII and SalI restriction enzymes and was designated 6669_Cid506.

Figure 5:
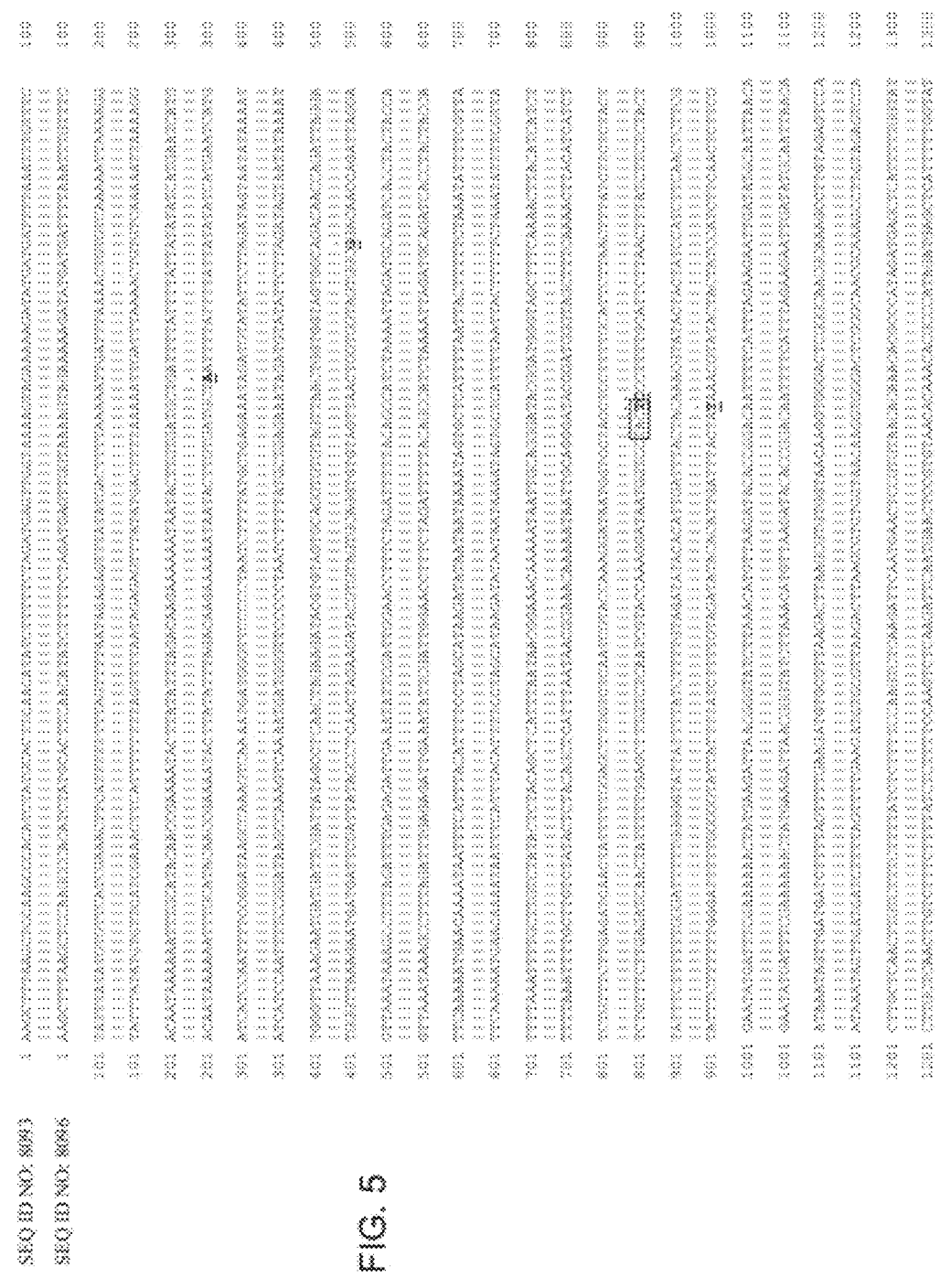
Figure 5:
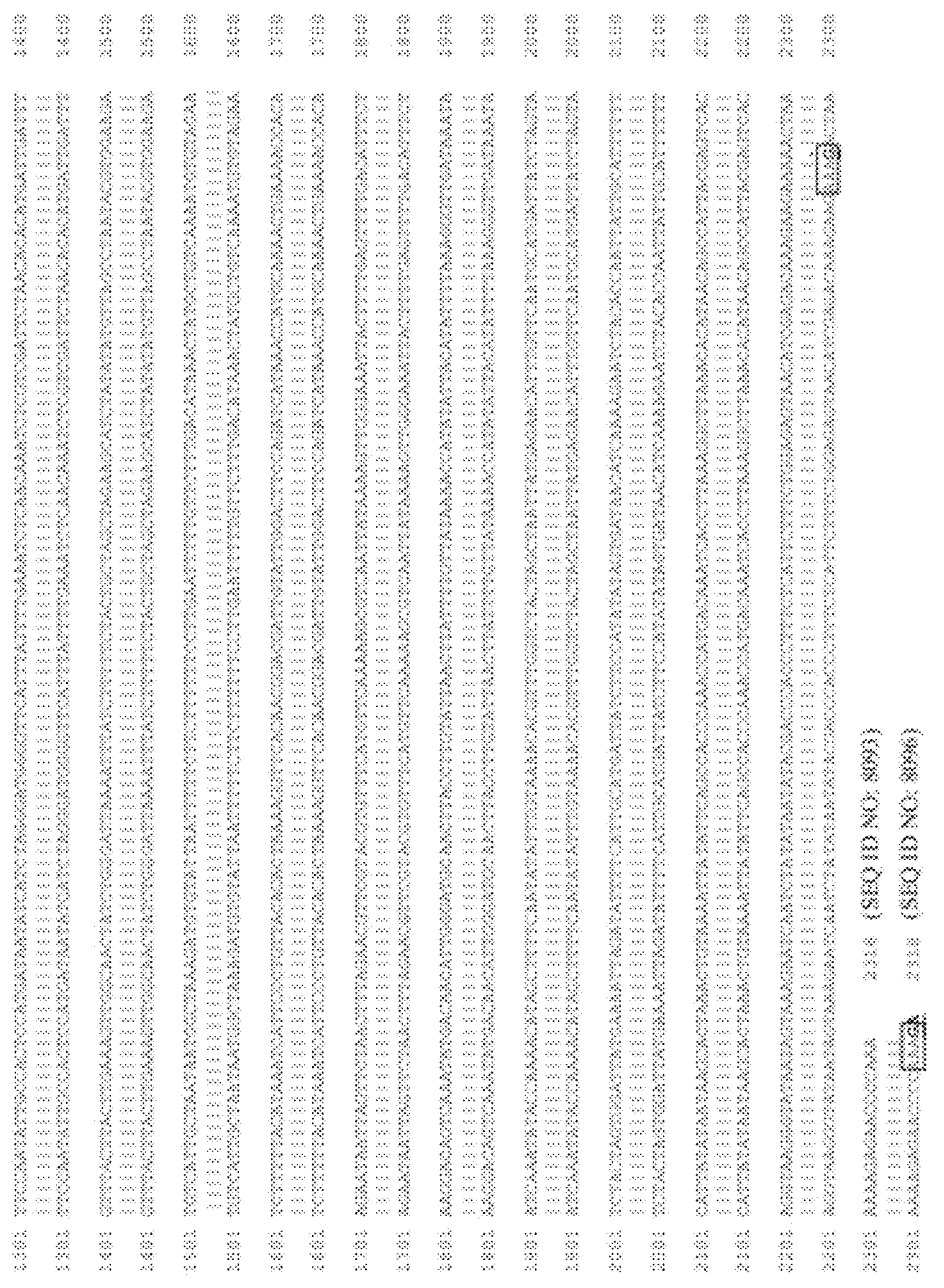

The pQYN vector—The starting plasmid is pQYN (Pid #1468; FIG. 5). This plasmid is based on the pBI101 plasmid (Clontech, Laboratories, Inc. Mountain View, Calif. 94043) and contains the following features different from pBI101: (i) PolyA signal was inserted before MCS (multi cloning site) (upstream to HindIII restriction site); (ii) GUS gene was substituted by GUS intron gene; (iii) Originally in pBI101 NPTII expression cassette was close to the right border of tDNA. In pQYN the region between left and right borders (not including the borders) was inverted in order to bring NPTII expression cassette close to the left border and GUS intron expression cassette close to the right border.

Figure 6:
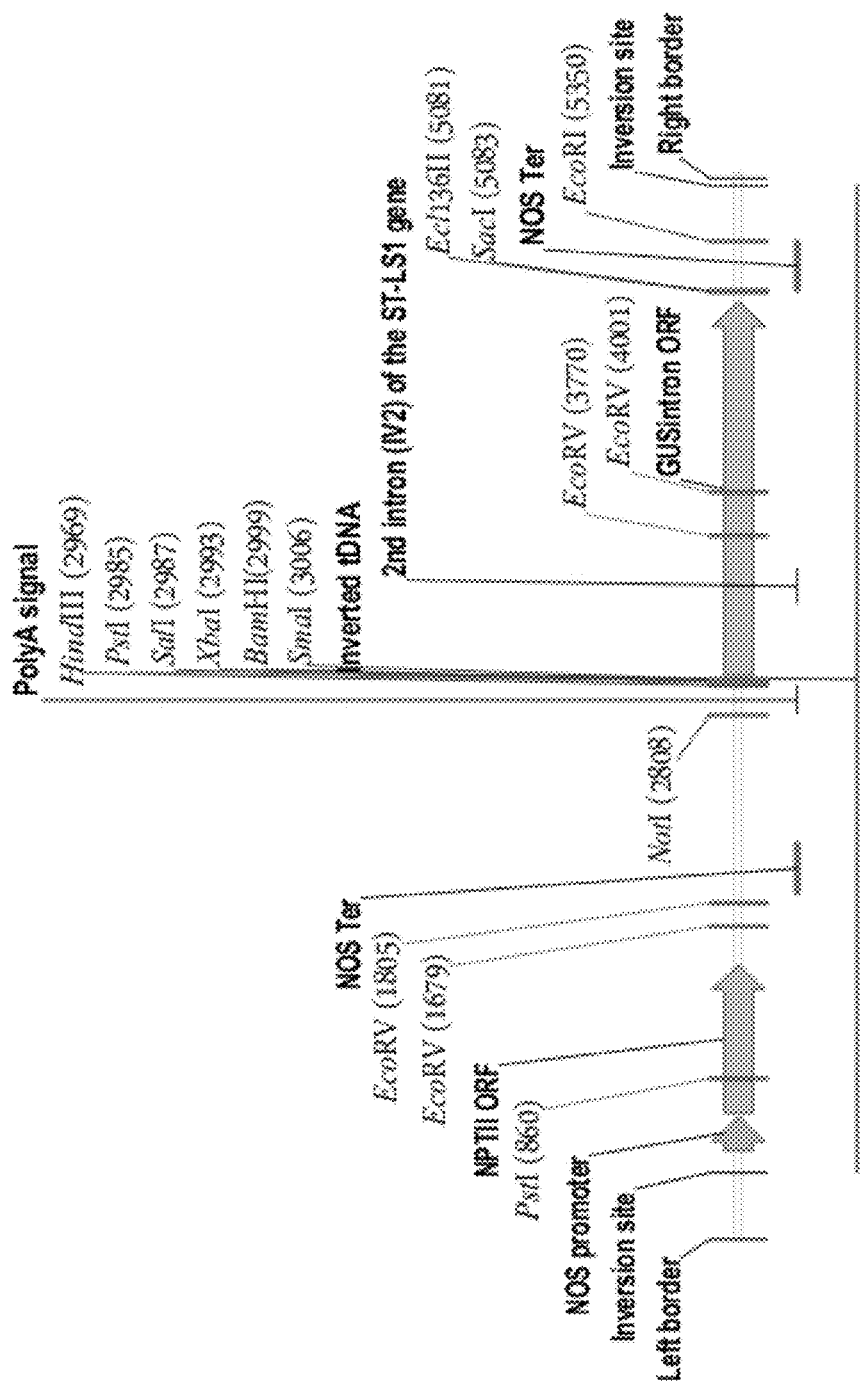
FIG. 6 is a schematic illustration of the pQYN plasmid.
Figure 7:
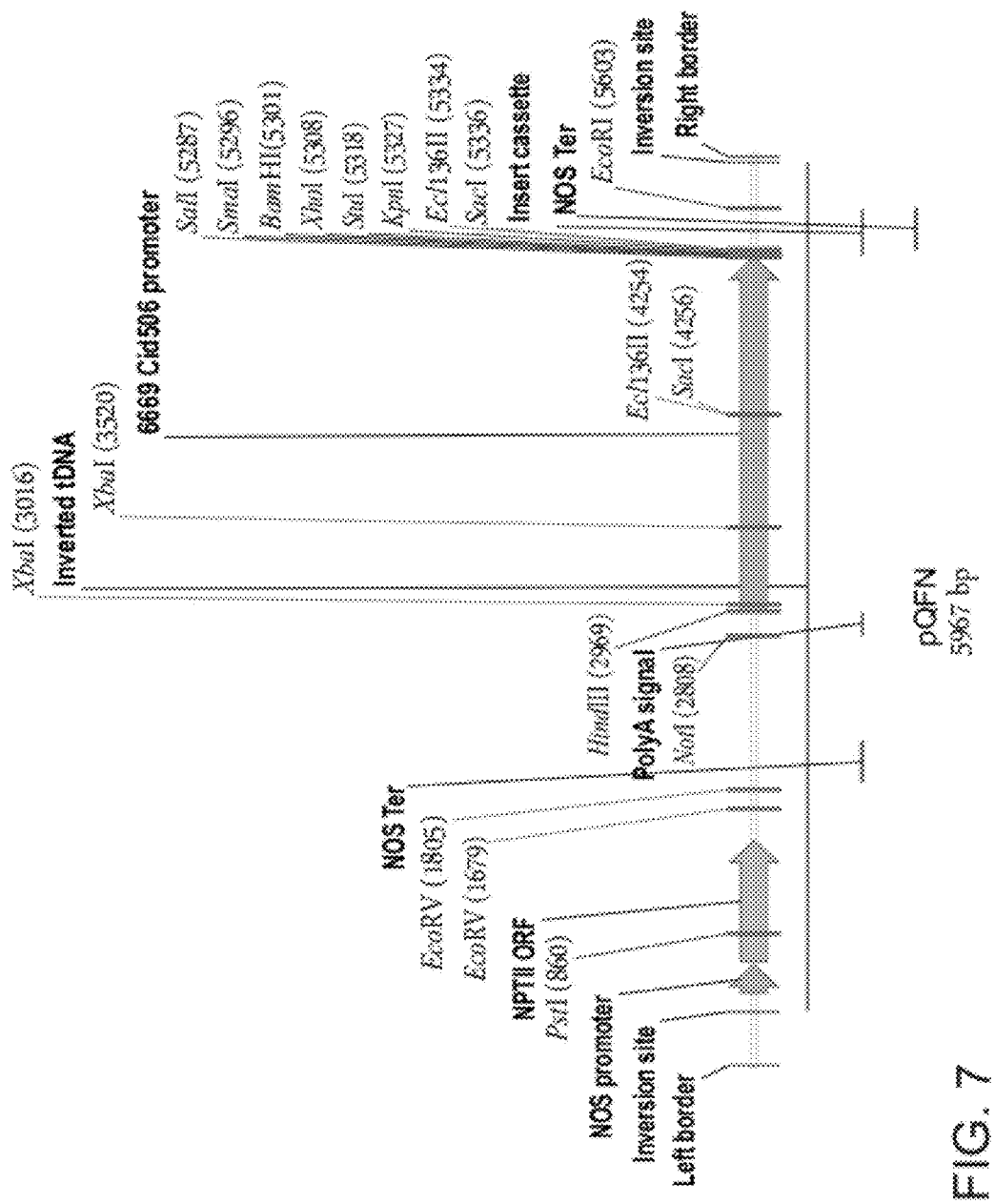
FIG. 7 is a schematic illustration of the pQFN plasmid.

Cloning of the promoter sequence into pQYN vector— The pQYN vector was digested with HindIII/SalI. The 6669_Cid506 which was digested HindIII/SalI was ligated into the HindIII/SalI—digested pQYN (Pid #1468) plasmid, creating the pQYN_6669 (Pid#1996) plasmid. To facilitate the cloning into pQYN_6669 (Pid#1996) plasmid, expanded MCS+NOS terminator was ligated into the pQYN_6669 (Pid#1996) digested with SalI/EcoRI, replacing the existing MCS+GUS intron+NOS terminator. There was no change in the NOS terminator sequence. Resulting plasmid was designated pQFN (Pid#2054) (FIG. 6).

Generation of a Nucleic Acid Construct Including the Novel Promoter and a Heterologous Coding Sequence (e.g., a Reporter Gene):

I. GUS Reporter Expression Cassette

Figure 8:
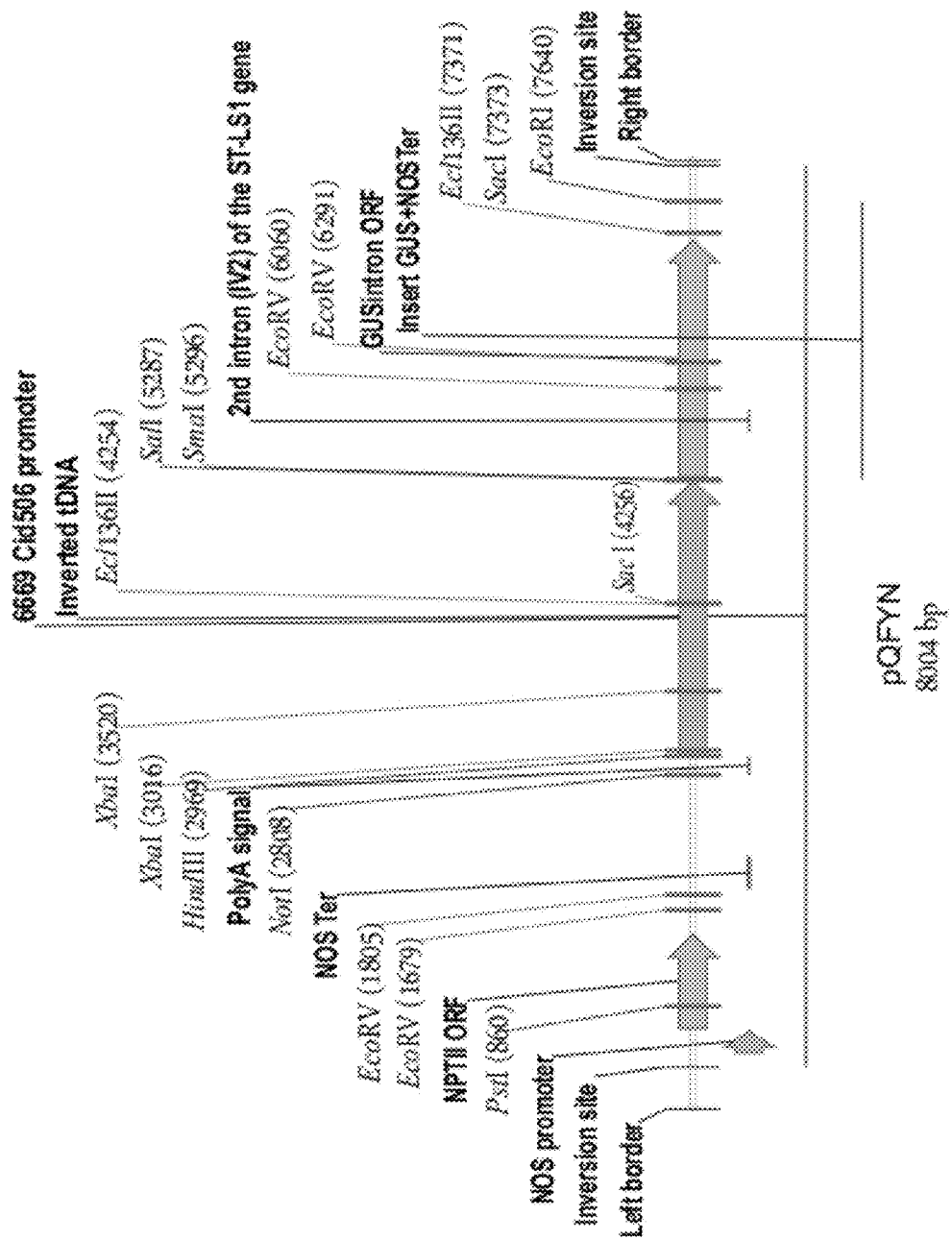
FIG. 8 is a schematic illustration of the pQFYN plasmid.
Figures 9A, 9B, 9C, 9D:
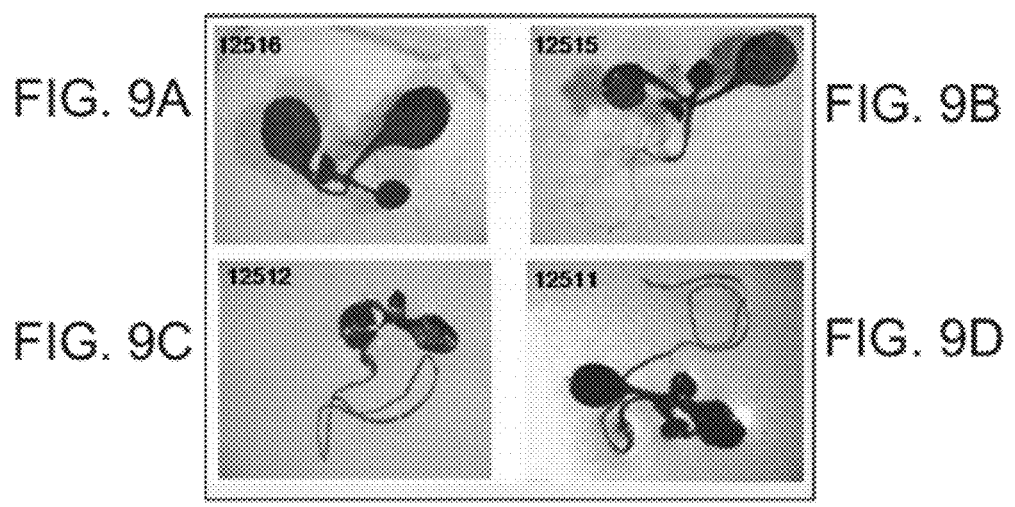
FIGS. 9A-D are images depicting GUS staining in 11 day-old *A. thaliana* seedlings which were transformed with the GUS intron expression cassette under the novel At6669 promoter (SEQ ID NO:8096). Note that the novel promoter sequence p6669 induces GUS expression (blue staining) in 11 day-old seedling of *A. thaliana*, especially in roots, cotyledons and leaves. GUS expression is demonstrated for 4 indepented events (event numbers 12516, 12515, 12512, 12511).
Figures 10A, 10B, 10C, 10D:
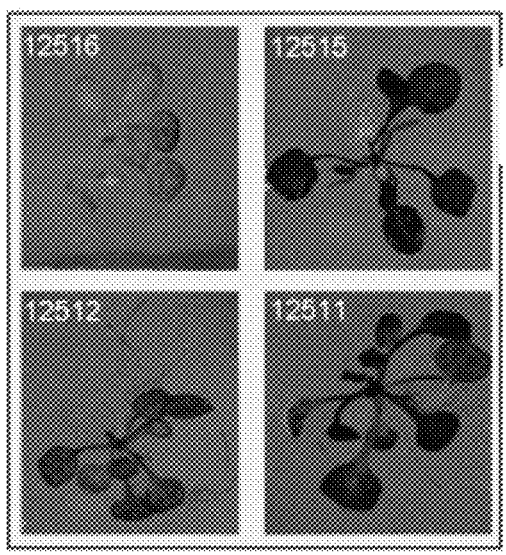
FIGS. 10A-D are images depicting GUS staining in 20-day-old *A. thaliana* seedlings which were transformed with the GUS intron expression cassette under the novel At6669 promoter (SEQ ID NO:8096). Note that the novel promoter sequence p6669 induces GUS expression (blue staining) in 20 day-old *A. thaliana*, especially in roots mainly root tip and leaves. GUS expression is demonstrated for 4 indepented events (event numbers 12516, 12515, 12512, 12511).

Generation of expression cassette 6669_Cid506 promoter+GUS intron+NOS terminator (At6669-GUS intron expression cassette)—GUS intron+NOS terminator cassette was excised from pQXYN (Pid#1481) by digesting with SmaI/EcoRI restriction enzymes and ligated into pQFN (Pid#2054), which was also digested with SmaI/EcoRI, generating pQFYN (Pid#2431; FIG. 8) final plasmid. There was no change in the sequence of NOS terminator.

Transformation of agrobactrium with the At6660-GUS intron expression cassette and further into *Arabidopsis thaliana* Columbia ($T_0$ plants) was performed essentially as described in Example 13 hereinabove using the At6660-GUS intron expression cassette. In addition, generation of T1 and T2 transgenic plants harbouring the At6660-GUS intron expression cassette was performed as described in Example 13 hereinabove.

Evaluation of Promoter Activity

Evaluating the novel AT6669 promoter sequence activity in transgenic plants: The ability of DRE to promote gene expression in plants was determined based on the expression of GUS reporter gene. Accordingly, transgenic *Arabidopsis* plantlets at different development stages were subjected to GUS assays using standard GUS staining protocol [Jefferson R A, Kavanagh T A, Bevan M W. 1987. GUS fusions: beta-glucuronidase as a sensitive and versatile gene fusion marker in higher plants. EMBO J. 6(13): 3901-7].

Experimental Results

Identification of a novel At6669 promoter with two new regulatory elements—The present inventors have surprisingly uncovered that during the cloning procedure a novel sequence (set forth by SEQ ID NO:8096) which includes some mutations with respect to the previously disclosed At6669 promoter (SEQ ID NO:8093) was obtained. A sequence comparison between the two promoters is provided in FIG. 5 with the mismatched nucleotides being underlined. As shown by the sequence alignment (FIG. 5), the novel promoter identified herein exhibits 3 additional sites of regulatory elements as compared to the previously disclosed At6669 promoter, as follows: the "YACT" regulatory element (Y can be a cytosine or a thymidine nucleotide) at position 862-865 of SEQ ID NO:8096; and two sites of the "AAAG" regulatory element at positions 2392-2395 and 2314-2317 of SEQ ID NO:8096.

The novel At6669 comprises an additional YACT regulatory element which is capable of driving a mesophyll expression module—High rates of photosynthesis, increased water use efficiency and nitrogen use efficiency of C4 plants are attributed to the unique mode of carbon assimilation in these plants which includes strict compartmentation of the $CO_2$ assimilatory enzymes into mesophyll cells [which include the phosphoenol-pyruvate carboxylase (ppcA1)] and bundle-sheath cells [which include to ribulose bisphosphate carboxylase/oxygenase]. The "YACT" regulatory element was found by Gowik U, et al., 2004 (cis-Regulatory elements for mesophyll-specific gene expression in the C4 plant *Flayeria trinervia*, the promoter of the C4 phosphoenolpyruvate carboxylase gene; Plant Cell. 16:1077-1090) to be a key component of the mesophyll expression module 1 (Mem1) of the ppcA1 in the C4 dicot *F. trinervia*. In addition, when used in a heterologous expression system the YACT regulatory sequence was shown necessary and sufficient for high mesophyll-specific expression of the β-glucuronidase reporter, and as an enhancer which directs mesophyll-specific expression when inserted into the ppcA1promoter of the C3 plant *F. pringlei* (Gowik U, et al., 2004, Supra).

The novel At6669 comprises two additional sites of the AAAG regulatory elements, the core binding site for the Dof transcription factors—The AAAG regulatory element is the core site required for binding of Dof proteins in maize (Z.m.). Dof proteins are DNA binding proteins, with presumably only one zinc finger, and are unique to plants. There are four known Dof proteins: Dof1, which enhances transcription from the promoters of both cytosolic orthophosphate kinase (CyPPDK) and a non-photosynthetic PEPC gene; Dof2, which suppresses the C4PEPC promoter; Dof3; and PBF, which is an endosperm specific Dof protein that binds to prolamin box [Yanagisawa S, Schmidt R J, Diversity and similarity among recognition sequences of Dof transcription factors. Plant J, 17:209-214 (1999)]. Dof1 and Dof2 transcription factors are associated with expression of multiple genes involved in carbon metabolism in maize [Yanagisawa S, Plant J 21:281-288 (2000)].

Altogether, these results show that the novel promoter identified herein can drive expression of heterologous polynucleotides in a host cell with high efficiency.

Characterization of novel At6669 promoter sequence (SEQ ID NO:8096)—The ability of At6669 promoter to promote gene expression in plants was determined based on the expression of GUS reporter gene. Various features of the isolated At6669 promoter of some embodiments of the invention are described in FIGS. 9A-D, 10A-D, and 11A-L. As is clearly evident from these experiments, the At6669 promoter is constitutively expressed in the plant model in various developmental stages, including the early vegetative stage of the seedling (e.g., day 10-11; FIGS. 9A-D), the bolting to stage in which the plant develops towards the reproductive stage (e.g., day 20, FIGS. 10A-D), and the mature reproductive stage (e.g., day 40-41; FIGS. 11A-L) in which various tissues express the reporter gene under the novel At6669 promoter (SEQ ID NO:8096), including the roots, leaves, stems and flowers, with a strong expression in leaves and flowers.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (8689 sequences)

SEQ ID NO: 1 - DNA, 1235 bp, Arabidopsis thaliana
aactccttaaaattgctctcaaggcggagaagaagaagaagaagaagaagaagaagaaacggcgccgtttatttattgtctatcttggttttccacgcaccgagctttaagaagagtgaaagatggtgatggactcatcaaaatggtggtggattggaaatcacaacactactaatttctctccttggcttcattctactctctctgaattggatgaaaagacaaaggaaatgctgagagtgattgatgaggatgctgattcttttgcggcacgagctgagatgtattacaagaaaaggcccgagcttatagctatggtggaagaattctaccgttcacatcgctccttggccgagaggtacgacttgttgagaccctcttctgtgcataaacatggctcagactcggagagtcatgagaaatcatcaacttgtgatgagtcttcttggtctgaggcttgtgagactcatgaggagtatgcggagtctgaaatagataacggtgaaagcaaatgggtcgatgaaagtgaaattgatggcattgttgaggaaatagaaccatcggaagtcgtttacagtgaaggtaatggaaattctgagatgatgaagatagagatagagaggctgagagaggagaataaggtttacagtgaaatggtgagagagaaagatgaagagaagagagaagctataaggcaaatgagtgtagcaatacaaatgcttaaagaagagaactcagagcttaagaaacgtgttaccaatactgttgttgcaaggcgtaataaggaaggtggtgattctcagaggaagcaacagatgtggaagccatttgagtttaagaagattaagcttgaagggttatgggggaaaggctttggcaattgggctctcccaaacacagattctacttccaaagagctcatgactctttagaggagacagagaggtccgagtgatcaagaacagaaactgaggaactttctctaaatatctttgtactctgtgataggtagggtatactctcaactagttagcgtaaggtatatcataggattgtagttatacctaagtccatggatgtttgttacattttctattgttcgtttcttgtttaaatataattgtctttcttttgaaatcaattgttttgttctttaatatctgtaagtttgttttcttttactttatgtgtgtaataaatggtgataagaagttgttgtttaaaaggtttgacca

SEQ ID NO: 2 - DNA, 1475 bp, Arabidopsis thaliana
atctaccgtctcttcttcaaaccaaacccagaacctccgtccgaccaattccggtgcagctaagaaccagagatagagagatagagatgcggaggatcaattcactgtacggaagaattggtctcctaaaacgagtacccgagaaatctacgaagcaagctcatacatttctcgcatctctctccttctctacggaaggtgcttatggcggtgacggtgagtttcagcagaacagctccaaagtcaagatctttgaccgagacctcaagcgaatacatcgtgatcgagcggcgtggctttctcgccaaaaaaacgattcttttgttgacgctgttgcagataatctacttgatcgcttagaggattgtaagaagagttttcccactgcattttgtttgggaggatctcttggtgctgttaagagattactacgtggtcgcggtgggattgagaagcttatcatgatggatacttcatatgacatgattaagtcatgtagagatgctcaagacgattcactcgataactccattgaaacctcttactttgttggtgatgaagagtttctgccagtcaaagagagttcggttgatttgatcattagttcgttggggcttcactggacaaatgatcttcctggatccatgatacagtgcaagctagcactgaagccggatggcttatttttagcagcaattcttggtggagaaaccttaaaggagctgagaatagcatgcactttggctcacatggagcgggaaggagggattagtcctcggctatcacctttggcacaggttagggacgcagggaatctgttgaccagggcgggttttagtcttcctggtgttgatgttgatgaatatgtagttaaatacaagagagcgatggatcttatagagcatcttcgtgcgatgggtgaaaccaatgctcttctcgagagaaacaagattttgaatcgtgaaactgctgttgccacggcagccatatatgactccatgtttgccacagaggacggcactatacccgctacttttcaggtgatttacatgacaggatggagagaacattcgtctcacccgcaggccaaacgaagaggttcagccaccgtatccttcacggatctccaaaagcaatttggcggacaatcttgatggaatgattgaagaagagaaacattcaataagcagagactttacaaatgacacttgagagagaaatcagtgacttaagctataaggtacttggaggaactcttgtagatttgtcggagtctttcactgggcgaaagcatcacaattaggacgcctgctttcgcccatgtatttcgtatcgaataatagctgatcagaaacatatttgtattttacaaaaatattacgaatacttaaaaatctcaatcttcaatcacgaaacatgatctcgcgctaggtttcttgaatagatttgtatacaatggaccaaacttcactaaa

SEQ ID NO: 3 - DNA, 1409 bp, Arabidopsis thaliana
gaatactttttcgaaatatcaaaagaaggaacaaaaatgcaagccatcggtagcagccatggcaggaggctctgcttcaaccactatctctccgattccttctccaaattcctctctccttcttcttctccttcccttctccctcagagatgccattcgttctgtatccccaagcttggaagtagtagtaccaatgagaatggcagaggaagaagtgtaacagtgagagcttcaggagatgaagattctaatgagaactttgctcctcttgctcctgttgagcttgaatctcctgtaggacagcttttggagcagattcttagaactcatcctcatcttttacccgttactgtcgatgagcagctcgagaaattcgccgcggaaagcgagtctcgtaaagctgattcgtcttccacacaagacattctccaaaagaggatatctgaagttagagataaggaaagacgtaaaactttagcagagatcatttactgtttagtggtacacagatttgtggaaaaaggaatctctatgattcctcggattaaaccaacttcagacccagcaggacggatagacttatggccgaatcaagaagagaagctcgaagtcattcactctgcggatgcgttcgagatgatacagagtcacttgtcttcagttcttggagacggaccagcagttggtccgttaagctctatagttcagataggcaaaatcaagctaggaaaactctatgctgcttctgctatgtatggatattttctcagaagagtagaccaaagataccaacttgagagaaccatgaacacacttccgaaacgccctgagaaaaccagagaacggttcgaagaaccttcgcctccttacccgttatgggacccggattccttgatcaggattcaaccagaggaatatgatcccgatgaatacgcgatacaaagaaatgaagatgagtcatcgtcttatggattgagatcatatgttacgtatttggactcggatacgcttcagagatatgccacgatacgttctaaagaagccatgactctgattgagaagcagactcaggcgctctttggacgaccggatataaggatactcgaggatggaaagctcgatacttctaacgacgaggttctgtctctgagtgtctctggacttgcgatgttggttttggaagctgtggcttttgggtctttcttatgggattcagagagttacgttgaatccaaataccatttcctcaaggcttgagtttagtcctccttgacatttgtacctttttgagagtagtgaatgtaaatgttaaatctctcatgtgaaattggtagcaactcctattcgtaaaatgtaataaacttcacttcaaaactttagacttaaatcaagcatattagctcaaaact

SEQ ID NO: 4 - DNA, 1769 bp, Arabidopsis thaliana
aacttcctttttctggttctctctttcttctttctattttattcaaaagccaattcccaatttcccaccaaagcatcactttggcgcaatccgaagattctcgccgccgccgtcgtcatgtcgccgtccgacgaatcgacgaacggttctcgttgctcatcatgcatctccagcgacaacgatggcaacgatttcggtaaatcggatgagtttacatgcaaacaatgcaaaaactccgattcgaaatcgaaatcaaaatcggtgaatgattcggataagcttcgaagaatcatcgtcgcttccgtcaaaggattcactataggtactggtttaaaaggtggtttagctattttctcaatcgtcgctcgtttcgctcgtcgtcgtagatcttctcctcaatctaggaaaaccggagagttttcgaatagtgaagctatcgctatggggattaaggagacgttaagatatggattgttcttaggaacttttgctgggacttttgtttctgtagatgaagctattgctgctttagcaggagacaagagaactgcaaaatggagggccctgtttgctggattggtggctggaccatctatgcttctcacagggccaaatacgcaacatacgagtttggctgtttatatattgatgcgtgctgcggttctcgcatcgcgttgcggtattaaaagtaaacgctttggtaccatttgcaagccacttacttggaaacatggagatttattcctcatgtgtctctcttcctcacagattttgtctgcttacattttgaaacaagaaagccttccttcatcgtacaagtctttccttaacaaacaaggtgggaaggatctttcaatcttacaaggcgtaaaagatatcgcaaccgcgcaaccgttcactaatttaagagcgattgagaaatattacaagtctgttggagttgatatcaaactggatcctaccatgaaagtcccctgtacgataatacatggaaatgagtcatgtgttaagcatggtgttacatttttccttcaagcttacaagagggcgttacctgtctatgtccctgtgtatttgattccagcgctaatagtccatcgtcaagacctgctaaaaaagcaatactctatacttggcaagggtcttctgggcacagcgagatcaagtttgtttctcgctacttactgctcttctgcctgggcttggacttgtctactattccgcacttttgagacatgcaacataccgcttgtggccatagcaacattcccaacaggtctggctttagctattgagaagaaaagcagaaggatagagatatcactatactgcttagcgagggcgatagagagcttctttacttgcatgacagaggcaggatacattcgaccgcccaagagtttaagaagagcggatgtggttgtgttcagcgtttcgacagccattataatgcattgttacgcacaagaaagagacgtatttcgatcaaaatacttgaacgtactagattgggtcttcggtgttcctcctccccctcctgctccttcttgcgaaacaacctagagacattcacttttaacctaaagatctttctgatgtgggacagaatttggtggtagaatgctcatttagagtctctaggagttttgttttgggtcaattttgtataccacaatccatttgacaatttttgtccatcttatgtggacacaccaatatgtaatctggtagtcttacatgttctacaaagttaaaataaaacgaagcta

SEQ ID NO: 5 - DNA, 2274 bp, Arabidopsis thaliana
acttcaattgcaaacccttgacaaaactctcgaagcttggatcccgatttctccaagcagccatggctccgaaatcgaaagaaaaatccaaaacatcgaattcacaaccacctccagcaatcgaagatctcttcacttccctccaccaacatatcaaggatactaaatatgaagaagccgtcaaggtcgctgatcaagttttgtcgattgtacctaccgatgaggatgcgatccgatgcaaagttgtggctctgataaaagacgataagttcgatgattatctaatcaaagacgttaagatcaatggtgctctctccgtcattaactcgttccagaagcttccaatcgatctaggttttcacaaggcgtattgcttataccgtgtaaacaagctagatgaggctttggtgtgtttaaaaggtctcgagagagatacagatactttggttttggaggctcagattttgtaccgtttggggaaggcagatgcgtgtgtggatgtgtatcagaaactgaccaagtcccagattgagacgttagaggttaatttagtcgccgggttgatttcagctggaaaagcttctcaagtgcagaaaacattggagagtttgaagatcaaaccaactagtagttttgagttggcttataatactgcttgctctttgattgaaaacaataactatgctgatgctgaacaacttttgctcactgccaggagaattggtcaggaaaccctcaatgatgacgacatcgctttaaccgatgaagaaattgagattgagctggccccaattgctgttcaattagcatatgtccaacagatccttggacaaactcaagaatccaccagctcttatgtagatttcattaaacgaaatctggctgatgaaccttcacttgctgttgctgtaaacaaccttgttgccttgaaaggtttcaaagatatttctgatggcttgaggaagtttgatctgctgaaagacaaagactcccaaacttttcagctttctcaagcacttgatgcaaagctttcacagaaacataaggaggctatatatgccaatcgcgtccttctactcctccatgcaaataagatggatcaggcacgagaactttgtgctgcactgcccggtatgtttcctgagagtattattcctacattgcttcaagctgccgttttggtgagagaaaacaaggctgccaaagctgaagaacttttgggacagtgtgccgaaaaattcccggaaaagtctaagttggttctcttggccagggcacaaattgctgcttctgccagtcatcctcatgtagcagcagagtccctatccaaaatacctgatattcagcatttgcctgcaactgttgccaccattgtcgccctcaaagagcgtgctggagacaatgatggtgctgctgctgttcttgactcagcaattaaatggtggtcaaattcgatgaccgagagcagtaagcttagggtattgatgccagaggctgctgccttcaagctaaggcatggtcaagaagaggaggcttcacggctatacgaggaaattgtgaaaaaccacaatagcacagatgctctggttggtcttgtgactacacttgctcgtgtcaatgttgagaaagcagaaagttatgagaaacagcttaagcccctaccaggtttgaaggctgttgatgtggataaactagaaaagacctatggtgcaaaacccattgaaggcgctgctgcttcatcgagtcaggaagaagtgaagaaagaaaaggcgaagaggaagaggaagagaaagccaaagtatcccaaaggatttgatccggcaaacccaggtccacccccagaccctgaaaggtggcttcccagaagggaaaggtcaagttacaaacccaagaggaaggacaagcgagcagctcaaatccgtggctcgcagggtgcggtgaccaaggataaacaagaagcagctccttcaacttcaaagtcaaaccaagtggccagttctaaagggaatgcacctgcgccttcctctaaggcctcaaaaaagaagtctagaagatgaacgaaacaaccctttaagattgtttcatctgttctgagaaaacaaaaacaaagagtacttagccccaaaatttccattgttctttttctttttggattcatcaagttttagttgtcttgacccatttaagattttggttaatttctcgtttgcattgcctgaattcttttgctttgatgaatcggttaatagtaaaacactaaaactaaagaaatgg

SEQ ID NO: 6 - DNA, 2010 bp, Arabidopsis thaliana
gagtatcagctaactgatttacagttttcgattcgaaaatcttaatctccatttcattccttcgacatcttcacacaaaccctaatctcatttctggtaaatccgattttgggaaactctaatttgatctcgagatcgctaacaacgatggaagaagacaagcaaatgcacgaggagaaatcatctctggttaaagaagaaccggttcgtggagaagagcccgagattgagaaattgacagtggcagatgtggacgcgccaccgaagagtaccggtggttggggttggggtttctctggcttctctgtgctttccgatctccaaaaagctgcggaagatatttctcgtaatgctgcagcggtggcagagaaagcagcgaaaagcattgcagagatgggagaagtggatgaagactctgaatcttctgctaaggaagaagagaaaactgaagaagctgatacagagcaggatagtgatgatgagaatgcgaagttaaagaagtcagctcttgagagattggagggtgcaagtgaagagtcacttcttagccagggtttgaaggttttcgatgattcagttgagagtttcacttctggagcttggcaagcatttggaaatgcgttaaaagggggcacaagtttggtgcaaaagcttgaaaacagtgtccagcaaggttcttcgcctagggaagctggatctggtgcaccgtctctactagagacaggaaaagcattaactgcgaaaggaatgcaagtacttgaatttgtgggcaaggaaactatggatttactgattacagagactggtattggagctgagaaggatagggtagactttaaggatcaagtacttgaggaggttacatttgatcgatgcttttacatttatggtggtcctgagcagcttgaggaattggaagcattggctagccactatactctgttgttcaacaggagaaaggggaaattgtcaccagatcaaaaatcgctgtatgacgggaagctcaaacaaatccagcaacttttcagctttgctgatgaaatgagtggaagtaaagcagagtctgacaaagggaagaaaatagatatcaaaactgaaggcaatgatgatgacatgaagaatctgcataactcaagtgtcagcaaagctgctgatatggctactgggttcacaaatgctttagcgggactacacgtaaatgatatgatccagcgaaccggtggcaggcttgaatctcttcactcagaaggagttcatagactttcagagatgtgctgttttgcagtcacacatctgcttatcctcggtaagtccatgatatctcatgccaacaaagttcaggatgaagacactgaggcattgaaaatcgagtgggcagaggatcctacagagaaagctaagctgattagaggcaaggcagaaacaatggctggatatgttgaagcagtttccaatagctttataacaggaatatcagatgtatctgaaacatactcagctgcgattaaaggagttgcagctgctgattccaaagatgatcttctgaaaacatcgaccatgcaggaaaaagcaagcaccttcaacgatagtcttcgctctgaccaaaccacagctatcacaaagatccaggaagggcttcagtacctgtcctatgtcgtgatttctacctcgatgccctctgcctaatataataagagtcagattggtcttatttgtggtttacatgacttggatttgatttagttttctttctagttgtagatatatctctttcgctagctgctcttatggtaagtctttcccacttgtgctctacttctttgttgtctggatcttgaaagttttattaaatctaggaaccaaagattgaaagcagggaagcgattagtactttatcgaacttttgttagaaatatattgttgcttccagagtttttacttggaagttgattgtgttatatgtgaacgtagctttcaatatttgaattcatattgaaaagtggtttattt

SEQ ID NO: 7 - DNA, 1695 bp, Arabidopsis thaliana
ggcttctctcctcgcgttatctccttttgtcgatttagccctaacctatacggctgctacatccagatttcctcatcctctattagggaagaagaaccaaaaccctaatcctatcttctcctcttataaatcgcttcaacaacagtttctttctcttctgatttgatccatgatttctcatctggaaccctagtttatacatccatcgggtgttactgttctttatctgggcaatcagtggtgtttttgttccttttgtatatctgtcgagacttctaggtgtgaaatcaaagcttgtttggtttatatcgatcttggttttagctgaatcgttgttaagatggctggaggtggaaacaggagagatgaaggatcgatcacgatccagagcactaatttgtttgcagcattggacactcgtaagaagaagaagaagtctgacaaggcagggaagagcaaagggtcttctaagtcacgagagccagagaaggagcctgagcctcaggtctattgggctcctacgcctttgaaagttaagtcttgggctgatattgatgatgaagacgacgatgatgactattatgcaaccactgctcctcctcagtctggttggagtacttctctgccttcccatactgattccaaagacgttcatgttgaggaaagtgaaagtgaggaagatattcttgatgaaggtgatgatgatgtggaggaagagcaggaacaggaaacagaggtacaggttcatccagagcctgaggtgaagaaagctcctgaagttcctgcacctcctaaagaggcagagaggcaactttccaagaaagagaggaaaaagaaggaacttgctgagcttgaagctttgttggctgattttggagttgcccccaaggagaacaatggcctagaggaatctcaagaggctggacaagaaaagaaagaagatgtcaatggagagggagagaagaaggagaatgcagcaggtggggagtcaaaggcatcaaaaaagaagaaaaagaaggataagcagaaggaggtaaaagaatctcaagagcaacaagcaaacaacaatgccgatgctgtagatgaagctgctgggtctgaaccaactgaggaagaatctccaattgacgtcaaggaaaggataaagaagcttgcatccatgaagaagaagaagtcaggcaaagaggtggatgctgcagctaaagctgctgcggaggaggcagctgcaagacgtaagaagctggccgcggcaaagaagaaggagaagaatcactataaccaacagcctgtgcggtaaaatcctgaatcaccaccattttgatcttgatggaaatgcaaatatgaacatgtatttcgccgtatattgttcatatgagtctctgtcctaataaatcttttgaagggtctggttcttagagttaaagacattgaatcctttttctagtcttattacaatgaacaggctaaagacaaaactactctctggagattttcatttctttttgaaacacctttgttttcttaatatcagaccttttttaggttcattatgtcttcaatcagcttcttatgtatggttcgatggtgttattttcttctttttttcgttcagttgcctgtgttttgattcatgccttgtcacaaaatcttttttggttatatgttccaaagtgattccccacttgagggtaatgt

SEQ ID NO: 8 - DNA, 2867 bp, Arabidopsis thaliana
atgtgtatgtaaaatggttgccggagtccatggcagccaaaacttgggcgattcaaagagagaatctttgatttattattcaaatgccaaagatctcaactttttttatttattaattagtcacaagtggcagttcttcgtggtcgccactacctaatcataaccatcgacaggtttatagagaagaactaggcaacgcatcgccatggatcaatcatcctccatgcattgactttttttagatcggaggaaaaaagtatgcaaatttagttagggttttgaaattcgaaaatcgagatgcggtgggatttgatcacggcgattgtggctgcgctggtggtctcggttttggctgatgaatcgggtcaaatggcaccgtatcggatccacacgctcttctcggtggagtgccagaactacttcgattggcagactgttggtttgatgcacagcttcttgaaatccggccaacccggtccgattacccggttattgagctgtaccgatgatcagaagaagacttacagaggcatgaatctcgctcccactttcgaagttccctcttggagcagacatcctaagaccggtgactggtacccagcaattaacaaaccagttggagttctttactggcttcaacacagtgaagaggccaagcatgtggattgggtcgttattcttgatgctgacatgatcattcgaggtcctatcatcccttgggaactcggtgctgaaaggggaagaccctttgccgcccattacggctacttggtgggctgcgataacctccttgtgcggttgcacacaaagcatcctgaactctgtgacaaagttggcggtcttctcgctatgcatatcgacgatcttcgggtcttggcccctctctggctgtcaaagaccgaagacgttcgccaagatacagctcactggaccaccaatcttaccggagatatttacggcaaaggttggatcagtgagatgtatggttactccttcggtgctgcagaggcaggacttaagcacaagattaatgacgacttgatgatatatcccgggtatgttccacgagaaggtgttgagcctgttcttatgcattatggtttacctttttccattgggaactggtctttcactaaactggaccaccacgaagacaatatagtctacgactgcaatcgcctcttccccgagcctccatatccaagagaggttaaaataatggaacctgatccgtctaaacgaagaggtctaattttgagtttggaatgcatgaatacattgaacgagggactcatactgcgtcacgcagaaaatgggtgtccaaaaccaaagtggaccaaatacttgagctttctgaagagcaaaactttcatggagttaacaaggcctaaactgcttgcaccaggaagtgtacatatcctgccagaccaacacgagccgccacccattgatgaattcaaaggaacttatccaaagattcacacactgttttctactgagtgcacgacttatttcgattggcaaacagtgggcttcatgcacagtttccgccagagcggccaacctggaaatatcactcggcttctcagttgcacagatgaagctcttaaaaactataaaggtcatgacttggccccgacgcattatgttccttcgatgagcagacatcctctaacaggcgattggtacccggcaattaacaaaccagcagcagttgtccattggcttcaccacacgaacattgatgcagagtacgtagtaattcttgatgctgacatgatccttcgtggacccatcacaccttgggagtttaaggcagctcgaggccgaccagtttcaactccttacgactatcttattggatgtgataatgaccttgcaagacttcacacgcgtaatcccgaggcttgtgataaagttggtggagtcattataatgcacatagaggatctccggaaatttgcaatgtactggttgcttaaaacccaggaggttcgagcagacaaagaacactacgggaaggagttaactggggatatatatgaatccggttggatcagcgaaatgtatggttattcatttggtgctgcagagctgaatttgcggcatagcataaacaaagaaattatgatttatcccgggtatgttcctgaacctggtgctgactatcgagttttccactacggtcttgagttcaaagtcggaaattggagctttgacaaggcgaactggaggaacactgatttgatcaacaaatgctgggcaaagtttccagacccgcctagtccttcggcagtccatcaaacagacaatgatctacggcaaagagaccttctcagcattgaatgtggacagaagctaaacgaagctctatttctgcatcacaagagaagaaattgccctgaacctggatcagaatcgactgagaagatctcggtttcgagaaaagttggtaacattgaaacaaaacaaacccaaggaagcgatgaaacaaaagagtcaagtggttcgtccgagtctgaagggagattcagcacgttgaaattatgggtgattgcgctgtggttgatatctggagtagggttcttggtagtgatgctattggtgttctcgactcgtagaggcagaggaacaacaagagggaaaggttacagaaacaagagacgaacttcttactcgaacacaggtttcttggacactaaatgatcatttctgttagaatctgagcaatgtgtagatacaaacaactaaaccaaaaaaaggtgagacattttgcttcccccaaagtcatataggtttgtttgtattcttttaaacattattttttgtcaagagttataaagtcggattgtaattttcaaaaacac

SEQ ID NO: 9 - DNA, 1389 bp, Arabidopsis thaliana
gtttatcaatctcacatcgagacgaaattagagctactcagacttgttctattaaactgttaccttctccagacaaagcgttacctttttttttggtccgtacgaggaaaaatctaggagacagagctatttgttcgaaagatgcaacttttaaatagctgttgtggaaaaggatttgatgggaagaagaaagaaaaggaagagccatcttggagggtattttcactgaaggaacttcatgcagccaccaacagtttcaattacgataacaaactcggtgaaggtcgatttggtagtgtctattggggtcagctatgggatggctcacaaattgcagtcaagaggttgaaggaatggagtaatagagaagagatagattttgctgtggaagtcgagattcttgctcgtattcgtcacaagaatttgttgagtgttcgtggctactgtgctgaaggacaagaacgtcttcttgtgtacgagtacatgcagaatttgagcttggtttcacatcttcatggccagcattcagctgaatgtcttctagattggaccaagcgaatgaagatcgccataagctctgctcaggccattgcctacctacacgaccacgcaaccccacatatagtccatggagatgtgagagctagcaatgtgttgttagactctgaatttgaagctcgcgttacagattttggttatggtaagctgatgccagatgatgatactggagatggagctaccaaagccaaaagtaataatggatatatctcaccagaatgtgatgcatcaggaaaagaatcagaaactagcgatgtgtacagttttggtatccttttgatggtactggttagtggcaagagaccactcgagaggctaaatccaacaacaacgcggtgtataacagagtgggttttaccacttgtttatgaaagaaattttggtgaaatcgttgataagaggctgagcgaggagcatgtggcagagaaactgaagaaagtagtcttggtggggcttatgtgtgctcagacagatccagacaagagaccaacaatgtctgaagtggtggagatgctggtgaatgaatcaaaggagaaaatatctgaacttgaagctaatcccctcttcaagaatccatatagcagcaacgaaaacaatagagagcatgttgcagaggaaagctcagatgtgatcttagaagataaagatcatcaacaacaacaagaatagcaatggttaggcacagtaattcgtttggcagattatttttagaggtcttgcttattttttttagtgtgtttcttggttcataaaattgatttgatcattactgatactggagtttgtaaggtgtggtattggcacatataagattgaaacttttattctgga

SEQ ID NO: 10 - DNA, 1405 bp, Arabidopsis thaliana
atttctatcttaatataaaaaaaactcgtttgatccatccgtcttctctcagattagttttttaacatcttggctgggtttcgtgtgatttcgttttggatatggttgttcggattcttgttaccatgattcggctatagtgtttgtcgcctctgattgtcccaagcatcgttctttactgatttttagatagctctgagatctgtctctgcgattcgtcggatttgaattcgtttttttttttgggtagctcttggatttcttcttctagggtttccaagaggatagagaaaatgcgggtgtcctctgagatactccttctttctttggttccggcgttgactttttatcattctggtttaagttctaatcgtttgaaacctcttcaaaagagtgattggcgtggtaatcttagttaaacaacaatttctctgtttttttgtttctccgatctcttcagatcttttcaattttctcttcggtttggtttgttttcacgcatttcctagctcggagtaagctaatcgaagaaaacaagcttgttattgatcgatctttcggtttttgttttgacgttttgtgtgaacgagttacttttggatatgagctctgtctgtggtgggttggatttcaaagatgcagagagcagctctgcttccagtcccattatatgttctactggcgtaaagcatatctcttgtgttggatctgatgatgctcaagagtctgatggtgatgatagtggttatatacaccaaactgtgattgaagaatccaaagacaaggcgatcagcgaacccatccctgagtctttacctctcaattctttggatgatgaaagtgaagataagaaccttgctactgcattgcaagacatgttctctgagagtatgagtgtggttactctgattcctgccattaaaggtggtcgagagaagcatggcaagtcactcgagaagctcagtgtgtcatgggctgaagatgtgtatgatcctcctccctccattgtctctcacacaagaagcaagaaacagcaaccgcagaaatcaaagagcaaagacaacctgaagaagaatggaaagaaaggacaaaagggaagcagcaattcccgcagcagcaaagacaagaagcagatttcttcacgcagcagcaaatacagtcgtgataagtttgattggacaacacaaatgtctgttctagctgcatcttcttgaatctgtgtggtatgaccaaggctcttgcgtcttccttgctcttgtctctctctctctctctttcttgtttataaataaaagatttgaagtgaaaacttttctcgagtttcagaacgactattgttgttggtacggaattgattttgtttttactcaatttaccacttttattgtgaagtttttccctctct

SEQ ID NO: 11 - DNA, 1465 bp, Arabidopsis thaliana
attctattcgtctcacttagtctgagttttaataatttattttccatttttctgtacagccagtcctcgtcttgctggcctgcaataataatgtctctgatcggccgcctcaatcttggtcggcgcttctgcaccgccgtgccaagaagatcggaagacataatgtcaaacccagattgccgcccttctgatctatgcttgagggtctcgtacttgatcagatgcgttggggatctcgacacggcggcgaagtacgctcgtttggctgttttcaccagcatcaaatcggagtcaacaacaacaatatgtcaatccatcatcggaggcatgttacgggataaaaggctcaaggacgcttatgatctctacgagttcttcttcaatcagcataacctcagacccaacagccattgctggaactacatcatcgaatctggtttccaacaaggtcttgtcaacgatgctctgcatttccaccaccgatgcatcaattccggtcaggtccacgactacccaagcgacgattctttcaggatcttgactaaagggttagtccactccggtcggttggaccaagccgaagcctttcttagaggcaggacagtcaatcgaaccacctacccagatcacgtggcgtacaacaatctgattcgcgggtttttggatcttggaaattttaaaaaggcgaatctagtcttgggcgaattcaaacgcttgtttttgattgccctatccgagaccaaagatgatttgcaccattcaaactatgaaaacagagtcgcattcctgatggccacattcatggagtactggtttaagcaaggtaaacaggtggaagctatggagtgttacaaccgctgtgttctatcaaacaggttactggtttgtgccgaaacgggtaacgcccttttgaaagtcctgctcaaatacggtgaaaaaaaaaatgcttgggcattgtaccatgaactcttagataaaaatggaaccggtaagggttgcttggactctgataccattaagataatggtggacgagtgctttgatatgggttggtttagtgaggctatggagacctacaaaaaggcgagacccaagaacgactacctcagtgacaaatacattattacaaggttttgcgaaaacaggatgttgtcagaagcagagtctgtttttgttgattcacttgctgatgattttggatatattgatgttaacacttataaaacaatgatcgatgcttatgtgaaggctgggagaatacatgatgctataaaaacctccaacaagatgatcgatgcaactctaaaggaggtctcccatctcttttgaccattcctcgtcacttggtgatctttatttaatgtccctttttaatatattttttatcagacaataatagatttttgtttgtttttattggtcggccaatttatccactagatgaagacataaacgtttacagaac

SEQ ID NO: 12 - DNA, 2873 bp, Arabidopsis thaliana
ggaaaggagcgaaatttgcagaagaaacaaagcataaccccccagagaaagagagagagtttctcccaacaagatcaaacttcgaactctacgagaactactattatccaaaacgcgaaatagagagacagagatttcataaatttcttactttttaaccccaaagttcttttccagacagcgttttcctctgtcctttgctctttgtgggtttactccttcttccggtttggatatcccgagctagtaaagaagggatccagtagcagaagctgaagctaataaacccaatcatagagaaagctctctgaacaaaagacattttctgggtttgttttaattaaaaagaaatggccgattcgaccaaagtaaggctagttcgttgcccaaaatgcgagaatctcttatcagagcctgaagattctccctttttccagtgcggtggctgcttcaccgttcttcgtgccaaaaccaaggagcgtgaagcagattctgtttcagtcaagtccgttgaagatacagccaaaccggtttcagctagttccccagagaaagcaatattggattctagtgaaacttcatctgactctgatgttccatctttgagacaccaccataatgttgttcctgttgatgttgagagtgatccttgttcaaaaccttcttctcttgaacaaggtaacagatctatattattaggggataaagatgaccttaaatctcaatcagggagacaacaagattcgggttgggatcggtttaggaaaagaacaaccaagagatgtgattctcaaagtgtcatcaacagattatccacttctaggcatccttgtgatgaaggcacttcttcttcagcaaactactttccagattcactccttgaattccagaaacacttgaaagatcagagcaacgaagcaattgagcaagaccgagctggacttctgagacagttagaaaagatcaaagaacagcttgttcagtcttgcaatgtggcaactgacaagtctaaagaacaggctcctagttcttcgtccgcctcggggttgaacaaggcgcctccaatgcggtttcacagtacaggaaatcacgctgttggaggtccttcttattaccatcaaccacagtttccttacaacaacaacaacatcaatgaagcccctatgcaccacagtctgatgcatccctcttatggagaccctcataggttcccgatacacggaagaggtcctcatccctacttctcgggacaatatgttggtaataataacaacggtcatgatctctttgacgcatacccgcagcaaaacgggcattttcatcactcatcttgctcttgttaccactgttatgataataaatactggcgaggttcagcaccggtggtccctgatgcaccctataatgctggtttttatcctcatgagagcgttatgggttttgctccaccgcataatcctagaacttatggttctcgtggtctacagcctcatggaagatggcctagtaacttcagtgatgctcaaatggatgctctttctcggattcgtcctcctaaagttgtattatcaggcggatctcgtcatatccgccctttggcaggtggtgcaccgtttataacctgtcaaaactgctttgagcttctacaattgccaaagaaaccagaggctggtacaaagaaacaacagaaagtgcggtgtggagcatgttcctgtttgatagatttatctgttgttaataacaaattcgttctctcgacaaacacagcttcaacgagacaaggagaagcccgtgtagctgctgattacacttctgatgactatgatcttcttggttatgtatttcactcgttggatgatgaaccaagagatcttccgggattgatttcagacaagtctcaagatatgcaacacgttcattctcattccgccagcctttccgagggagagctaagctcagacagtctaaccgctaagccactagctgaagctcacgaaaactttgttgattactcttcgatcaatcatgaccggtctggagcaggcagccgtagctctcgttcagaacacgacaaggtcacactgagcaaggcaacagccatgagacagaactccatgaaagaggtttcacttgcaagtgagatggaagttaacttcaacgactactctcatcgtaacagtggagtatctaaagatcagcagcaaagagctaagaagagcggattcgcgagcattgtgaagaaaagcttcaaagatctgacaaaatctattcagaatgatgaagggaacaaaagcaatgtttcgataaatggacatcctttaaccgaacgtctgctgagaaaagcagagaagcaagccggagtcattcagccaggaaactactggtatgattacagagctggattctggggagtaatgggaggtccaggtcttggaatattaccgccattcatagaagagcttaattacccaatgccagagaactgctcaggtggaacaacgggagtgtttgtgaacggaagagagcttcaccggaaagatttggacttgcttgcgggtagaggacttcctccggacagagatagatcctacattgttgacataacgggtagagtcatagatgaagacaccggtgaagagctcgattgcctcgggaaactagccccaacgattgagaaattgaagcgtgggtttgggatgagacttccaaagagaactacgtgaaagaagataagaggagagatatgtatttagctgaatatcttttgtttagaaagagagagcttatgtatgtatttagaaattggtattatttgcttccaagtttaatttttagacttcttcaatcaaaatttgctacaacgaacaattgaa

SEQ ID NO: 13 - DNA, 1327 bp, Arabidopsis thaliana
gcgtctgtgtttgtcttcctaatccgtaattgtgtctcttctcttcttctggacaaaaaaaaaatggaatggatacaatcactgcccaaaatcgagcttcatgctcatctcaacggttccattagagactccactcttctagagcttgctagggttcttggtgagaaaggcgttatagtgtttgctgatgttgaacatgtcattcaaaaaaatgatcgatctttggttgaagtcttcaagttgtttgatttgatccataagctcactactgatcacaaaactgtgacaaggatcacaagagaagttgtggaagattttgctttagagaatgtggtgtatcttgagttacgaactactccaaagaggagtgattcaataggtatgagtaaacgttcttacatggaagctgtaatccaaggtctaagatctgtcagtgaagtcgatattgattttgttaccgcatctgattctcaaaaactgcacaatgctggtgatgggattggaagaaagaagatttatgttagacttcttcttagtattgatcgtagggaaacaacagagtccgcaatggaaactgttaagctcgcattggaaatgagagatgtcggggtagttggtatcgatctttcggggaatcctcttgttggagaatggagcactttcttgcctgcattacaatatgccaaagacaatgatcttcacatcactcttcactgtggagaggttcccaatccgaaagagatccaagccatgcttgattttaaaccgcatcggattggacatgcctgtttcttcaaagacgaagattggacaaagttgaaatctttccggattccggttgaaatatgtttaacatccaacattgtaaccaaatcgatatcttccatcgatatacaccatttcgctgatctttacaatgcaaagcatccattgattctatgcactgatgattttggagtattctccactagcctctccaacgagtacgccctcgctgttcgttctcttggtcttagtaaaagtgaaacctttgcattggctagagcagccatagacgcaacatttgcagaagatgaagttaagcaacaacttaggttcatttttgattcagcctcgccagagcacgtttagtgagactgttgagtgcttcagattttaccggtttacttcattttgttggtttataccaaaccgaacaaaaggtgttttggttcattggttggttcgaaaaaataacattcatctcgaatattgattgtaataatataattataatttaaaattttcaaacttttgttctctgttaaaaataaaaattgatttcaac

SEQ ID NO: 14 - DNA, 957 bp, Arabidopsis thaliana
attcagaattaagaaaccctagacgacgatatcgagatcgatccaaccaactctgcagctaacatctctaaggtttgattttccgatgatgagggtgatggagcctccgcctatcgaggaggcagctttggccccagtatcggtcttctgggacataaaatcgtttccggttcccgatggctatgatgctcgactggtgggtccgtgtatcaaacggaatttgaggaagttaggctacacaggtcctatcaccatcactgccgttggcgtactatcagaggtccctcgtgacatccttaaagcagtgtattccactggaatctctcttaaggaggtcattaaaagtccgacaaacatgtatgctcttttccttgagtcctctcttcttcgtactccacctccagctaatatgatggtcatatcccgtccaccatcctacattcctcgacacttctcttctatacgtgacaaggaccgtgagaagggtcgctacactattttcccgtttccattcggagaaatgcctttgactcttgcaatcagcctctgggaagacttccttctggcagatccagtagctcttgaggaggagaagtgcagtgaaatgggtgatccagcctcctggttctgcgctgtgtgtcatcattttgctgccccagatcttgttactggccgggacttgatagtttcatcacgcatctctattctcgacaacatgcacaactgcttcaattccaaactgtcccctgtagccctggctctgtatgcaagcacgcagctctggctcccagcattaggtttatatgcgttaacaaaaaaattgaggaggaggccagagctgaggctccccgtgatacaactagtcaattaacttaaagttttacttactgtcattatgtggtgctgttagatttggatgcattaatttttaattaagtatataaaaaaaattcatag

SEQ ID NO: 15 - DNA, 3910 bp, Arabidopsis thaliana
tcattttgaagtgcacagatatcaatcgtctctctccctctctctctgtgagaaagctttctgattaagctttcgtcgtctcctccattgcaaaatctagctcgatctgtgaaggtttctctgagttcttcaaaaatctcttctagagaaagacttcattagctcaattttagcaacttcctccacctccttttactcacactgtgcttcgatttcaacttcgcatttcacaatgatccccaacggagaattgagattacctgctctcaaggtccgtgaagaccgcgtgtcaccctcagctcctattccggtcaccagaaccctagtggctgatactgacgtcacttccgatgacgatatgagtacaaattccgaggatgtctctctcgattcgtctcccgagaacagtagagtgtccagtgccgttggtcgcagctacgggagaaattcttcttattatacttactccgaggtgagctcatcaagagagactttggtcggtgcgcgcgaacagacgggacctagatttgatggtgatacggaggaagatgaatccaccgattcagcttctagcacgcaattttctccgccgccggcagctgggaggattaacgacggcgtatctcaggagtttgatgagacgttttcttctgaagaagtaagcgatattcccagtgcccctccattttccggggcagcagaggaatctgaagaaattaaaccagcaacttcaagcgttcaagtttcagaagtcaaaacaggagattgtgtagaaagtagaaagactggccactttactagacctagtgcagcttctgagtcatctgggccacctgatcaacatccagctcggcttcctacttttcatgcaagttctcgtgggccatggcatgctgtggtttcctatgatgcatgtgtacgactttgtctgcatgcgtggtcaaccggttgcatggaggctcccatgtttttggaaaatgagtgtgctcttctacgagaagcatttgggttgcagcaactccttttgcaatcagaggaagagcttctggcaaagcgatcttcacaagctccgcacgaaggagttgcaccaaaacccaagaaaaacattggcaaaatgaaggtgcaagtacgacgtgttaaaacagttatggatggtccaaccggctgtagtatatcatctttgaaaccatcgttgataaagtttgagaaaatccggattcacttttccaatatgtcaacacgcttattttctggatggcgggctctaaggaagatccatgtccgtgtaccagccaatggttcttctcttcctcgtcaaagtctggcatatgttcatgccagtacacagtacttaaaacaagtttctggtctcctgaaaaccggtgtcacaagtctacgtaataattcaacatcttatgatattgtacaagaaacatactcgtgtaagttaagattgaaaagcttagctgaagataacgccattatgatgcaacccggatctggtgaaagccatgttttctttcctgatagtcatggagatgatctgattgttgagatcctggatccaatggggaaggattttgggcgtgtacttgtgcaactagctaatatttctgaagattcgtacgtttcaagtgattctaatgaagaaaccatacaggctgagaaacttcgctggtggtctgtttttcgtgagccagaacatcaacatgtgggaaaactccagctctatattgactattcagcaagttttgatgataacagccatttgaagtgtgcttctgttgcggaaacagtcgcatatgacctagtcctggaagtggccttgaaaatgcagcgatttcagcaaagaaacttgttgttatatggttcatggaaatggcttttggaagaatttgccacctactatgggatttcagatgtctacaccaagctcagatacttgtcctatgtaatggatgtcgctacaccgacttccgactgtctccatttggtacatgacttgttaacacctgtcatcatgaagggaaatggcaagagcgccttgagtcatcaagagaatcggatcttgaatgaaatcaaggaccagatcgagcagattctaaaactggtctttgagaattacaaatctcttgacgagtcgtcattttctggaatgattgatgtggtcaattctgcgtcaggtgttccagcgccagcactcattcctgctgtgaaattgtacacgcttctgcacgatgtcttatcacccgaggatcagactcatctttgtcattatttccaggcagcagcaaagaagagatctagaaggcacatgggtgagacagatgagtttgttgcaaacaacagcgagcccaatttttgggatatgtctgcaatgtcggctgcataccagaaaatgacaatggcctgcaagaatgtaaagaatgagatctatactgatattgagatccaaaatgaagatatacttcccagctttcttgaccttccaaacctgtcagcgtctatatatagcactgatctctgtaatagacttcgagcatttctcgttgcttgtccgccctctggcccttcaccaacagttgcagagctcgtgattgcaactgcagactttcaacgtgatctttccagctggaacattagtcctatccaaggcggtgttgatgcaaaagagttgtttcatctatatatcatgatttggattcaagataaacgcctttcattacttgagtcctgcaaacttgataaggtaaaatggtctggagtcaggacacagcattcaacaactccattcgttgatgaaatgtacaagaggctgaacgaaaccattcaagactatcaagttatcatttccagatggccagaatatatctttgttctggagagtgccattgctgatgttgaaaaggcaacagtggaagctctggagaagcagtatgcagatgtcttatcacctctcaaagaaaacttggctccaaaaaaactaagcttcaagtatgtccaaaaactgaccaaaagatctgtgattccatatgtagtcccggatgagctgggcattctattaaactccatgaagaggatgcttgatgttctacggcctaatatagaggctaaatttaaagcatggtcttcatgcattcctgatggtgggaatgcagctcctggtgatcgtctttctgaggtgacagtgatgctcagagccaagtttcgtagttaccttcaggctgtggtcgaaaaacttgtagaaaatagcaagctacaaaaaacgacaatgttgaagaagattcttcaggactctaaagaaagtgttggagaatcagacatcagaagcaaaatgaataacctcaaggagcagctcaccaacacagtgaatcatctacactcggtttgtgagacgcatgtcttcatcgcattgtctagaggatattgggatcgtatgggacagattgttttaagctttttggagaacaggaaagagaacagagcttggtacaagggttctagagttgctgtctcgatattagacgatacatttgcagcacagatgcaacagctgcttggcaactcgctaagagagcaagacctggagcctccgagatcgatcatggaggtccggtcgattctttgcaaggaccctgcagataataaagccaaatcgttctactactgagcaccttaacagctaaaaatgcttgaaagatttcagatctcatttgctcgtctgcttgaagcttcaagtattttacttggtggagcaaatcgtggaaaccttgagaaagctttagatgtataagaaagtacaatgggtaccacatctttctttagtgctaatcaaatgtcaatatattacaagactggcatcacatctgatacgaattgtaataagagttggaagtcaaagttttactac

SEQ ID NO: 16 - DNA, 1915 bp, Arabidopsis thaliana
actgattgttgttgctgtgatttcagattctctccaacgttatctatttcgattagctcaagcctcaaggtgaagcttgaagcccatcaatggcggatgggtagcttctggtctccttgaagatgaatcggatttcagctatttctactcttgtcactcctctccctcttcttccgtcgtgctcctttgttccgacacgacggtgttatcctcgcagagctactccttattccaggcgaatcaatctcaagcctctcacttctcgcattgttctcctcacgcgccgtcgtcagcttggtcagatcgtggaggaggtagaagccgctaagaaacggtatgggaggctcaacacaattgtgatgaactcagttctcgaagcttgcgttcactgtggaaatattgatttggctcttcggatgttccatgagatggcggaacctggtggaattggagtcgactctattagttacgctactatcttgaagggattgggtaaggctcggaggattgatgaagcgttccaaatgctggagactatagagtatggaactgctgctgggactcccaaattgtcatcatctcttatctatggtctgcttgacgctcttatcaatgctggagatttacgtcgtgccaatggtctgcttgcacgatatgatattttgcttctagatcatggtactccgtcagttcttatctataacttgctgatgaagggctatgtcaactcagaatctccgcaagctgcaataaatttgctggatgaaatgttacgccttagattggagccagataggttgacctacaatactttgatccatgcctgcattaagtgtggcgacttggatgcggctatgaagtttttcaatgatatgaaggagaaagcagaggaatattacgacgattttcttcagccagatgttgtaacctacaccactttggtgaaggggtttggggatgcaacggatctgttatcactgcaggaaatttttttggaaatgaaattgtgtgagaacgtgttcattgaccgaactgcatttacagcagtagttgatgccatgctgaagtgtggttcaacaagcggggccctttgtgtatttggtgagatattgaagagaagtggagctaatgaagtcttgcgaccaaagcctcacttgtacctgtctatgatgcgtgcgtttgctgtccaaggggattatggaatggttagaaatctgtatcttcgcttatggccggattcttcaggatcaatctccaaggcggttcaacaagaagctgataatctcctgatggaagcagctctcaatgatggccagctcgatgaggccctagggattcttttaagtatcgtgagaaggtggaagacaataccttggacgactagtggaggcatggctgctgtccgcctagaaacattgttggggttttccaagtctatattgcgtccacatctacttagtaaggtgataccaagtgaaccaatagaaagcattatgattcgatttgaagccactcggccactgctaggcactctgcagttgaagaatgtggccatgcggtttttcaaggagcaagttgtaccaattgtagacgacaggggaagctgcataggccttttgcatcgggaggattgcaataaccttgatgcgccattggtctcaatgatgagaagcccgcccacatgtgtgagtacaacaacatcgattggtcgtgtggtagatctagttttggaaaagaagcttaagatggttatagttgttcactgcgggaattttagtgggagcggttatagctcaaaggcagtaggagcttttacaagagcacaattgtatcggctatttgaatcagaacaaaagctgctttagtgaatgtaagtaatattttatcgcttcttatatgatttagttctttcaat

SEQ ID NO: 17 - DNA, 3852 bp, Arabidopsis thaliana
aaagaagctttctttaaacaaagaagttgatttgaacattctacagtttcatgatttcagctctgtaactgtatagctatagtcctctgtgtgccaaaaaggactagctcaaattctcctgtgtctcttatatggtatggctcaaggcagggagcgaattcctgagcgatggacctatgatgtgtttgtaagtttccgtggagcagatgtgcggaagaactttctgagccatctttacgattctctcagaagatgtggtataagcacattcatggatgatgtggaattgcaaagaggagaatatatttccccggagctactgaatgccattgaaacctcgaaaattctcattgttgttttaacaaaggactacgcatcatcggcttggtgtcttgatgaacttgttcacattatgaaaagccacaaaaataatccctctcacatggtttttccaattttcttgtacgtggacccatcagacatacgctggcagcaagggtcatatgctaaatcattttctaaacacaaaaacagtcacccattaaacaagctaaaggattggagggaagctttaacaaaagtagcaaatatatctgggtgggacatcaaaaatcggaatgaagcagaatgtattgcagatatcactagagagattctcaaaagactgccctgccagtacctgcatgtaccgtcatatgctgtaggtctgagatcacgcctacaacacatttcttcactactgagcataggttcggatggagtccgggttatagtgatctatggaatgggtgggatcggtaaaacaacattagcgaaagtggcgtttaacgaattctcacatctttttgaaggatcaagtttcctagaaaattttagggaatattccaagaagccagagggaagaactcatctgcagcatcaacttctctctgacattttaaggaggaatgacatagagttcaaaggccttgatcatgcggtaaaagaaagatttcgcagtaaacgtgtacttcttgtagttgatgatgttgatgacgtacaccagcttaattcagcagctatagatcgagattgctttggccatggaagtaggataataattaccacaagaaatatgcatttgttaaagcaactaagagcggaaggaagctattcaccaaaggaacttgatggtgatgaatctcttgaacttttcagttggcatgcatttagaacaagtgaaccaccgaaagagtttcttcagcactcggaagaagtagttacatactgtgcaggactacccttggctgtggaagtcttgggtgcttttctcatcgagagaagcattcgtgagtgggaaagcacgttaaaattgttgaaacgaatccctaatgataacattcaagcgaaacttcagataagttttaatgcgctaactatcgaacagaaagatgtattcttggacattgcttgttttttcattggggtggatagttactatgttgcctgcatattggacggatgcaacttataccctgacatagtactcagtctgctgatggaaaggtgtctcattactatttctggtaacaatataatgatgcatgatttattacgagacatgggaagacaaattgtccgagaaatatctcccaagaaatgtggagaacgtagcagactgtggagtcataatgatgtcgtcggtgtactgaaaaagaaatcaggtacaaatgcaatagaaggacttagcctgaaagccgacgttatggatttccagtacttcgaggttgaagcatttgcaaagatgcaggagctgagattgttagaacttagatatgtagatctcaatggaagctatgagcatttcccaaaagatctacgatggttgtgttggcatgggttttctttagaatgttttcctataaacttaagcttggaaagtttagccgctttggacttgcagtacagcaaccttaaacgattttggaaagctcaatcgcctcctcaaccagcaaatatggtgaaatacctcgatctcagtcattctgtctacctcagagagactccagatttctcttacttcccaaacgtcgagaagcttatactgatcaattgcaaaagcttggttttggttcacaagtcaattgggattcttgacaaaaagctggtactattaaatctaagcagttgcatcgagcttgacgttctccctgaggaaatctataagttgaagtcacttgaatctctctttctctcaaactgctcaaaacttgagagactggatgatgctttaggggaattggaatccttgacaactcttcttgcagattttacagctctaagggaaatcccctctacgatcaatcagctgaagaaactgaaaaggttatctcttaacggctgcaaaggtttattgagtgatgatatcgacaatctatattctgaaaagagccattctgtttctctattgcgtccagtctcattaagtggtttaacctacatgagaattttatctctaggttactgcaatctatctgatgaactgatcccggaagatattgggagtttatctttcctccgggatcttgatttacgaggcaacagtttttgcaatttgccaacagatttcgctactctaccgaatctcggtgaactcctattgagtgactgctcaaaacttcaatccatccttagtttacctagaagcttattatttttggacgtaggaaaatgcatcatgttgaaaagaactccagatatttctaaatgctcggcattgtttaaattgcaactcaacgactgcatcagcctttttgagatcccagggatccataatcatgaatacctgagtttcatcgtcttggatgggtgcaaactcgcatctactgatactactattaacaccatgcttgagaattggcttaagaggaaccatgaatgcatatatatcccagtcgatcgtccaaacgtcattccaaactgggtttactttgaggaggagaagcgttcattctctattacagttcctgaaactgataactctgataccgtggtagggttcaccttatggatgaacttcgtgtgtccaatgggatacagctccatatacccccgggctatcatagtgaggaatcttaccagaggcagtgcatggatacatagccttaagaattcgaaaattcggattcagatgaatgccaaccttttgaccaacgattttcacatagtaacaggtgacgaaatagaagttgatgttgattgcgatgatagattcacgattctagcaacaggaattgctctttgttacaaagcaagagactcctcagattttagctttggtgatattaagtttacatacgaagaagatgatcttggctatgctagtaatggtatatatttagattgtcatcgatcaaagtatggacatgattcattacaggcagttgtacattggaaaattagttatccgatggatggggaaacgtcaaacctattcgcttgtagctttttcccgggaatctccaggtaccaagaaaataatcaaccagttgtagacgtggaggaaagcaatcacagacctcgcaggaaaatgagaatgagtctatggaaaattttgggagcaatcggcttcttgacacttgttgtggttcttgaagtatactttgaactcttgagctccatttttgccaattcgacaactgattacattatgttacccacttgattttgtggaactcaagttggtttctttctcggcttatatggttttgttattgtcatccattttcgaaaaaatggttcgtgctatagtgttgtacccgtagaacacaaaggatattgcatcgtttaatacagtatatattggtgtagtga

SEQ ID NO: 18 - DNA, 888 bp, Arabidopsis thaliana
actttcctgccgaaaagagagagagaaaacaaaacaaaaaatggctacccgaaaagctctgatcaacgttcaccggatcattcgctccaccgccgtggttggccggagctctatcattcctgccgccgctaaccggtcatatcctattatattccggaatggagttgatttgggggcgagattcttctgtgagaacactgcgtctgcccagaatttcgatattgatctctctaacgaagagaataagagaagaacgatcaacagattgttgtataggagcaagcaaagagggtttttggaacttgatcttgttttggggaattgggttgaggagaatgttaattccatggacgaaaatggtgttaaatccctaattcatgtcctcaatttggaaaaccctgatctctggaaatggctaactgaacaggaacagcctccggaagcagtgagttcaaatccggtgttctcggcgttacacgagaaagtcatgaagaatctgaacaagcatgcagcgccagagactcgtgcagcggctggacagccctgggtcagaggatgggacgatttcaagagaggccgtgatgctcccatttcagggaatcagtaaacataaactcctcttttcaaaaagtatcaaagtgaaaataagttatgatatgaaaatagataccaagtagtagcaaccattactttactattgtattaataaagaaccaggccgtgaagaaggtccatggcgttgagataattacagtgttgtgtcttgtttgttgaagtttccaagctaatatttggtgttactagattttgcctagttttggataaaatgttgtccaaatttaaagagataagatggtaagatatctgtcaaaagatattatggtttac

SEQ ID NO: 19 - DNA, 1320 bp, Arabidopsis thaliana
ccttaaaattctaaaaagaccaaaaaattggccttcttgtttccaattccggcaccggaaacaccgctcaaacagaagcctccggcgagcttctccctcctaaacaaaaaaaactctctctgtgctacctataatgaaccgcttctctcgtgctcgttcatacatttccttggtgctgtttaggaagtccagctatgtcacttcccacattccatggaatcagtgcttctatacatctttaaaatctagtttaaagcctgcaagtgtgagtgtatctagtgttcattgctattcctcaagatcaaagactgctaaatcaaagatgtcaaaaagctctgtttctgtttcggattcggataaagagaaagacgccttttttgttgttcgaaagggtgacattgttggaatttataaggatttgatcgattgtcaagctcaagttggatcttcggtttatgatcctccagttagcgtttataagggatactcgttgctcaaagacaccgaggagtgtctttctactgttggtttgaagaaaccactctatgtttttagagctttagacttaaaagaagatatgtttggagctcttacaccttgtctcttccaggatcaacttccttcagcttccatgtcagttgaaaagcttgctgagctagagccatctgctgatacctcatatgaaacttgcattattgagtttgacggtgcatcaaaaggaaatcccggtctctctggcgctgcagctgtactgaaaactgaggacggaagcttgatttttaaaatgcgtcaaggtttaggaattgccacaaataatgcagctgaatatcatggattaatcctaggattgaagcatgctatcgagaaaggttacacgaaaattaaagtgaaaactgactccaagctagtttgtatgcagatgaaaggtcaatggaaggtaaaccacgaggtactctcgaagctccacaaggaagcaaaacaacttagcgacaaatgtctctcttttgagatcagtcatgtacttaggagtttaaactctgatgcggatgaacaggcaaacatggctgctcgtctttctgaaggagaagttgaagtggcttaaaggatattatcggtgaactagatttggtcttttttgttgttgtccaggctacatccaaatctgaatagctttatctaacagtgtgagtggtgtctctaaagagaacaaccactatgtaaatatgactcttggtggtttttctgttgtaatagttgcttacacctatgtagaaatggaatggtcccaacttttttctttataaaggatttaagacgaaa

SEQ ID NO: 20 - DNA, 1014 bp, Brassica napus
ttcatggaatgtgttaaagagtcttgcagtgactccacttggatctctcttacttactccattatctccctcttctctctcatctcattaaaataggaatagaaatggagagctcaacatctttagccatcgttcttcatcagtcttccaatcatgacgaactcttcatgcagcagactcttcaattctcacaaactctcaaggatttaaagaacttgcggaaacagttatactcagctgctgagtacttcgaaacatcttatggcaaagaagaacacaaagaaacggtgatagagacgttgaaagaatatgcagccaaggcagtagtgaacacagtggatcatcttggttctgtctctgataaattcaactcttttctctctgataactcagcccatttctccaccactcgtcttcgtttatcttctctcgaacaaaggatgaaactatgtagagagtacatgggaaagagcgggagttctcagcatcgctttcaagttcaatctcctcaccatcataagcgttatttcttccctcaacatggaagaggcacaagtttcgctgcaggagatgactcacatcggttcaagagtgctgttcgatcaacaatactagaaaaccacccaaataatgcaaggaaaaccaacaagacaggaagcttctccttcttacacaacaacatcagcaacataacaccaagtaaaataacaaagtctcctatgagatttcctctcatacgttcaggatctctactgaaacgttcaagctccccaagccagccaagactactggccttaccggaaccacaaagagcgatatctatgtcgacaagtagagagatagtggaaatacagcaaaaatcttcattgagaaaggggaagaagagtctgatgctcaaggcattgatgagtatgagcagtaagtccagaaactaaataaatcttgtattcttacgttaatatgtacaaaattaatatgtgaaatatgaagagagaagaaataatgctcacccac

SEQ ID NO: 21 - DNA, 1453 bp, Medicago truncatula
aatcaaaaacccaaattattcttcacgactcttcaacttctcttcccttctcaccggaaaatctctacggcggcggtggaaaaatatattccccattcggcggcgcttttttgtacatagtattacagtatgggcaaaacttggtggtgcttgatttttgttacctggttatgtctttttgcgttttcagatggcagagaactcaagaccaggcatacgagtcatcttgcgcagtataatcatacacttgctaccatattagtggaatatgcttctgcggtatacttgtcagatttgactcaactttttacttggacgtgctctagatgtggcgacttgaccaagggatttgaaattatagagttggttgttgacgtcgagcattgcttacaggcatttgttggagtagccgatgatccgcgtgctataatcattgcattcagaggaactaatgaacacagtttacagaactggattgaagatttatattggaaacagcatgaaataaattatccagatatggacgatgcaatggtacatcgtggtttttatactgcataccataatacaacaatacgccctgcagttttaggggctgttgaaagagcgaagaagttttatggagatattccaattatagcgttaggacattctatgggcggagcaatggctgcgttttgtggacttgatttaacggtaaataaacaagaaaaaaatgtccaggttatgacatttggacaacctcgtattgggaatggtgtttttgtatctctctacagcaaactagttccaaatacaatccgagttacaaatgaccatgatattgttccccatttgcctccatactattattatttaccacagaagacataccagcactttccgagagaggtatggctttataacattggattaggtagtctggtgtacagggttgagaagatttgtgatggatctggtgaggatccatcttgcagcaggtcagtgagtgggaatagcatcacagaccacctagtctattatggcgttgacatgggatcagatgatccacaatcatgcagaatcgttatgaattctgacgttccgagtactagcagcatcagagattcaagaggaaacttcatcttatctagaaatcctacaagttcccttctcaaattgagtacagagtttgacaataaggaaaaggccgttaatgtctattgaattggcatgagatatctcttgcaacataattgtgggacgtaatacttattcttttctttcttcacagtcctttcaaatgcggccgaagaattttatcagaattagctgtaactggaagaagattgtgtgtatagtctttgtatatattcatccttgtatatatgactcataattcttggtgccgatgttaagtgttgaatttcacatgcaaattctactcatttgactaataatatttgatttattc

SEQ ID NO: 22 - DNA, 984 bp, Medicago truncatula
ctgttattctctccaaatttcacagcaagattgatctttctagcaagatttcgaagcaattttgaaacaagcaaggaagcgtaagggtttggagcagaggaggacatagcaataacaatcacgataacagaagaagaccagatcgtgaacgatgacggtggtgaggggaagtgttttcagattaggaagacgattacgactaggaatcttaaattccctcaaaccagagactaatcacaatactctaaatacaaattgttctcgctgcctgggcacaacgccgtcgtttcaacctcgcaaccacaatgcctttttctcttcccccgcctcaccatttccttctccattttccaccggacaaaggaggactatgtttatccaaacacagtccactccaaatccagagtctcttatgtttcatcctggtaaacctgtcatggatgttggtagcgccgatttcccgaaccctcgttccgccatgaattctcctctcgctaaatcaattttcactattgatggaattactcgtgttttctttggatccgattttgtcactgttaccaaatcagaagatgcatcgtgggaatttctcaagcctgaaatctttgctgctattatggatttctactcttctggtgaaccgctgtttctagactctcaagctgcctcatccaaagacacagcaattcacgatgatgattctgagacagttgcgatgatcaaggaacttttggagactcgtattcgaccaactgtacaagatgatggtggggacattgtatattgtggttttgatccagatacggggatcgtcaaacttaaaatgcaaggagcgtgtagtggctgcccaagttcttcggtgactctgaagtcaggcattgaaaatatgctgatgcattatgtacctgaggtcaaaggtgtggaacaagaattggatggtgaggaagaggaagcagctttaagtggacaaactgagtagttgat

SEQ ID NO: 23 - DNA, 5810 bp, Medicago truncatula
ttttcgtgacaacaactcgcacgtgccttttgttgcagaagttgtcaccgacctttctctcttcctaaatcatcatcatcatcgtgaatcaattttcgacgttgcgcgcgttcatcgattgttccttttcgaattttcaatttcaattttacaccctcaatttctaccgtaatcgctcgattttagggtctgaagtagtagctgattttttaagttatgtgaagaattgagatgaaactgaatcaagcaggttctcagttacctggactagcccaactcaatgggaacggacagatgccatctttaggcggtgtttcacgatcagcacttaatatggaccctgaatttcctagagcacgcgagtttattcaagagaagatctgtgagacgttatttcgacggcatcagcagccaattagtgaaattcaaaaaaggaggattaaggatcttgcaaaacgcctggaggagggcatgttaaaaaatgctccttctaaggaggagtacatgaacttggaaacactagaggctcgtttatctcttttcctccgacaagcaactatgaataatcgcagccaacagtatccccagcttgttagctcgtctcctattggtacaatgattccaacccctggtatgtcgcatggtccaaattcaaacgtggttgttgcatcttctatagatgcctcaatgatttcttccagtggtggtaatagtgtagtatcaacaactttcaatggtgtaaatatattaccaactggtggcatacatggaagctccttaaatagatctgatggtttatcaaatggatatcaacagtcttctaccagcttttctgctggctcagtggggaacatgtcatcaatgagtgtgccgagaacttcaagccagatgattcctacgccgggatatacagtcaacagcaatcactcacatatgaatgtagattcatctactaatggtaatgtcttctccagtgcagagtctactatggtaccactgtcacagcttcaacagcagaaacagcatgttggtgaccaaagccaggtattgccgaacattggcagccaaatgagtagtggaatgagatctggtttgctacataaacagtttacaaactcaaatggtgctgtgaatagtgggctaggcctgattggtaacaatattcaactcccaaatgaaccagtcacctccgatggctatgcttcaacttatgctaattcccctaaacacatacatcagcactttgatcaaaatcagaaaccagtaatgcagggtgatggatacggattgaataatgttgacccttttgcttctggaaacttttatgcatctgcaacatcttctgggtctatgatgaacactcggaacacaaattcagtacaattgccatcaatacccaaaactagctcgttgatcagcggtcactcaaatttgcatggtatgcagcagtctgctcacataaagtctgaagcaatcaaccaattggaaaagttgaattttcagtcttcatcaacttcaagagatgcccttctgcattctcaacagcagtatcagcaaaggccccatcaatttcaacagtcagagcagtatcctcaatcacagcaacaatttcaattgaaactacatagtcaacagcctcggcatttggtcaatgataatgctttcaatcagtctcagttgtcttccaatctagaaaaccaagtgaagtcagagcctggaattgagcatcataaagaagtgctcagttctcatgttcctgaacagttccacatgtctgagatacagaatcagttccagcagaactcatctgaagattgctctagagctcaatacctttcctttccatctggtcagcataatttatcctcatcagtacctcaaagttcgcaacaaatgttgcatccacaccatttggttgcagaatctcaaaataagttcagctgtcttacagttgaggctcaatgcaattccaaacaatggactgactcacaagatggtaacccaatgtctaacaatagttcacacgaccatcatctccatgtggattttcatcaaagaatatcaggaaaggatgaagctcattgcaataatttatcatcagatgtatctatgggccaagccgttgctcctaggggtgcagctgagccgctagacccaggaagtactaccaaaaatgcacacaggaatcaacaacggtggcttttatttctacttcatgctcgacgatgttctgctcctgaaggacgatgccaagaacgcttttgttcttttgcacagaagctatgtaggcacatggatggatgcaacctgcgccattgtccgtaccctcgttgtcatcatactaaggaattgtttcatcattttatacactgcaaggatccatgttgccctgtttgtgtttttgtaaaaaaatgccggcgggcatgtcaacttaaggctcagagtcagccaccatctgaatcgagtttgccaagtgtggtaaatgggtcctgtaaatcttacaatattaccgccacgtcatcaagattgatctcaaaacccacattagttgtggaaacatcagaagacctgcacccatctgtaaaacgcataaagattgagcattccactcagtctgttaatcttgaaaaggacaactctgcttcttctgtttctgcaaattgtgattctgtagtttccagggacgctcagtcccaaacatatcccaatgcggagaagtctatctcaattaaatctgagattacagaagtaaaagcagaagttttggctcatgccaagcttagtgaaatgaagatggattcgagtaatgcagatgataaaattcctgatggtgagcctgtgaagaatgatgatactggtaatttagctaggccagaaaatatgaaaactgagaaagaagttgggcaagataagcaagaacatgtgatgcagccaggtgaaaatgcagctggaacaaagtctggtaagccaaaaataaaaggggtctctttaaccgaattatttactccagagcaagtcagggaacatattactggtctcaggcaatgggttggccaaagcaaatcaaaggcagagaagaatcaagcaatggagcactctatgagtgagaattcctgtcaattatgtgctgtggagaagcttacgtttgaaccaccacctatttattgcacgacatgtggggttcgcatcaaacgtaacaatatgtactataccatgggtactggtgatactcgacattatttttgcatcccatgctataatgatgctcgttctgaacacatcgttgttgacgggactcccattgccaagtcaagattggaaaagaagaagaatgatgaggaaactgaggaatggtgggttcaatgtgataaatgtgaagcttggcaacaccaaatatgtgccttgtttaatggtagaagaaatgatggtggacaagctgaatacacttgccctaactgctacattgaagaggtagaacgaggagagcgcatgccattaccccaaagtgctgttcttggagccaaggatttaccgagaactattcttagcgaccatatagaacaacgattatttaagcggctaaagcacgaaagacaagagagagcaagatttcatgggaaaagctatgatgaggtgattaatatactggttgtcagaaatacatcatgttctatcttttactacatggttacttttctttttgggttaatagtgcttttcacccctgaatatatgtcattttcggttcctggagctgattcccttgttgtaagagttgtatcatctgttgacaagaagttagaagtgaaacagcgatttttggagatttttcaggaagaaaattacccaacagaattcccatataaatcaaaggtagttttgttgtttcaaaagattgaaggtgtggaagtatgcctatttggcatgtatgttcaagaatttggagctgaaagtcaatttcccaatcagcgtcgggtgtatctttcatatttggactccgtgaagtatttcaggcccgagattaaatcagtaactggagaggctcttcgaacatttgtttaccatgaaattctgattgggtaccttgaatattgtaagctccgtggttttaccagctgctatatatgggcttgtcctccgctgaagggtgaagattatattttgtattgccatccagaaattcagaaaacaccaaaatctgataagcttcgtgaatggtatctagccatgttaaaaaaagctgcgaaggagaatgttgtggtcaatatcaccaacttatatgatcatttcttcacatccaccggtgaatgtagggctaaggttacagctgcaagactcccatattttgatggtgactactggcctggggctgcagaagatttgatttatcagctacgccaagaggaagatggaagaaaacaaaataaaaaaggaacaaccaaaaaaactatcacaaaaagggctttaaaagcatctggtcattcagatctttcaggaaatgcatcaaaagatctgctcctcatgcacaaacttggtgaaaccatttccccaatgaaggaagattttattatggttcatttgcagcatgcatgtacccactgctgcattctaatggtgtgtggcaaccgctgggtttgtaatcagtgccagaactttgagatttgtgataagtgttatgaagcagagctaaaacgtgaagagagagaaagacatcctattaatcagagggaaaaacacagtctttatccagttgaaattactgatgtaccatttgatacaaaggataaagatgatattcttgagagtgaattctttgacactagacaggcatttctgagtctctgccagggaaatcattatcagtatgatacactaaggcgggccaagcattcctcaatgatggtcctatatcatcttcataatccaactgctcctgcatttgtgaccacttgtaatatatgctatcttgacatagaaactggtcaaggttggcgttgtgaagtttgccctgagtacgacgtatgcaattcttgttatcagaagggaggcattgatcatcctcataagttgacaaatcatccgtcagtggcggatcgtgatgctcagaacaaagaagcaagacaagttcgagtattgcagctaaggaaaatgcttgatcttctagtgcatgcatcccaatgtcgttctccacattgccaatatcctaattgtcgcaaagtgaagggcctcttccgccatggtatgcactgcaaaacacgtgcttctggaggctgtgttctttgcaagaaaatgtggtatttgcttcaacttcatgctcgtgcatgcaaagaatccgaatgccatgtgccacgatgcagagatttaaaagaacatctaaggaggctgcagcaacagtctgattcacgacgtagagctgctgtaatggaaatgatgaggcaaagagctgcagaagttgctaacaatgctggatgagtaatttgtacatgtaaatacggggcgcttcaaagaaatgttctacacatctagacacctatgctccaacggcatcggttgtttttgtgaatggaatacatagggtatacatagcttcctagccttgcagattcgctgattgatgacccgggttaaattgaaccatttagtgcagcttcgcagcttccctcagctgcaagggattaaccaggtccagcgagggtatttggtggcgcttccttttatgttgtccgattctttgattttgtctagttatttgtatcatcaatgtcaaatgtcatcgttgggtggcaggtgtactatagtcctaattagtc

SEQ ID NO: 24 - DNA, 2535 bp, Medicago truncatula
attattacacgatcctaactcactgagtcaaatctgaaaaactttccgattcacataaatatggcgcttcatttctacactttctcctttcaccgtcttcctacctgactttcttcttcgcttctctgataaccggactcctgtttgcaagaaatatattgttctctaaattttgacatagcatcgaagctgtagcgatgtaaacatatatcgtattgtcaatatcaattcaaggagccatttgatttgatcggaggattttagtttctctacgagtttcattttccagaagtcttgggttggttctgaaccctgatttttggaaagaaactactagtacagcgcatattttaggcttattgttctctgtttactctactgcttacgttaaggcatgggctacttttgcaataagagtgaaagccgatcaaagtgatgatagaaatgggggaaattagttaagatgttttgattttagtattaatggaaaggttcatagcttgtttatttttgagccagcaagattttgaacctgtaaattgagaatggcttgtttggtacttcatccaatgcatgaaaatggcgaatttaccagtagttttagtcctcatatgagggagtcaattttgatttacctaactgttggtggatctgtgattcccatgcatattttggagacggattccattgcttcggtgaagctgagaattcaaaccttagaaggattttttgtaaagaaactgaaactggttttcgaagggaaggaattggctcataacaaatcttgtgtcggtgattatggtgttgctgatggaaatgtgttgcacttagtactacggctttctgatcttaaagctattactgttaggactttaagtggaaaggagtttgggttttatgttgagaagactaggaatgtgggttatgtgaagcagcagattgcaaagaaagggcgaggggtcttcaatcttgcagatcaagaattagtatgggagggtgaggcacttgaagatcagagacttattgaggacatctgcaaggacaacgacgctgtgattcatttgttggtcaggatatcagattccaaggtaagaactaaaccagttgagaaggatttggagttatcaattgaggcattgtttgcacacgatacagtgccaaattcagctgtggaccagttagggccagtgtctataacaaataaggtcctgaagaggaaccaattgactagagaatttcttttggaaccaatttttaataattccaatatcaaaattccaccagtggtccatgaactaattaaggttacattagaggggttagagaaaggccgtaaaccaattcgatcttcagagggatcagggggagcttatctcatgcaagattcatctggcttaaaatatgtttcaatcttcaagcctaccgatgaggagccaatggcatttaataatccccgaggattacctatctctgtggatggtgaagggttaaagaaaggcacacaagtagggcaaggtgcattgagagaagttgcagcttacattttagatcatccgaggaaaggacctcgctcatatcataacaatgaggagaagggttttgctggagttccgccaactgttatggtcagatgcatgcatgaagggttccaccatcctgaaggttataagaatgtttcaagtaatgtaaaaataggatcacttcagatgtttatgaggaacattggaagctgtgaagacatgggccctagaacatttcctgtggaagaggtacataagatctctgtgctggatatgaggttggtaaatgcagatagacacgctgggaacattttggttgccaagaatggagaagatggtccaattgtcctgattccaattgatcatggttattgcctgcccaagagttttgaagactgcacttttgactggttatactggccacaagctcaagagccttactccctagacaccactgagtacataaaatctctggatgcagaggaagatattaagcttttgaagtctcatggatgggaacttccgctggaatgcgcccggattcttcgtatatcaaccatgcttcttcagaaaggtgcagaaaaaggactcactcctttcaccattggaagcatcatgtgtcgagaaacactgaagaaaaagtctgtcattgagcagattattcacaaagcagaggaagctgcacttcctggaacaagtgaagctaaattccttgatcttgtttcagtgatcatggataatcatttagaagggctattcccatgactgaattgtaaagtgatgagatattgttgtaaagtgaggatgctcctttcatcttcaacgcagaccccacaatctactataatagactgtagttaaacttcttccaaccaacaaccaagaattgatgcttgtgttgctatattgagttttgtgttttttatactacacctctggcttcaaggaatggaaatatgtgtgtatattgaccaggaaagtttatggaatttctgtgcttcttgagccaatatgc

SEQ ID NO: 25 - DNA, 1262 bp, Solanum lycopersicum
aagtgtgtacttctcactctgctcctcagatatagagagagaaagaagtgcgtgagtgtatgaattaatttttcttccatttattttatttttttggcagaatttgcatgacattctgttgaaaaaaggacctcaagctcacttttttgtgcttcttcttcttcttcttccgtttctcgtcaggtaaagctcaagtaagagacaaattatagtagcattcaccatgtttcgtcgcaagaaccactctaatagtgaacaggggggtgaggaccagcagcacaaggttaaggagcttagggcttccctggggcaactctcaggccgcagtgcacagttctgcactgatgcatgtttaaaaaggtttttggaggcacggaattggaatgtagataaagcaaagaagatgttggaggagacgcttaaatggagattatcgtttaaacctgaagaaattcgctggaatgaagtagcgaaagaaggtgagactgggaaggtgtttaaagcaaattttcatgaccgccatggcaggacagtcctaatattacggccaggaatgcagaacacggcagcactagacaaccagatgaagcatttggtgtatctaatcgagaatgccatttttaatctgccagaaggtcaagaacagatggcctggttaattgacttcactggatggtctataaccaataatgttcctgtaaaatctgctcgcgagaccatcaatattttgcaaaaccactaccctgagagactcgctgcagcacttctgtacaatccaccgcgactttttgaaacattttggaggattgtcaaatactttatggatcccaaaacatttcaaaaggtcaagtttgtgtatccaaagaataaggatagcgcggaactgatgaagtcgtacttcgacgttgacaatcttcctactgagtttggaggaacagctacactgaaatatgatcacgaggagttctcaaggcaaatggctcaagatgatgtgaaggccgccaagttttggggttcggacaaacatccccctggtcctggtggtaatggtaattactctgcagtagaagttgctccagaaccttaatcacttactctataagccactgcctgagcttaaatgattgcaacactgacaaagctcagtctcttatatgcctaactaagttcaaataaataatgaggaatgtaagaatcatgttcacagacattagcttatttcagatgaactttaattgtaggttgaactttgatttatgcag

SEQ ID NO: 26 - DNA, 1170 bp, Solanum lycopersicum
cggccgggggcgcctttactttccagcgtttatttatcatacagtaatcgaaaactgctcaaagtaacttctcacattcttctagagagatctgaccctttagaacaaaatggagcatgaagacagctacaagggagtttcggagccaaaatatgagtgccttctgtttgatgttgatgatacactttatccacttagctctggtatttctgcacaatgcacgaaaaatatcattgattatatgattgaaaagcttggcattgatgagactaaagttccagaaatgtgtataagcttatataaggagtacggaacaaccatggctggtctcagggccattggttacgactttgattatgatgactatcatagttttgtacatgggagattaccttatgaacttttaaagcatgaccatgttctgaggaatcttttgcatagcttgcctgttcggaaagttatattttcaaatgcaaatgaagcccatgtggcaaaagttcttagcaggctcggattagaggactgctttgatgatatcgtatgctttgagactgtgaatcctaccaacaacggcagtgcacaagacagcaacaatggtgtatcccctaggtctcttattgtttgcaaaccgttcaaagaagcctatgaacaagcctttaaaatagccaacattaaccctcagaagacgctgttctttgatgactcggtccgtaaccttcagactgctaagctcacaggccttcatactgtgtgggtgggtgcctcccatagaacagaaggcatagattatgcactagaaagcattcataacatgaaggaagcactaccggagttatgggaagatgttaaaccagacattcgctactcggaaaagactgcaattgaagtgagagcttagttgtgtaatttcacaataaagacaaccgtatagttgtagttatttaatctattgctttctctttttcttttctagtttcctcttttgcctgttaacctgaataacagttgttacattgatttcacaatccctaactgtattattattgcttagtggatgtgagatttctcatgtgactatagttgtaagaacttctcctagaagtaagtccatgatgactactgaatcaagtttgaattataagtatttggttgtgaactaaaaaaaaaaaa

SEQ ID NO: 27 - DNA, 1697 bp, Solanum lycopersicum
aaatcacaaaaggatagctaaaaatggtgagaaataggagagaagaattatacgttaccgttcccccacttttccgatgtccgatatccatggacgtaatgaagtctccgataagtctctgcaccggcgtcacttacgatcggaattccattcaaacttggctttcacaaggtcataatacttgtcccgctactatgcaaatccttccgtctacggatttcacacctaacctcactctccggaggcttatcaacgtctggatacagcatcagccggcgagttcaccgggatctacaacgccgtcttcatcctctgttacaaaaacggaagttgttgaaattgttgaaaatctcaacggcgaggtcgataggttgagttccttggcgaagattggggaatttgttaaatgttctggtgaaaacaggagtttttttgtgaatttgagtgatgcgattgcgaatattgttggagttttggtggattgtgatgtggttgaggtttgtgaagcggttgttgcggttttggatttagttgtatcggagaatggagttaaggagcagttgaacaaagagattttgaagagcgatcagaaatttctaccgaagtttcttttggttcttcgtaaaggaaagttgagttcgaggattcaaaccgctcggattctagaattcatcgcattagacgccgattcacagcgaaaaatggtcgaggagcaaggtttactctacgaattgcacgtattcactagcacggagacgaaccgattcgcgatcgaagtcggtttatcaactctaatcgcggtctcaaccaccagactggcgaagaaagagctagtccggttcggaattatacaaactatcggaaaaatccttagcaattcggaaaccgctcgggcggtggtagagaagtcattgaagctgttggaaacagtagcgacgtgtgcagaaggcaggacggcgataggtaaaggcgaagagtgcttgtcggcgatagttacaaggctgatgaagagctcgaaagcagcgacggagcacggggtgacagtactatggagcgtgtgttgtttgtttcgtcatacggcggcgcgtgaggtagtgggaaaggcaaatgggctaacaaaagtgttgctggtaatgcagagtgattgctccgcggcggtacggcagatgtgtggggaattagtgaaagcattgcgcgtggtgaatactttctcagtccggacggaggaagtaataaagataaagaattattcaaagtcgtgtttggcgagttatgatacccaaactactcacattatgccctactgaaaaatataataaatacccctcttaattggtgctgactaaccatccataccaaaagaatcaaacactatttttctattttttgtcctttaataattattagtccatttgtttgtttatagaaatggaattaggtaagattcatgctgtaaatccaaaggaattctgctaatgatacaaatgacatcaaactgttagctaaatagtacatcataagatcgtgatatttctttcattaatatcattgttattggttttatagtgttgtcatgattgatcagtgttggttgtattaggtatttttattagtttacggatgatatgatgtgtttattatccattgacgtgtaaaaccatatgcacacaaattatatataaataattgatttctta

SEQ ID NO: 28 - DNA, 1631 bp, Solanum lycopersicum
tttttcttctttctttcttctcttctaacctagcattttaaaaacaaaaaataaataaataagcataagcattaattcttttcccaaatacttagaaaaagtccaggaatcttccttttttttttttctattcagaaaatccaatttcctcttgatttccttgttctagaagataccattttttttaacaaagaaaattccaatttctgatgttggcatacacgtaatattttctggtatataagaggattgttcgatgttttgttctcccaataatattaaattgaagattttgcgtttatacaatttgggtttgctatttcttgaattttttttcttaaagttgtgatttttatttggaatctttggatatgagtttagggggagaaaagaaaaatgtggttgtgattgggggtggagttgctggttctgttgtagcaaaaacccttcaaaatgaggtcaatgtttccctcattgatgagaaagagtattatgagataacatgggcaagcttaaggtgtatggttgaacctgaatttgcaaaaagatccgtcatttctcacgctgaatacctccctcatgcgaaaatcattccgtcagctgcagttgacatcacagacacttatgtattgaccaaacaaggcagccgaattgcatatgactatcttgtagttgccactggtcatacacaaagcggttttgagacgagaacggagaagatcagtcagtaccaagcagagtatgaaaagataaaggctgctgattccatattgatagtcggaggagggccaacaggtgtggagttggctgctgaaattgttgcagattttcctgctaagaaggtgacattggtgcatagaggatcaagattattggaatttattggagaaagcgccagcaaaaaggcgctgaattggcttacttcaaagaaagttgaagtcatattggagcaatcagtccttgttaactctcaatcagatggtgtttatagaacatctggtggagaaactatagttgctgattgttattttctttgcaccggtacactatttggttcagtatggttaaaacaaactatcttgaaggatagtttggacagtcgtggaaaggtaatggttgattcaaatttgaggatcaaggctcgcaaaaatatctttgctattggggacatcactgatgttccggaacttaaacaaggatatttggctcaagaacacgcaaaggtagtagccaagaacatcacgtcgttaataaagggagtggaagatgatcacaaattggctgtatataaaccagcaaccaaggcattggctatagtttctctagggagaaaagatgcagtggctcaatttccttgtttgtcaatcgctggacgcattccaggcatgataaaatctggggatctatttgttggaaagacgcgcaaaggacttggtctacagcccagcgtttagttgtcctgcttataatgcatgttagagaagttaacatctacgtacattgtaccattccattactccatttgtgggattgcacggtgtatgttgctgttggtggttatttgtggacatgtaaactatatatcaatattctggttttagctattatagcaaaggcaattattatcaagc

SEQ ID NO: 29 - DNA, 812 bp, Solanum lycopersicum
ggtcgtcttcaattgcagagaaaatcaacatcaatggctgctctaagtgtacaagaagttctaccagcaactctggaatctacttccgaacctccgtctctctttgatggaactaccaggttgtatatcaattatcaatgcccgtattctcagcgtgtgtggattaccaggaatgttaagggtttgcaagacaagatcaacttagttccgattgatcttcagaacatgcctgattggtacaaggaaaaagtttatccccaaaataaggtgccatccctggagcacaataacaaaatgataggagagagtttggatctggttaaatatgttgatagcaacttcgagggaccatcacttttgccggatgaccctgaaaagcggaaatttgctgaagaattgatagcttatagtgatatattcgtcccagaagtatacaaatcgttcttcagagatgcacagacactggctggtgcacaattcgattacctagagaaagctcttgacaaatttgacgatggacctttcttcctcggtcaattcagtcaggttgacatagcatatgttccatttatcgaaaggttccaaattttcatggaaaaggggattaactatgacatcacatccgcgaggcctaaactagccaaattgatcgaggaaatgaacaagcttgacggttacaagcaaacaaaagtcttggatccagagaaactggttgaatactataagaatctctttctgaaaaaggcttgaaacttcaaaaatgcatttgatctagttacatgggctagtactttgatatatcaaatatgttt

SEQ ID NO: 30 - DNA, 702 bp, Solanum lycopersicum
cttttttagtgggatattctgatgcttgtatccaattgagggcattagcaatcaatggccctggatttcatttgcaacaagcaaatagaagaaggtaagcccatagagaagttgaaaatggttgatgatgaacatgaaggcggcaatctctctcgtggttttgagtgtaacatttgcctagatcttgcacatgatccagtggttacctactgtggtcacttgtattgttggccttgtatctacaaatggattcacttacatagcatcccttgtgaaaatccagctcaacgccacccacaatgcccggtttgcaaggctcatgtttcacaaacaaccatggttccactctatggacgcgaccaagctacaaaaacatctcaagatgatggcatggccataccagaaagacctcaacaattccatcatcggtctagtacaagcacgattggtgaaacagctcatgcagaacgcgttgatgggaactcatttgttccatatccaaacgcgcatcatctagcagggaccgctagtttgaggatgagaaggcaacaactgcaagctgatgataaatcacttcgcagagtgcatttttttctcttctgttgtgtggtgttgtgtcttatcttgttatgataacaaacttctttccctgctgtaactttgtaagaatatgaaatataatgtactacaccaatttggctc

SEQ ID NO: 31 - DNA, 2517 bp, Solanum lycopersicum
tcataaagtggataactattggacggagtaatatataaggaggagtcgcaaatacgcgtgcattaattatgtgtctagccgcagttccacagagtttgggttgattagattctttatattctctgtgactgaactttccttatatttttctgggttcacgcggtaggtaatctactaattccggttattttcttggatttttctacttcaaatcttgaaagccccattgttccaagttgtggatttgattaatcagaaaaagcaacaatattttatccaagattctcttcctttaatgcagaagacgacattgacttcaacaagactattggtatcactcccaaattggactttgatggtactgaaacggaatattaatcaggatagtgatgaaaactctgagtttccacctagggaatctaagcgccaacatccttctaatgcgtttttttcagggttaaggagttactcttctccacaagaacttgcacgaaagctggaacccttaatccgaagctgggtgcgtgaagagattgagcaaacacttcaatctaccctgagatcctcacttaatgatgacgagacttctaaatctagggatattcagttactttttgacgatgtatttccttcttcccttttcacgggcagcaaattatccatggaaaataggcccattaaagttctcttgtatgatgctagttccaaccagagaataacatctggaccgttatcttcggcaaaagtagatgtggttgtgcttaatggggaatttaatcctagcaatctagaagactggagtgaggaagagttcagcaaaatggttattcgtgcaagagaaggaaaacgtccattattgactggagatttaatcattcagctaagggatggtgtgggatatctgggtgatctcagcttcactgacaattcaagctggataaagagcaggacctttaggttgggagtgaaattaaataaccgttctggtgaatttagggtcagagaaggagttagcaagccctttactgtgagagatcatcgtggggaggcttataagaagcattaccctcccactttggatgatgaaatctggcggttgaaaaagatcgccaaagatggtgcatcacacaaacggttgagtaaggaaggaatatcatgtgtgaaagagttcctacggctgtttgtcactgatccatctcttttacgtaagatgctggcttgtgggaacaacatatgggagaaaataactgaacacgtgagcacttgtccgttagacaacagcgagtggtacgtatacaacgctggagaaagtattgtacttctgttcaactgcatctatgagcttgtaggtgcaattcttgatggacaaaatttccagtccattgacaaattagatatatttcagaagcggatggtggaagactttaagcgtagtgtttataaaaatttgaattgtctagctccccttgaggaccattctttgattggccaagcaatccttacatctaatctgcagaatggccttaatcatattcctagttcaagccaacagaatatgaactactcagatgaacaaggtcaagtggagttccagagcaactctgatcatgccacaatttcatcaccgctagcctacacagctcaacaggatagtccaactacagtgtccatgcctgaaagctttaatggaatacaagcatttaattcgaccttggcaagcagtttcttggttggtgaaccttgctccagtatctaccctggtgattatgattggggttccaatggttcattggattcactagggatgactgattatctacctcctaacaacaattatcagtttgagacaccagtgtggcaagggaatgaattgttagcgagttcaagtgttcagccggtgtctcctaatattggctttcacatcacaagacgtggaaatcctagagccatatggtgcacaatccgtgctgttctgaaatggaaaacattggttaagagaaaatagctatttgaagattggaaaggcttttacaagtagatatctgaagtttgttcgagatataaccagcaaacttcacctccatctctcagcctattctttgacaattttaaaacataaatatatttatatgtccattacatatagcatccatcgtatatatgtgagtaaattgtacatatagtaaggtttttgtcaggatgaaggtgcatgtaggataaattttcttgcagaaacagtagcaagatatcaaatattatgaaatgccatcgtccttggaggagtttagtgctacccctttagtaaatagtactagtagttttcttgtgtttttctgcatcagatgtaataaatggtgcttgtacaggaagtaatattattaccttaattattagtttataaattaagagattctatgtcaattgttgtcagctgttttctgggaactcatctgactccattgtacgtttctttttcggtcattacacttaataatatataaatatatagttgtacat

SEQ ID NO: 32 - DNA, 1112 bp, Solanum lycopersicum
cctcctatcctactcacctcctaagaaacttctagaacaaaaacgcaaatttctcatttttctcgtcttctcgatctgtttagagggggtttggatctgaattgacggcaacggtggatgctatggtgccatcgtcggttgattgtaccggcgaatctgccaccggggagaatcagagatctcttccgacgccatttttgacgaaaacttatcagcttgttgatgatcctgccatggatgagttgatctcgtggaatgaagatggaacgacatttattgtttggaaacctgcggagtttgctagggatttgcttcccaaatgttttaagcataataatttttccagttttgttcggcagcttaatacttacggatttagaaaagttgtacctgatcgatgggaattcgcaaatgactgtttccgtagaggtgagaaaggactacttcgtgacattcaacgccggaaaatttcaccggcaggtgctgcggttgttgcaccagcagtagtaacggtgaatgctgcacaagcggtgacggtagcggtagcaccagcggtcagggtggtttcttcatcgaattccggtgatgagcaggcgttctcatcgaactcatctggtgccgcagctggagcggcgatgttaaggaccactacgtgtacgacgacgccggagcttatagaggagaacgaacggttgagaaaggagaacgcacaactaaatcaggaattgaatcggttgagaagtttatgcagtaacgtatacaatctgatgtccaattacacggcgaatccggcggatataccggcaggtatactaggaggacgagctttggaattgcttcgtacggggcaagttgacggcggcggtgcggccatcacagcggcggagagcagcggcttcaaggcggatgaagatatgagcccacggttgtttggtgtatcaattggggtaaagcgcgtgaggagaagcagcgaagaagaatctgaggatcaggatcaagtacaaccgcatggatcagacatgaaatcagagccgttagattcaggaagtgctcaacatgatgatcagccatggattgatcgattagatttagggtgttgatttcccttggag

SEQ ID NO: 33 - DNA, 834 bp, Solanum lycopersicum
gtagcacaccaaaaagaaagaaatactcactagtaaaaatgaattctttgatgatcaagttgttgttttttctcgtccttatttccaatggatattcaacaaaattagattcatatcctccaacttgtaaaaaaattgaatgcccaaattatgatgtgattgaatctggaaaagactatgaaattcgtcgttacaattcccctatgtggatgtctactgaaccaattgatgatacgtcatttgtttccgccacccgaatcggtttcaccaggttatttatgtatattcaaggaaagaacgatcagcatgagaaaatggatatgacagcaccagttatgacacaagttaagccaagtgatggaccattatgttccacctcatttgttgtgagttttaacgtaccaaagaagaatcagccaaatcctccttcagctgaaggcctacatccccaaaaatggaaccaaagtagttatgccgcggtcaggcaattcagtggatttgttacggatggtgatattccgaaacaagctgctgcccttactgccagcatcgctgacactaaatgggcagcagctatcgaaaaaagcaggagtaaagataatagtacgatttatacagttgcacaatacaactctccctttgagttcagggctagagtcaatgagatgtggtttacttttgttatggacactgcaattgacatttgagaggcaacaaagtttactattctctcagtttattgttttgtattatcaaaaaagtgtagttgttatgtatgaccagaatgctatatttcataataatacaatatgattctgaaaattttcatgtttt

SEQ ID NO: 34 - DNA, 648 bp, Solanum lycopersicum
ctccattaaacctccatttctttatatagcattctcctcctaaaataaacagataaaaaagaatggcgatttttggtgatccttttagaagattcttattgagtccgacgattcatcgaagcttttctggttctccagctcttctcgattggattgaatctcctaattctcacatcttcaaaatcaatgtcccaggatatagcaaggaggatataaaggtgcaagttgaagatggaaatgtgttggtggtgaaggcggaggggcacggcggcaagaaggacgaattccacggtaaagagaaggatatagtgtggcatgtggcggagcgaggaggagggagaggtggcgatttctcgagggagatcgagctgccggaagatgtgaaggtggatcaaattaaagctcaatgtgaaaatggtgttcttaccattgttgtaccaaaagatgcaactccaaaaacatctaaagttaggaacattaatatcactagcaagctataaagtcttggttatggtataataaaattaaaagtatagttttgtgtatgttgtcacaagttgtggaattgaatggatgtaacaaagtacttgtagaataaataaggctttttcttaatccaagcttaatgcacttcctataaaaaaaaaa

SEQ ID NO: 35 - DNA, 1025 bp, Solanum lycopersicum
gccggggatactttctcacgccaatgctttcacattacacaaattaaaaaatagtcaataattataatatgaataaacatcacattcttcaggaagatcatcaaaattcttctggcagttctttagccatgagttcctcttttggaacaactactccagaaagacattcttctttttctcaagagtctgaatctgctgttgctagcactcttcatagtccatcttcttcagattactcacccacaattactccaagtcatgatgattcagctgtaattattcagaagaggaaattggggaagaaggcaaaaagttatgcatatagaattcgtgagcatgtgaaattgggttcgaagttttcagaaacggtgaaggggaaattgacgatagtgaaagaaggagggagaagaaatatattcaagcatatgtttcatgtgaatgatggagagatattgcttaaggcatcgcaatgctatttgtacacaacagcaggtccaattgctgggattttattcatatcaactcataaaattgctttctgcagtgaaagacccatctctgttccttttccctctggaggaattctcagaacaccttacaaggtggttattccagtgacgaaaattaaaagagctcttcccagtgtaaacgagaacaagccatctcaaaagtacatagaaatagtaactgaagatgattttgagttttggtttatgggttttgtacgatatgaaaaagctttcttgaatttacaaagagctatttcgatgtcaaattaaatgttttagacatgtaatgtttaggattttaaagagtcattgttagtatctaagtttttctttttaaattttttgttgaatcggcggcattttaggactggttattctttgttcttttcggtcgatgatcataatttcaactattttggctatagggatatggattttatgttcaagtgtaattatctatggttatttgatgtactttccctgcaaagtgtgaaatctcctcaaacaaaagaatcc

SEQ ID NO: 36 - DNA, 1069 bp, Solanum lycopersicum
ttccaaaaccacaaattcaacaaaaatacactcctattcacatcacttcactcggtacgaagttttgactattataatagtcgcgactattttaaaaagaaataagcaatttcctcgagatgaatagtgatcactttagagttcaagatgaaggagtatttctactagcttcgagtcaacctaagaaacgcgcaggaagaaagaagttcaaggaaactcgtcatccagtttataggggggtgaggagaagagataataacaagtgggtgtgcgaggtgcgtgagccgagtgagcaaaaaagaatatggctagggacttacccgactcctgaaatggcggctcgagctcatgacgtagctgcattagcacttagaggtaacctagctactttaaatttcgccgattctagttggcgtttgactgtaccgatatcaaaggatcctgaagaattacgtaaggctgccatacaagcagccgaagaattagttggagtcggttatatgaatgaggaaatcaattatattgaagaaaatattgctattggtggggccaatggaagtgacaatagtaatttggtgggtaatgaagtgaataataataataacatacaaaatatggagatgggtaacatttcatgttataataattggggtgacaataatgaaatgttggaaattgagggatcaacatggcaagagaagatgagtgaggggcatttgttttcaccaactccccattatgatagttgttttagttgggatgatgtggaaagtgatggggaagtgtctttgtggagctataacatgtaattacgttgtttagaatcgagcatgaataattgatataagtgtgtaattacgttgttcagagtcgaacataagtaattgatacaagtgatataattacattgttcagagtagagcgtgagtaattgatacaagtgcatgatgagtgtataatgatatataggttgaattcttaatcacataacttaaaagtgattcgaggtatggattctatgattaatgaatgtattttatgatatataaagtttggattttgattgatt

SEQ ID NO: 37 - DNA, 1130 bp, Solanum lycopersicum
gaaacaacaatacaattttccttcgatttgcctaattctcaggtcatctttccagctccacttggttgtgtagtgaatctttttccaagaaaactttttatttggagatggctgaggacggtcacaaggttatcttaaacgtctatgacttgagtcaaggtttagctcgacagttatctactacttttttgggaaaagctattgaaggaatatggcacacaggagtagtggtttatggtcatgaatattattttggaggcggtatacaacatgctccagctgggacgacaccatatgggactcctattaaagttgtagatctgggtgtcacccacataccaaaggatgtctttgaaatgtatttgcaagagataagccctcggtatactgcagagacatacagtttgcttacccacaactgcaacaatttcagcaatgagattgctcaatttttggtcggtgcaaccattccagaatatattttgaatcttcctaatgaggttacaaatagcccgatgggtgcccttataatgcctatgatacaacaactggaatcaacgttgagggctaatgcagtaccacaagcaccccagttccgaccagctactgttgctcctgcttcccagccgacactttctgttgggaagtcctctagtagcggtattaatcaatccaaaaagcccgagagccaagatggagagaagaagaatgttaatgtgccctctgcggtcaaacctgtggaagagcaggagaagacgcctgctaatgcggttgtgaaagatcctcttggtgatgctcggagcaaggtacaagaggaaatcacccgtgaatttgctgcaatcatggctactgggacattgcgtgcaagtgaggctgctgctttagcaactaaaaaagttatgcaaagatatggagatacatttgctgctatgaattaatgacaacgaagttgtctttataaattcatctgtattggaaatttaatatccaactgatttgatgtaaggtagacttattggatgcttagtaggagatgagcaaacattcttccttgaaagagatccgcattattgtactctttctggacttcatacattgaataagttcactttttacaactaaaaaaaaaa

SEQ ID NO: 38 - DNA, 996 bp, Solanum lycopersicum
aactttcaactaaattcaccacattcattagaggatggaagagataatagaagaaaaaaagatgaagattctttgtttgcatggatttagaactagtggaaatttcttaaaaaaacaattaagcaaatgggatccttctatttttgctaattctgaaatggattttccagatggaatatttgcagcaaagggtaaatcagatattgaggggatatttccaccaccatattttgagtggttccagtataatgaggatttcacagaatatgagaacttagaagaatgcattacgtacttgtgtgagtatataacaagcaaagggccttttgatggtcttctcggattctcccagggagcaactttatcaggccttttactagggtacatggagcagggggagattctgaaagagcatccaccaatgaaattatttgtatcaatatcaggtgccaaatttagggacccaaatatttgtaacattgcatacaaagatatgatgaaggttaaatcagttcattttattggagagaaagattggctcaaacttccttcacaagaacttacaacagcttttgagaatcctatcatcataaggcatcctcaaggccacactgtgccaagaatagatgaagcagctgtggagacattgaaaagttggacaagggaagttgccttatcttccaatgagagttgtgttggtggaggaccaaatgaagcctgcaaacatgttaacattgaaaatggtgtggaacaaggcaaaaaactagagaagcctaatgaagtagagatccaaaaggctcaagaataatagtcaaaagctcttctctattatattctatttttgcattacaaaagctagtttaatataaatatattatgcatgtagagacttaacctagtatgtacctatttatatctatttaattttctgatcaattctctaatatatcataactagtggtgcaatgtgttctctcgcagttattgcaatgtgtt

SEQ ID NO: 39 - DNA, 1275 bp, Solanum lycopersicum
aagaggtaggcttggtagatgaaatcgtttttttccgttaggcagtgatggagagttttcgcctccgcttccacaatttcttatctttccatctctccatcattgctaaaattttccggtggttattctcctctttgcctaccatcaaacgctttcctctcttcgttcctttcatcgacgcttatatatccctcttattccgatttgccaacttatcaccatgcaccctcgatctagacgaccaaaccaccatccatttctgggctcccaatcaccgccgttacgataaaccaaatctcgtcctcgtccacggttacggaggcgatgccaaatggcaatttatgtaccaagtcaaatcactggctgaatccttcaacctctacattccggatctgttattcttcggtaaatcgtatacaactcggaaggaacgaacggaggagtttcaggcgaaatgcgtggtgcaagggttaaaggaattgggagtgagaaattgttccatgtttgcaattagctatgggggatttgttgggtatcgaatggcggagatgaatccgcaaatggtggagaaagtagtgatattgagtagtggagtgggttgctcgaaagatcagaaggaagagcagttgaaaaagattggaagagatccggttgaattgctcataccggagaaaccagaggatctgcatgtgctcgtaaacttatcaatttacaagtacaatcatttcaagtgggcccctgattacttcctccaagaattcattgatatgataagtaggacttacctgaaggagaagcaagagctagtgcaccacttgctgtccaatcatacagattgcagattgcccatcctaaatcaggaaactctgcttatttggggtgacaaggacagagttttccctcttatgttcggctaccagttgcaaaggcatttggggcctagagcaaagttggaaattataaaaaacacaggacatgcagcaaacattgagtctcctgattctgtcaatgctttgattaaagcctttatcttgccgcaaagcaaagacttatagggttgacactgggattgatcttgatactgctaggcttagctgggggttcttgctccctatgttacatatctctattactttctcattgtttgtaaataatgaaactactaatgggactttaaagtattacgaagtctcctagatgatataaatcaagttgattaatgtatgtacgtttgatgaatagcatcaacctgaacgcaattcagcttaatttttg

SEQ ID NO: 40 - DNA, 1274 bp, Solanum lycopersicum
gaaaatagatgtatccattttcctaccttattttttctttttcttcaatcgaagcttcttctgcaagatcgatttcttctagaagattctgcaacagcggagaacttgatcaatcttcatcggctccacactatcaacgaatcactgaattctctcaactttgaagatttcagaggttatggctgatgacgatttccttcagctcctcaagagaattggggcatttcttactctcaagatttctaatctctcacaaacactggattcaagatgtgcaggagctatagcaggtcttgcatttgcaatagtatttatctggaaaataatgagatcacctagtggaccacagaggaggcatcctaagcaacaagctgttacacctggtagttctggtgtaagcagtcattttagtgaaaatgtaccgtcttcagaagttagccccccttcagagaattcaaatgcacaaaatgtcattgatgagttctttcagcctgtaaagccagctctcgggcaaatagttaggcaaagattgggtgaggggaggaaggtaacatgtcggttgcttggagtaatcctggaggaaacgagcccagaggaactacagaaacaagctactgttcgatcctctgcgcttgaagtgttgctcgaaatcaccaaattttgtgatctttatctcatggagagagtacttgatgacgaaagtgaaaaaaaggtcctactggctttagaagatgctggagtgtttacatctggtggcatggtcaaagacaaggttctcttttgtagcattgagaatggacgaacatcatttgtgcgacaactggaacctgattggcacattgatacaaatccagaaattgttttccaattagcgagatttatcaaatatgagctacacgttacgcctaccaagtcagaaagaacagctataaatgtcttcagttcaacgtctttggagcagttttttggagcagcttagacgcatttggtttgttgttttaggtctcaccgtcctcttcaagtttgggctgtgagagttcatatttttaactcaattacatctttttctggtacctgcaactgcataattttgaggttcaaggaaaaacttttgtatattacgctgttgtacgcagaacgtgtcacttcatcatcatatcatattcatatggtcataagtgagaagattttaacttgaaaagatgaattacgattttatctcttcactaaatttaatattatatataaaaaaaactaattaataaaatgtcaaa

SEQ ID NO: 41 - DNA, 885 bp, Solanum lycopersicum
aaaagagaccaaaacccttatactacactttgaaattttgcaaaaaaatatgaccacaaaagagatggaagtagtgaagaatttggatgttgaaaaatacatgggaagatggtatgaaattgcctcatttccatcaagaaatcaaccaaaagatggtgtaaacacaagagccacttacactttaaaccaagatggaacagtacatgtgttaaatgaaacatggagtggtggtaaaagaggttcaattgaagggactgcctataaagctgatccaaaaagtgatgaagcaaaacttaaagtgaaattttatatcccacctttcttgccaattattcctattgttggtgattattgggttttatatattgatgatgattatcaatatgctttgattggtcagcctagtaagaaatatctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacactaaaggattttggtggatcaaatcaatattgggaaaatagtcaatcttgaatatggtttttttaaaccaatagctaaataaattttacaatataaattatgaaaagttgtcttgtaaagaagagtttattattgtttatatttcaaatgttgtaattttctaaggtgtgtccttcttgtgttggtagcaagtatagcatgtgtaatattgtgttgttgcaacttgtaagagagtttgttgttaattttacaatataaattatgaaatgttgaatatatatagttcgtttcgttcaaatgaagtttcttgaatttttat

SEQ ID NO: 42 - DNA, 4421 bp, Solanum lycopersicum
actctttcttctttactaaacactgaataactgttcttcaaagtttctgcaattcagcactaagaacaatcaatggagccaactgatgttgcagtctctgaagaccaacagctctctgctgaccctctgccttttgcaagaagttatcagttggaagctctggagacagcattaaagcagaacaccattgtttacttagagactggttctggaaagaccttgattgcaattatgcttcttagaagctatgcttaccttcttcggaagccgtctccgtacatagctgttttcttggtcccgaccgttgttctggtgactcagcaaggagatgctctgatgttgcataccgacttaaaagtgggcaaatattggggagaaatgggcgttgattattgggatgcttctacatggcaacaacaagtggatgatcatgaggtacttgttatgactccggcaatactacttgctgctttgaggcacagctttttacaaatagacatgataaaagttataatatttgatgagtgccacaatgcccgaggcaaacacccctatgccagcataatggtggagttctatcatcaccagttaacccatgagagcgcacaacttccaagaatatttgggatgactgcttcccctataaagtctaaaggtgctagcacggcacatagttactggcaaaagatccatgacctcgaaaatcttatgaattccaaggtatacacgtgtagcagtgaatctgttctggcagagtatatcccattctcaaatccgaagttgaagatatatgaacatgaggatattccttgctcactgtttaatactttagctcatgacctggaaaggttgaaagaaaagcatgaatgttcgatttcaaagtcaaacctgtctgctatgagtgctggatctgcaagaagacgtttatcgaaacttcacatggctttcttattttgtttgagtgagatgggtgtgtggctggctttcaaggcagctgagttcttgtcctttgaagaaaatgatttcttttcatggggagaatttgatgcatgtgctcagacaattgttagagatttcagtttgggtgcatctaagattttttcggcccgcttaccttcagggccacattggtcaattggtggtgatattcaggcaaatgcggatgctggatatttgtcatccaaagttaattgtcttctagagtctcttcttgagtacagggaccaaaaggatttgagatgcattatatttgttgagagaattgttacagccattgttcttcggtctctactgaatgagttgcttccggaacgaagtggttggagaactgagtatacagcagggcatgtttctgtgctccagtcacagagtagaaaaagtcaaaataaaattgttgaagaatttcgcaaggggctggtgaacattattgtagcgacatctattcttgaagagggcttggatgttcaaagttgcaatcttgtgattcgatttgatccatcagctactgtttgtagctttatacaatcacgtggacgagctcgaatgcaaaactccgactttcttctgatggtcagagatggggatgatccaacccttactcgcatgcaaaactatatggctagtggagagataatgcggcaagaatcattacgccatgcttctattccatgttcacctctagatgatgaattgtatgatgagccttgctacaaagttgaaagcacaggagcagttgtcaccctcagttctagcgtgtcattgctatacttctattgctcaaggctaccgtcggatgggtactttaaacccaatcctaggtgtgtgattgataaggaaacagaaacctgcacgctacaacttcccaaaagctcgccactgcaaggaattattagcgtacaggggaagagaaaaatattgaagcaacttgcatgccttgaagcttgtaaacaacttcatcgtgtgggtgccttgactgacaatcttgttcctgatatcgtggaggaagaaatcatcaacaaagaattggaatgtcaaatccagactgttgaagaatcaaaatactttccaccagaattggttagtcattgcagcaatgattcagaagcagtgtactactgctacctagttgagatgcaacatgcctcttacaacgacttcgagcttcatgggattatacttgctgttaggacaaggctcaagtgtgatgatgaaatactggcatttgacttggacgttgataggaggggactcttgcaagttcaacttaattatagtaaagttgttacacttactgctgaagagattcgacgatgtcagaggtttcaagtcagtgtcttcagaattcttcttgaccgtgatctgagtatactgcaggatgctttgggtgcagttcaatcgcccattggttctgcagtttctgattatctgttgctcccgtcattgggtagtacccctgaaataaattggaaatgtgtgaattctttgttgtttccgtctcaagctcttggggataagcatatggattggtgttctactcaagatcgcaaacgcagtgtgaacaccaaaaatgggttggtatgtagctgcatgttggagaattcattggtctttacacctcacaatggctatatatactgcgttaccggttttttggataagttggattgcaactcattgttgggaatgagaactggagaatccataacctacatagaatactacaaaaagcggcatgggatcaacatatgctttgaagaagaaccacttcttaggggaaaacatatttgtaaagtgcacaattaccttcagagaagcagaactcagaaggctaaagattcaactgattcatctgttgagttgcctcctgaaatttgttccctcatcatgtcacctctctctatttctacacttaatacctattcatatgttccttcaatcatgcatcggattgagtccttggttatggcctcaaacttgaaaagaatgcatttggatcactgcacactgaatgttcctattccaaccgctacgattctggaagcaatgacaacaaagaaatgccttgagaagtttcatttggaatcacttgagacacttggagactcttttctcaaatatgctgccagtataaagctgttcaagacttacgaaaatcatcatgagggtcttctcactgtcaagaaaactcagattatttccaatgctgcactatgcaagcttggatgtgctcgtaaaataccgggatttatccgtaatgaaccattcgatcttaaagcatggatcattcctggtgataattctcaagttcacagcttcgacgaagtgctcctaacgtcctcagataaaatgtatagtagggtaaaacagaagatcagaagtaagagagtagctgatgtggtcgaggcactaataggtgcctacctcagctcgggtggggaagtagcggctttgtcatttatgaaatggcttggagtggacatcaattttgttgatgcacctatgtcaaggcactttcccatgaatgctgagaagctagttaatgtcagatacttggaatccctgctacattacaagttcaatgatccttctctgcttgttgaagcgctaactcatggatcttacatgatacctgagattccacgatgctatcagcgcttggaatttcttggagatgcagtgctcgattatgttgttacagcacatctctatttcaaatatcctggactgactccaggactaattactgatttgaggtctgcctccgtaaacaacgaatgctatgctcaatctgcagttaaggctggcctgcacaagcacattcttcatgcctcccaagatctccaaagacagatatgtagtactgttgaggatttcgataaattgaaccttgactccacgttcggatgggaagctgaaactactttcccaaaggtgcttggagatgttatagagtctcttggtggtgcgatctttgttgattctggctttgacaaagaaactacatttcagtgcatacgacctcttttggaaccgttggttacacctcagacactaaagccccatccggtaagagagttaagtgaactatgtgaccagaaaggttatataaggaagaaggatgtcgtctctcgtgagaatggtatagcttatatcacagtagaggtcgaagcaaatggcgttgtccacaagagtacatgctcgggacgagacaaactaatagccaagaaggtggctagcaaaaatgtgctcaagtctctgaaagaatgtccatctaatgctactgaacagtagttacaaaattcccagaattgcttaaatattgtaagtgtcattctgtttggatgtgttgtttcatgatatgtactattggatctgttgttatgtgaaaaatgaaagattctccatctatggttaatttcttt

SEQ ID NO: 43 - DNA, 1021 bp, Solanum lycopersicum
tttgtatatatatatattaaagcccaacccctaatttgcttcattctatctccactttgcttctttatatcactcactataacattgaagagttttttttcctttttttttgattgggagttgtgaaaatcatcagttaaaaggacaatcttgatctgtattcaggcactagaaatcaagaaacaagatatggcgttggatcttcattttgaagaacagatagcagagagtacctttaacaaatgtcgtggtagccccttacagaaatggaagacgcttgatgatgagcgtgatgatgacaatcgcgctagtggttttgactgtaacatatgtttggacgttgtaaaagatcccgtggttacattttgcggtcacctttattgttggccttgtatctacaagtggattcaattccagggcgcctcggatcaccaaaagccacaatgtcctgtttgcaaagctaaagtttcacaaaaggagttgattccgctctatggccctggccaagcaacaaaatcatctgcagacggcgttacaagtaaaggcatggtcataccacaaaggcctctgaggccaacatgtagtggggatatagcaactacgacaaattcacttccatcgcaacaacttaaccatcgacaacagccacattcagggagctacacggcctcaccaaccgtgattggtgaagtggtttatgcaagagtctttggaaacgcatgtccaaactcgtataaccttgaaataaacacgagtttgagaatgagaaggcagctgttacacgcggatagatcacttggaagattatatttcttcctcttctgttgtgtattggtatgccttctcttgttttgatcacttttcgcgctacattgtgtgtaatttgtacatatgtttaccttattagatgctgaatatacgagcttcgctcaatgtaacatgtcttcgaagctttttctgttcttcatgctggctaatacacaattttattcttaacctaaagtgtgccattaacacccca

SEQ ID NO: 44 - DNA, 1190 bp, Solanum lycopersicum
aaagaaaatgaaaacgcgtacacgttctacataatcatcatctataaattattataattccaataactgtgtatctcttaagacaaaattcactcaaaattcaactactcaaagcaatttacaatcaatttctcgaatcatgacaggcacaggagacgaaaatcaacccaaatttaaaaaatcagagtctcaaataccttctgtttcttcatcatcttcagatccacaagcaccagaaatggatccccaaaaatggggtacccatattatgggtccgcctgcagttccaacttgtcatccagacaatcagaaagctgcttcatggagagctgaggatcaaagagaagagtttcagccacagccttatgttgtttattccccaattgataagcctagcaataacccacttgattccgttgttaatgtgttcaattcatggagtaacagagctgagaacatagctcgcaacatttggtataatctgaaagctggaccgtcagttacagaagcggcatggggaaaacttaatttgacagctaaggcgttgacagagggtggatttgagcctctttacaagcagatttttggagcagatcctaatgaacagctgaaaaagacgtttgcttgttatctttctactgcgactgggcctgttgctggtacactctatctgtcaactactaaagttgctttttgcagcgatcggccattatcatacaaagctccatctggtcaggaggcctggagctactacaaggtagcagtaccgttgggaaatattgggactataaacccaatagtgatgaaagagtctccaccagagaggtacattcagattgttaccatcgatggtcatgatttctggttcatggggtttgtgaattttgataaagcaaaacatcatctacttgaaactttgtcaatttttagagcacaaccccctcatctcaatctgcaacaaccagcagctacttactagaagcattgcctgtactctgttttagtgtgttttttttcctgtttgttcctgcattagatatgtatttgtatttcttttattgtaacattacttgtatgtttatacatattcgggagtgactatgttcgttttgatgtaaataaaagttctttgcgttttaatttatttgtcttgttttgacttgatatagaagattttgagatttgaagat

SEQ ID NO: 45 - DNA, 2579 bp, Solanum lycopersicum
ttcaaagctgtttgttctctttctctctctatccagaaactccgagatttgtctttccgagcatcaaattagggttctactgctgtctttgtgccgttcaagtatcggtttttggctaagttctagatttttccggcgacttatcggttttgagataaagggaggatttgggatttgaatatgaaatctgatcagtgtgttgcatgtggcttgagtgctggttaaacaactcaaaaggaatgtcagatttgcagttatacgggcttgacgatatatcttgggatgagttctgccacaatgatgatcatatagtgccacatccaagtagcggacgcaccaatgaaccactcccccagaatgatagtcgtaagaagcctcgccatgaagtaattggtttaacaggtaatgcaggtgatcaatctactggtaaatatgctaatcagcaaaaggagcaagtgttgagtaatagaagccccaaaatgctggaagaggactcgtgggccgatgcacctgatggtgcattctcttctccacgtcaaaaagccatagtcggagaagtttcaagtttaccatctgaaagtaccaggacatccgatcattgcatcaaaagtaataacatagactccattgagaacgagccttgtcctaatggttgcaatcttgatgacaagaatgcttctgtgggggagaactcttatagctatccacttggtcccatatctcaggctgataatgatctcagttttcttgataatagttgtgaggataaagactctaatgatctcttatattatagctggcctgagatagagaactttgaggatgttgaccggatgttcaggagttgtgattcgacatttggatttggacctggtagtgaagatgacctaggttggctttcatcatcagatgttattgaaggatctggagatggattgacgtctggttttaagtttccatgtccagcatccaatgcgcttggaagtacatccgccagttgtgatacttcaaagccaaaggaaacaaacatttcaacggataattctggcattgagaatcaatcacttggctataatagcagttcgtggtcctccgagaaaaatgaatctgtaaatctgggtcatatgccttttttaaatggatcaagtaatttacagtgcaagttagtacctgataagaaggctgaggtacatggtggtggagtccaggtcgagattatatctaataaccaaccaagaatcaacgataatatagtggatagcatgcaaaagaaacactccaagcaccagaatcgctctgagggtaaaagaaaatgtggttatctagaaaatggagacacactcaattacactgatagccttccagaggagcagaagctgccatctgggaccggaagcactcacgtgagtttcgcatctgcaggtgtcctgcagcaaaagcaagctcaagatcctgattttggctacttgggtggtagcttctcttacatggattcagattacggtcattccgatgggagtgctctccatccaactctaccaattttaaaatatgaaagtaacggtctcgtgtctctttcccccaaggactcttatgcatcaaatcaggtacagtccatggagggttctcctgatccttcttttcaggtggctgctatgacaagaaaggagaaggtggagaagttattccatccgtcaggagttaagattgaaaataaacgtgattttgaaggggttggcataagagctcccacagaattaggatcctcagttgtacaggagtgttcttctataaattctggcttggatgaaatttcagaagaagcagctagttttcatcagcttcaacgtgtcatggaacagttggatataaggacgaagctatgtataagagatagcttgtaccggttggctcggagtgctgaacaaaggcatagacatgctaatctcaatattgtctctggagatgatggaggtaccagcggaccactggttaccgaaggaacaaacaagtgcacaggatatgtggacattgagacagacacaaatcccatagatcgatctattgctcatttgctattccacaggccttcggattctgctgttgcccctgcccgcgattcctcgactttgaagtcgccttccatgattcacgggtcgttgtctagcacaccagtgatgagtgataacgtgatctctcatggagaaattgcacctcaaacagatggagaagttgctgattgaccataactatttaagaagtcaattccagtttgtggggggaatttcacatgcagaaatgatcaaagatcatacaaggaacctttatgttttgaatgttttctctggaactggtttctggtccatgtgagaacatatccttgtatgagctttcacaatcaaattatatttgtttcactctaacccttcctcagtcggaaggcatacacaaactacctttcctgtgtatacgtagatcaaaccaactgactctttttttgttgtttgtaagtagataatacctggaaattttccagaagatacttgcaagtcttgtagtagctcatgacctgttcccct

SEQ ID NO: 46 - DNA, 977 bp, Solanum lycopersicum
tagttcatagcaagttttttcctcatagactatatcttaaaaaatatatgaaaatgaataatctttcactcttatttctcactcatctcacactatttttcatttgtgtttgttcacaaaatatagcacaaacacaatttgtttataaatggtcagaaacttattgtaataaggatacccctgtgggatgtaagcaaattcctcctctcaaattcactctaaaaggtttttggggcacagattccaatggaaatattcaacaaggttgtaaagatccagtagaacgtgattggaacaaagtgtttgataccgtgatggtagataaactcaacgtattttggccctctcttactaaacaagatcccaaagacatgtggaaggaagcttggaatacatatggaacatgtacaatagaaaggttcaaaactccaatacaatatttcaatagggcttcaagattggatagtgaaattggagatttattacaaagtcatttaataaactcaaatggaattgtcccttgtgactctgctacatacaacaatgttgagatcttgaactcattcaaacaagttgcaaaggataaagatgtgtatttcacttgcaaagacattaacacaactcatgcttatttgaatcaagttacattttgctacacaaatgatgcaaagaattttgtgaattgtccaacttctctcattaacaaacgttgtcgtgttcaaaacattattgttcctcgtccttcacctccaaagcctatcaaacaacaggagaaaagcttggaccaaatagcttatggagattcttggtcaattgtgtgaagctttattatattagaaagtttagtgataataataatattaattattaataatagaaagatgaataatgtttttaattgtgactgtgatatgtactgaataatgaagcaaataaaatgatcatctttctattttatttatatttattgtgactca

SEQ ID NO: 47 - DNA, 1676 bp, Solanum lycopersicum
agcggagagttggagaaccacgttagcagtatacgacaaggaagattaccagtgtccagtgtgcgtgtgtgtaatttataatcaacaaaattagcagtggccgagttatcttttagtttttcaaaaacaagaagaggtgcagagaacagggagggaggaagaagcaatggcggagtctcagttggttcaccctcctttattcacctatatctcaatgatcactctgctcactttagtacccccttttgttattctcatgtggtatacaaatgttcatgctgatggatctgtattgcaaacatataattatctaaaggagaatggcctgcaaggactaattgacatttggccaagacccactgcaattgcgggaaaaataataatttgctatgctctatttgaggctacacttcagcttttgttgcctggtaaaagggttgaaggaccgatatctcctactggacacaggcctgtctataaggcaaatggcatggcagcatatacagtgacactaattacctatctcagcctttggtggtttggaatattcaatcctacaatcgtgtatgatcatctgggagagattctctctacactaaattttggaagcttaatcttctgtctctttttatacataaaaggtcatgttgcaccatcttccactgatcacggttcatcagggaacataatagttgactactattgggggatggagttgtatcctcgcattggcaaacactttgatatcaaggtcttcacaaactgcagatttggcatgatatcttggggactcctccctattacctactgtataaagcagtatgaagaatatggaagtctctctgattccatgcttatacataccataataacgttggtgtatgtcacgaaattcttttggtgggaagcaggttactggaacaccatggatattgctcatgacagagccggtttttacatatgctggggttgcttggtatttcttccatgtatgtacacttctcctggcatgtaccttgtcaaacatcctgtaaatcttggacctcagcttgcaatttctatcctagtagctggtattctctgcgtatacataaactatgattgtgacagacagaggcaagagttccgcagaacaaatggcaaagcccttgtctggggaaaggctccttcaaagattgtcgcctcatacactactacaactggcgaaactaaaaccagcattctcctgacatctggatggtggggcttatcgcggcatttccattatgttccagaaatactagcttcgtttttctggagtgtgccagctcttctcaaccatttcatgccctacatctatgtaatctatctgacgggcctccttttggatcgagccaaaagggatgacgaaaggtgcaagtcaaagtatggcaaatactggaaaaagtattgtgaaaaggtgccttaccgggtagtccctggaatttattagtgattcttgagcttcaactgatgaactgtctttaatagtgctgcttctagtattgtagtagtatttagaccatgaaaaattttcttctttcaataaagcacttttagttgaaccaacatctcatttctatggttgtaagttgttacacgatgaaaaaatcagcttgaaatagatatgccgtgaaattagttgaggtgtgtgaaaa

SEQ ID NO: 48 - DNA, 1581 bp, Solanum lycopersicum
ccaaaaacaaaaaggaggtaaaacaccgaaagcagttgggggagaggaagatgaacttcctccgtagagtaatttccccaggctctcgttctcaagtttctcaatttgcgaataggtccttcaaaattacacaaaagcattatgggtccattgctcaacccacctcaagctccttggttcatggcattcatcaatttcattgcccagatgtggttggaatccttgcaaaactatcggattgcatagcatcaagggaaggaaatattctcagtgctgatatttttgttccagacgacaatcatgtcttttactccagaagcgagtttctctttgaccctgctaaatggccaagagagcaaatggatgcagacttctctaatctagctaaaaagttcaatgcgatgaagtctgtcgttcgggtgcctgatactgatcccaaatataagatttcaattctagcttcaaagcaggagcactgtcttgtggacttgttgcatggttggcaggatgggcggtttcctattcacataacttctgtaataagcaaccatgaacgaggtccaaacactcatgtgatccggtttcttgagaggcatgggattccatactattatttgccaatgactaaggagaataaaagagaaaaagaaatcttggatatagttggggatactgactttttggttcttgccagatacatgcaggtattatctggggacttcttaaaaagctataagaaagatatcattaatattcaccatggcttgttgccatcgttcaagggtagtaatccatctaagcaggcttttgatgctggcgttaagttgattggggcgacaactcacttcgttagtgaagaactagattcgggaccaatcattgagcaactggttgaaagggtttctcatagagataatttgcggacatttatacaaaagtctgaggatgttgagaaaaggtgtcttgcaaaagcaatcaaatcatactgtgaactgcgtatttttccatatgaggcgaacaagactgttgtttttaggtcctgattgaaaaggaagctgtggtagctgcatcatctctttccattctgtccatcattcgggtgatcatcgatatcatcgttatcactcagttatccaagcaaaacttccacacaggccactccgagaagtaaagacacagaaggtgtttcatctggaaaaaggaaagagaaataaagaggtttcatctgaattcatgttttaaaattccaatttttaagacactgtcttgatatctgtttccatcttatcacatgcaacagatatttgtacaagttccaaattctgttctttgatatcaaaagtgcctcaaagctgctttcaattgttatagaacttttaaaccttttgtcatttgaattatgtttttgggtactaatcatctggtggtatctgattcccactgtctcgattaattcaaatttccgtgctattagggatttttccattttcagggctcgaactatgttttagtgcatgccatttgaattatgttattgtatgaccctatggtgatgaaattcaaattccttttagggtcaaa

SEQ ID NO: 49 - DNA, 669 bp, Solanum lycopersicum
atagctatgttttaaaatcatcgaaaaaatgaaaacttttaattgcaatttttacatttttcttcttcttattcttcctcttatttttgaatcatgttgtttagcaagagttcaagttcatattatcaacaagcttcctgatggactggcaatgactctccattgtcaatctcatgacaatgatttaggacagttgagattgacgggaggtgacgaagctagttggacttttagtgttaatttttggggcaccactatgttttattgcgacgctcaatgggatgatagttccacaacatatcgttttgttacttatgatgccgctcgggatgcccgacgatgtcaaacggaatgctggtggatgatctctgaagaagaaacgttatatggttataatcaagagagtgaatactgggagttgtttcccttcaccagtgcataaaatctcttaatgatgcctattatcttcgtgtgtgtttaaaaaattatcaatttttcgtatttaagattaaccaaatccaattatcgttacttcgtacaatgtaaggttgttcggtgatcaacacatgtaacatgtacaaggcaatatgatatttatatatagttactattacttacaatttcatcattgctgcaaaattatcttaatataattataaagtttgatta

SEQ ID NO: 50 - DNA, 645 bp, Solanum lycopersicum
attaacaactcaattcttctaacattcgccggaaaattcaaaattatggaggtacataaacggaaatatatacacgatggagagatcgaagcaaaaaagcaaatgaaaacggaggaaattgatggaacggcggcggcggtggtggaggacgacgaagtggaggagttttatgctattctgcggagaatacgagtggcggtgaagtatttcgagaagggaaacgccgagggcagtggcgccgggagaaatctgacggcggcgaagccgtggagtccgaatttccggcaggaggaattgaaacgggctgttgacggcgttaaagagagagaaaccgtggaagataatgcgggtttggatcttaacgccgacccggttactgatccgagttcttcagaagccaattaatttaattttttttttggcttaactattaggggatttcaagataagtgggagtaaaattattataattcgataatatgtttttctttttcattttaattggatcgagttattttttttttttaaggttaattattaggatattttgactcttaatatgtttttcgcccattttaattgcctcggaggggctgtaattactgattatgactaattatacactaaaactatatttatatcgtt

SEQ ID NO: 51 - DNA, 1408 bp, Solanum lycopersicum
attcatatcaatatcaaaaaatttctctcaaacttattttgataatactccataaatggatgggagaggagggtgttgtattgctaggtatgcaggaggtgcgtacgatatgtcaaaagtggataggataatgcttaaattcagacctatagcacctaaaccagcagcagccggtagttccgtttccggcacgactactccaccgcaaaaatctgaggttccggttcgtactggacggtggaagagaaggtatgttaaggacaataaaaatagtaataataacaagagatctagtagcggcgggtgtagtcctactcctagtcgtaggaaaaggaaagctcggtcggttgaagaaaatgattcaagcgcaaaatcagtgtctggcggagaaacggcagttactctgccgttgttatcggagattcctgaaaggaaggataattcagttgatatgatgaaaaaaaatgctccgatctggttgagttttggtggtaaccaagggaataataatgataacagtaataataataatggtcagttgcagggagtggctatggatcggtcagttgtgatgtttcctcagccagtacgtgtagtggggtcatgggtaaaggtggaaagcgtgacagacgcgtgggtggaagggtatgggttaggacgtacggatgaggaaaaacttataaatctggagcgggacagctgtccagggtttatatcagacggtttaaatagagttaggtgggccaacaaggcatacaaggggatggtgggtgatggggcaggggaagtggttgtttggctagtgatgaaagatgatgtacggctgccggagagcaaatccacggcggcgttcacttgccgggttagggttgtcaggtgcgggaaggaaaaaaattcattgattctgccgtgcgatgtgtggagaatggacggcggaggatttgcatggaggttggatacagaagccgctctctctttggggcggtaggtaggtaattgaagtaactccacctgaagggtaaagaagtaaatctgtatgccgaaccactaataaaacttgccaccttgtgccttgtctacgtatagaggacatgcagacgacttgcatgtgcttttatcagaagaaaaattgtgaatatctttttagagttcagaaatgtttttttaggtgtgtttaatttttttttggttttttcaaggcggagtttggatggtggcggatttacttatgcctagttgtgtggtttatggaatgttcgttagggatacttattgatatacagtgttactactagcagttgtagttgaaccagggaaaacatatcatgatctgttatctgactttggacttcgcgttcctgtttctaatttaacatcttacatacatattttgttccaactatttcac

SEQ ID NO: 52 - DNA, 564 bp, Solanum lycopersicum
atcggccgaattcccatggggatccgatcaaatcatcaaaccaactattcagcaatctaaataccagagtaccaattcatcatcacaaaaaaagacaaacatagtttttagaagtaagaagaaattaaataaaaatgagttcaagcaggagagcatggatagtagcagccagtgttggagcagtagaagctttaaaagatcaggttggattgtgcagatgggattatccattgaagtgtttggcacagcacacaaagaataacatgagatgttactctcaagctaaaaaactttcatcttcacttattgcaaagtgtgaaaagacagagcaatctgaagaatctctgagaaaagttatgtatttgagctgttggggtccaaattgaacattttagcatagtggtaaatgagacagaaaaagaaaagtgtaaataggacaaagattgtactagttgaagggcatgccattttaaagataagcatgtatctgtaatcttatgtgatactatatgaatagagttgttattttggtgaaattgatgcattaatagatcaactaattgc

SEQ ID NO: 53 - DNA, 1425 bp, Solanum lycopersicum
gtgaccgtgtcaaatgcgttgctcgtaaccctattttctctctcattttgccggagtttcgatggctttcgtaaactccatttcaacagttacaagaccataccgccattctcgtttcttataaacactctatttctcaaacaatttcaactcttattcccaattttcaactttaatttgtcaaagatgtggagaaattcctgtaatctattgaaacggacagttacattggttgcgaggacaaatacggttaacaatggggtgaggccgtttttgggtgtggattataagttcgggtgctattgtggcccgaccagaatggtgggtgggtactattttagctctgggtcaaatgggggtggggaaaacaagaatggggatagtattactcatgaggaagctaagaggttgatgagattggtgaatgttgaggagctgaagtggaaattggggatgaagaatacggaggttattgggtatatggatctgttaaaggcgtgtaagaatatgggtgtggctaaaacccatgatgaagctgttggttttgctagagttcttgatgaggctggtgttatattgctattcagagataaagtttatcttcatcctgataaggtagtggatgaaattagaaaggcagttcccttagcacttctacccgaaaatgaccccacaatagaagaactaaagattctgcaagagaagaaggataaaatagatgagcttgcccataggcatgtgcgtcgcgttttgtgggctggtttaggggctggccttttgcaggttgggctcttcttccgtcttacgttctgggaattctcttgggatgtgatggagccaattgctttttttacaacttctgctggaatagtaataggttatgcttacttccttgttacttctagagacccatcataccaagatgtgctgaagaggcttttcctctcaaggcagaggaagctgatcaagaagcatgattttgatattcagaggtttgtcgaattacaaaagaaaatcaaattaccagtgaatagtcaatcttccattaaacatcggttaggaatggagctggaacccgaggatcttttacatggtcactaaatcatgttggcctctgatcctcttcttcccagcttctcacataactatatccttactaaactcataccttttagccaatgtaagcccttcattttgtcacggaaggtgaatatctcagttgttaacaatcatccctgattttaccttgtaatttgaaggttatatttcttaaatcttctttacaagataggcttagatagtagttctgtccatcacaatatccttcaagccttttactctgatgttgttgtcctgtcatatatacttgaaagttgtacaagatactgatgttatatcaatgattttatgttcgttcttctggat

SEQ ID NO: 54 - DNA, 1740 bp, Arabidopsis thaliana
aagttatcaacaacaaaaaaagaaaaaaaaaagtcccacaaacacaaagtgtaatatctaaaaatccatatctccatctctcccctctatctatcgctccctctctctaattcttcggacacaaagcataagacttgaaggaagcaaaatgagtttgtggtatatcattgttgcattcgtcttcttttcaactataatcattgtaaggaacactagaaagacaaagaagaatctacctcccggacccccaagacttcctattattggaaacttgcaccaattgggatctaaacctcatagttcaatgttcaaattatccgaaaaatatggacctctaatggctctaaggtttggaagtgtgtctactgttgtggcttctacaccagagacagtaaaggaagttttaaaaacatttgacgcagaatgttgttcgcggccttatatgacttatcctgcaagacttacatacaatttaaaagatattggcttttgtccctacaccaaatattggagggaggtacgaaagatgacagttgttgaactctacactgcaaaaagggtacaatcatttcaacatacaagaaaagaagaagttgcatcactcgttgatttcatcacacaagctgcgtcattggagaaaccggttaacttgaacacgaagttaatgaaactatcaggaagtgtgatttgtagagttgtatttggtatcaatcttaaaggaagtaaacttgagaatctttatgaggaagttattcaaggaaccatggaggtggtggggagttttgcagcagcagattacttcccgatcattggtagaatcatcgataggatcacagggttacatagcaaatgtgagaagattttcaaggcaatggatgcattttttgatcaatctataaagcatcatctagaagatgagagtattaaggatgatatcattgacttgctcctcaagatggaaaggggagagattgaacttggggagtttcaacttactcgagacaacaccaaaggaattcttttcaatattcttaacgctggaatagacacttctgcacaagttatgacatgggtgatgacatatttgatttcaaacccaagagttatgaagaaagcgcaagccgaggtgagagaagttataaaaaacaaagacgatatcattgaggaagatatagaacgactcgaatatctgaaaatggtagttaaagaaacgtttagggtattaccgctcgttccacttctaattccaagagaggcttcaaaagatgtaaagattggaggttatgacattccaaagaaaacatggatccatgtcaacatatgggctattcataggaatccaaacgtttggaaagatccagaagctttcatccccgagaggtttatggataaccagattgattataagggtttgaactttgagtttttgccgtttggtagcggaaggagaatgtgccctggtatagggatgggtatggctttggtacacttgactcttatcaatcttctttaccgatttgattggaagcttccggaaggaatggaggtagaagatgttgatcttgaagaatcatatggacttgtctgtcctaagaaagttccacttcagcttatcccggtccttacccaatggagttgattttatattttcatagttctaaatgtaacccttaagaagtatcctaaagttcttatccttatcactagatgagtatccacgctatgttgcgtttgttttta

SEQ ID NO: 55 - DNA, 1090 bp, Brassica napus
gatgattcctctgtctttaatagagagagaaagggagaagaaacgttaatcaatggcgtcgagaccgtgcgattcgtgcagatccgcggccgcgactctgttctgccgcgcggacgcggcgtttctctgcggcgaatgcgacggaaaaatccacacagctaacaaactcgcctcgcgccacgagcgagtcttgctctgccaagtctgcgagcaatctcccgcgcacgtcacgtgcaaagccgacgcggccgcgctctgcgtcacgtgcgacagagacatccactccgctaacccactctcccgccgccacgagcgcgtccccgtcacgcctttctacgacgctccttcaaatgctgacgttagcatggaggctgcgtcttggctcttgcacaacccgagcgtcaaggaaggaggtgtagagatcccaaacttgtttgccgatcttgattactccggggttgatccgaagatggaggcgtcggagaatagctccggcaacgacggagtcgttcctgttcagaccagagctctgtttctcagcgaagattacttcaacttcgacatctcagcttccaaaacaactttcccacacggattcagctgcattaatcaaactgtttcgtcaacatcgttagatgttccgttggtgcccgaaggtggagctgtggtggagatgtcaagaacgacggcaacaccagccctgcagctatctccggcggagagagaggctagggttttgaggtatagagagaagaggaagaatcggaagttcgagaagactattaggtatgcatcacgtaaagcatacgccgaggtgaggccgaggatcaaagggcgttttgctaagcgaactgattcaagagttaatgatggaggagaggtcggagtctacggcgggttcggagtggtcccgagtttctgagtcttgttcagtgtcatgttgtaagaaacattgatgatggtagctaaagtaacggttattagagaaatgtttaatagttgaaatgtttttttattaacgtcgaacaactgatatgtgtcactccaaaaccatatcaaatcagcaaatataaattataaattacttcca

SEQ ID NO: 56 - DNA, 1011 bp, Brassica napus
agcatcagagagaaaagaaagaaagcaaacagagaaaatgtgtggcggtgctgtaatttccgattttgcccctaacgtcaccaaggctaagggtaggaaactcacggcggaggaactctggtcagagctcgatgcttccgccgccgacgatttctggggtttccattccacatccaagactcaatccaccaaccaacaagtgacgttgaaagaggaggcggcggagaaggagaaggaaaaggagccggtgacggagaaaaggaggaagaggaagaacgtttacagagggatacgtaagcgaccgtggggaaaatgggcgtcagagattcgagatccaagaaaaggcgccagagtctggctcgggacgttcaacacggcggaggaagctgccatggcttatgacgttgcggcgaagcggatccgcggcgataaagccaaactcaacttcccagatcttctccaccatcctactcgtagtcctgcgactcctctagcatcgtctccagtttcagaagttcagcctccggcgaagaagcactgcgttgtctctcagagcgagttgactcagccgagtttcccggtggagtacagtggagtggggagcggggacgagtttcaactggactacgatctgaaacagcagatatcgagcttggagtcattccttgagctggatggtgacacggtggagcaaccgagtcagctcgacgagtccgtctccgaggtggatatgtggatgattgatgatgtcttcgcgtcgtatcagtaataaacgtaatataagtagaaatattaaataaagtttgtaatataactgccgttacgttctaaggtttgtaatgtgatgacatgagcgactgatgttattatatgttgtcgtttgtaatgtgtgttcttgtgactcatttggagcgttacatctacggtttatggtattgcttattctcttcttttttaatggaaaatatatcatgctgtaaatacaaaataagaaaatgagtaggataccac

SEQ ID NO: 57 - DNA, 1694 bp, Medicago truncatula
aaaccttttacctctcattctccaacaccaatcttttccaacaacacacaaaaaaacacaaacaaatctaacatggcttcatcaatcacaaaccttaactcaccaaaattactacccatttccaaagaacaaaccaacccattttcccattttccatcaaataccttaaagtttgcatctttgtcttcaagaacattttctaatgtgtcttgttctgttataagagatacttcctctgttcttccattgcaggatgcaaatgggtcggttgttcttcaacgacccgattcatttgggagatttgggaagtttggtgggaaatatgttcctgaaactcttatgcatgctcttactctgcttgaagcttcgtttcattctcttgctggggatgaagattttcagaaagagctggctgggattctaaaggactatgttggtcgggagacccctctttattttgcggaaaggttgacggagcattacaagaacgctaatggtgaaggacctcacatttatctgaagagggaagatcttaaccacaccggggctcataagattaacaatgctgttgctcaagctttgcttgccaagaaattaggcaaaaagcgcattattgctgaaaccggagctggacagcatggagttgccactgctactgtatgtgctcggtttggtttggaatgcattatttatatgggtgcacaggatatggaaaggcaggcactgaatgttttcagaatgcgtcttcttggtgctgaggtgagaccagtccatgctggaactgctacacttaaggatgctacatcagaggctattagagactgggtgactaatgttgaaacaactcattacattttgggatctgttgctggaccgcatccatatccaatgatggtaagagagtttcatgctgtgattggcaaggaaacgagaaagcaagctttggaaaaatggggagggaaaccagatattctgattgcatgtgtcggtggaggttcaaatgccatgggacttttccatgaattcgttgatgacagtgatgttaggctaattggtgtggaagctgctggctttggcctcaacagtggcaagcatgccgctacgttgacaaagggagaagttggtgttttgcatggagctatgagctatctgctgcaggatgatgatggacaaattgttgagcctcactctattagtgcaggcttggactaccctggtgttggacctgaacatagctttttgaaagacttggggcgtgctgaatatcatagcatcactgatgatgaagcattggaagcttttaagagagtttcgagacttgaaggcatcattccagctctggagacatcccatgcgttggcatatctagagaaaatatgtccaacccttcctaatgggacaaaggtcgtggttaacttcagtggccgaggtgataaggatgttcaaactgttaccaagtacttgaagctttgaaaacgtcatgttcttgtattgaataatggtttagctgctgaatggttggtttcattttcatacttagagacagaattagttcaatttgattttacaaaagcaagctatagttaaagaacaatgtatatttgcttcacagaactcctgtctttttaataatcttctgtttggaatggtacaataaaagtaataaatgccacaaaattatgctgttgcaactt

SEQ ID NO: 58 - DNA, 1605 bp, Solanum lycopersicum
cacctttaaacatatactgatactgaacttgaaccttcaatatctgctaatggatctcaataatctcttcatttctctcactccatcatggacttcggtgtctatgttgatcggattttttctctatttagctaccgttggatctattctacccggaaaacttgttcctggggcgactttatctgatggaactcgactccattatcgttgcaatggtttattatcacttctgttgttggttttgcttcttggagttgggtcgcagatgaatcttgtttcacctactgctatagcagatagaggacttgagcttttgtccacaacacttatctttagtgttcttgtgacattgatgctttatttggttggcctgaactcacgtgcaaagagttcatcactgaaacctcatgtctcaggaaatctaatccatgactggtggtttgggatacaactgaatcctgaattcatgggcattgatctcaaatttttctttgttagagctggtatgatgggatggttacttatcaatctttcagttcttgcaaaatgtgttgtagaggctaaattgagccaatcaatgattctctaccagctattttgtgggctctacatccttgactacttcttctatgaagagttcatgacctccacatgggatataatagcagagaggttgggctacatgctggtttttggtgatctagtctttataccgttcaccttcagtattcagggttggtggcttttgagtaacaaagtggagctaacaacagcagcaataattgccaattgcctcgtctttcttattgggtactcggtgttcagaggagccaataagcagaagcatgtatttaaaaaggatcccaaggcacccatatggggtagtcctccaaaagttattgggggaaagttgcttgcttctggctattggggcattgcacggcactgtaattacctcggggatttgttgctggcatcgtcttttagtttaccttgtggtataagctctgtggttccatacttttaccccatatatcttctcattctactcatatggagggagagaagggacgaagctagatgtgcagagaagtacaaagatgtgtgggctgaataccgtaaacttgttccttacaggatcttaccttacgtttactagctcaatcgtttgtccacgttgcttgtgcattagagtcagaattagcctcactgtaccgcactacccaagcatgagaagggacgaactcatgaatgaatattacatcaaattcgagcttttgccctatctatgcagctttctcatctcctctacgaaagtaatcttttaatctatttcagttaggatcaacactgtatccaggttgtaactgattgcttagcttttgaaagtttttccagaaccaacttgtacactagatgtactttatcatggcaggatttaaatgtgctgcttgtattgaatgccaactatggaattatttttcatggtttgtaatcttggagcagcttactaatgtgtgctgaaattttcgaatgattttcccgactttctagttttttgtatgcaccttgactaatttcaggagatatttgctacgttccacc

SEQ ID NO: 59 - DNA, 1022 bp, Solanum lycopersicum
acaatttacaccattttttttccattctcatattcattttctattttattctctactcatctccaaatttttgttaaattaacctaaaaaataaaagatggcttctaacacattgatgagttatggaattgcacctgtttacccctctattctctcttcttccaagtctaaattcgccaccgcgttgccggtatccaccggagttaccaacgacacgtcaaggttcagtatgtcggccaattggatgcccgggcagccccgtccatcctacctcgacggctcagaccccggagatttcggatttgatccacttggttttggagaagtaccagaaaatttggaaagatacaaagaatctgaacttattcattgcagatgggctatgcttgctgttccagggatcatagtaccagaggcattgggcttaggtaattgggtcaaggcccaagagtgggcagccattcctggtggacaagctacatatttgggccagcctgttccatggggaacacttcctactattttggctattgaatttttagccatagcctttgtagaacaccaaaggagtatggaaaaagattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattagagaacttggcaactcacttggctgacccatggcacaacaacattggggatgttattatccctaaaggcattttccctaattaaattatactatttatcatatagtatattagccaaaaaaaacaccttgtaaaactctcccatattgtactcatatagtcttgtaatgaaatggactctttgtgtatcctgtgtctatgcatgatatctctatctaaatatccattttattcgtacatgaattttagatttaaacttgattaaattt

SEQ ID NO: 60 - DNA, 2042 bp, Solanum lycopersicum
ttattcggaaataaaaaaaaatgttggtctgtatttgagggttggaaagagtagtatataaatgttatacgaaggtctctctctcaacgcacaacttcactcatttctttctcgaatcactctctttctccctcttcccgaacttgtaggatttcctgtcaaacattctcctcgccggagaaggaaataaacgtcgtcggtgttcaggttgattgaaggttctacgtttgatccgttcaattcttttggctccaagttgtagttgaaacaaatcggaaatggcttctcaaccgaagaatgttggaattctcgctatggagatttactttcctcctacttgtcttcagcaggaagtattggaggctcatgatggagcaagcaaaggcaagtatacaattggtcttggacaagattgcatgggcttttgcactgaggttgaagatgttatatcaatgagtttgacagctgtgaattccctactggagaagtattctgttgatccaaagcaaattggtcgactagaggttggaagtgaaactgttattgataagagcaaatctatcaagacattcttaatggaaatatttgagaaacatggaaatactgacattgaaggagttgactcaactaatgcctgttatgggggaactgctgcattgttcaactgtgtaaattgggtggagagtgcttcatgggatggacgctatggtcttgtagtatgcacggatagcgcggtctatgcggaggggcctgctcggcctactggaggagctgcagccattgctatgcttgttgggcctgatgctcctatagtatttgaaagcaagatcagggctagccatatgtcccatgtctatgatttttacaagcccatccttgacagtgaatatccagtggttgatggtaagctttcacaaacctgttatctaatggcacttgatgcttgctacaagagtttatgcaacaaatatgagaaattggaaggcaagcaattttcaatgtcggatgcagcctactttgtgttccattcaccatacaacaagcttgtgcagaagagctttagtcggttgctgttcaatgattttctaaggaatgctagctctattgatgagtctgccaaaaaaatcctggccccctttgaatccttgaccggtgatgaaagctaccagagccgtgatcttgagaaggcatcccaacaacttgctaaaccactttatgatgagaaggtgcaacctaccacattgataccaaaacaagttggcaacatgtacaccgcatctctttatgctgcttttgcatccctccttcacaataagcacaacacattggctggtcagcgggtaatcatgttttcctatgggagtggattgactgcaactatgttttcgctaaagtttaacgaaggtcaacatccttttagtttgtcaaacattgcaagcgtgatgaatgtcacagagaagttagaatcgagacatgagttcactcctgaaaaattcatcgaaatattgaaactaatggagcatagatatggtgccaaggacttcgtgaccagcaaggattgcagccttcttgcaccaggaacctactacctaacagaagttgattccaagtacagaagattttatgcaaagaaggctcaggagaatgggctggtcaacggacactaggacagcaaacacggtccttgttgcacggtgtaaggccatatagtaggcgactcgtgctgtttaagttattgttagcgcatagaagaataactagtgctctggcagattcgattgttattacatgtagtttctttccagagtagtagatgtagatcctatgccttttttctttcttttttcagttcctgacgagttctaatgttgtgcatctcctctgtcttcacctgtatgtgaaatgattgtaaaagtagtcaacctagtcttttgtcgaaattcatttctcatctacaataaactgatgtatttatgagaaagatcatttaaatgggtgattgctgaaatttgcgaaatgaaagaacttatcttcattttcta

SEQ ID NO: 61 - DNA, 678 bp, Solanum lycopersicum
aagatcctctgttttcttcaaacaacaaatgtctctgattccaagcttctttggtggtcggagaagcaatatcttcggcccattttcccttgacctatgggatcccttcgagggcttcccaattgccaacaccccatcctctgctcgtgaaatctctgcttttgcaaatgcaaaaattgattggaaagagaccccacaagctcacgtcttcaaagtggatgttccggggatcaagaaagaggaggttaaagttgaagtagaagaaggaaggattttacagatcagcggtgagagaagcagagagaaagaggagaagaacgatcagtggcaccgtatggagaggagcagcggtaagttcaaaaggagattcaggttgccggagaatgcaaaaacaggggaaataaaggcagagatggagaatggagtgctgacagtgactgttccaaaagaagaagagaagaagaaatctgaggtgaaggcaattgacatctctggttaaacaagtgtttgatgaaatttcctttctcaataatatgtgtttctcaagtacttttggtttgttggagattaagatcttaattttaatttatgtataattgtggtcttcttctactagcatttgtaaacaagacaatgtcgcgagtgtttaattaatgaaaaatttctttttgttgtaaa

SEQ ID NO: 62 - DNA, 1743 bp, Glycine max
ctgtgtagttgagtggttgtatgcaaaggcatcgttttggaagaacaagggcatgtgagaaaaaacatactaatcaaattaaacagcgaagaagagtttcaaatttattgcttcgaatctccagcttcgtcagggaaggaaaacagcataacgtgtggtctcgggggaaccaaaaactgtgaaattctgaagccactaggccttttaaaaaccaaactaaggaagacggtttagacagagagtacttcaagctaagaaaatggaaagtggggttgtggctgtgaacaacaacatcaacaactatgaatccaaggcaacttccaccatcaccattaagggcattctcagccttctaatggaaagcattgatgatgagaattgtgatggtggtggaagcaagaagagagttatttctcttggtatgggtgacccaactctcaccacattgttccacacaccaaaggttgttgaagaggctgtcgctgatgctcttcaatctcgcaagtttcatggctatgctcccactgctggacttctccaggctagaattgcaattgctgaatatctatctcgtgaccttccttatcaattatcacgagatgatgtcttcatcacttgtggatgcacacaagccattgatgtttcggtggcgatgcttgctcgccctggtgcaaacatcttgcttccaaggccaggcttcccaatctatgaactttgtgctgcatttagaggggttgaagtgaggcattatgatctgcttccagagaaaggttgggaggttgatctagatgctgttgaagctcttgctgatcagaacacagtggcgttggcgatcataaaccctgggaatccttgtgggaatgtgtacagttaccaccatttggagaagattgctgaaactgcaaaacgggttggaacaattgtgatctctgatgaagtttatggtcaccttgcatttgggagcaagccttttgtaccgatgggagtttttggctctactgttcctgttctcactcttggctcactttctaagagatggatagttcctgggtggaggcttggttggtttgtgacaaatgatccatctggcacttttagagaaccaaaggtagtcgagcgtatcaaaaagtattttgatcttctaggaggtccagcaaccttcttgcaggctgctgtacctcagataattgcaaataccgaagaaattttcttcgagaaaaccattgataatttgaggcatacagcagatatatgttgtaaagagatagaggatattccctgcattttttgcccttacaaaccagaaggatccatggctatgatggtgaaattaaacctttcacttctggaagatattagtgatgatattgacttctgtttcaaacttgcaaaggaggaatctgtgatcattcttccaggaactgcagtaggcctaaaagattggcttcgtattactttcgctgctgatccatctgctcttggagagggtatgagaaggataaaatctttctatcaaaggcatgcaagaaaattgtaaagctatagtgaattcacttataagtaaaattactaaataaatggccctttactactagtatactacacaagaattgaagattttatttcaatatagcatacagtctctttaggaatggaccaattaactggacattgcaacataattaagaggcaatcctctttatattgaagcattatctttattcaaatactaaacggttcatg

SEQ ID NO: 63 - DNA, 615 bp, Glycine max
actttgagagacagtggcagcggcggtactctcaaattgatcctctcagtctgaggaaggaagacggtgcgttcgtaaaaagtgaaaaagaaatggcagaactgagtttgggaattctaattgatattgttgatgaggaatggatgagagacactctccctgatgatgatcttccactgcccccaacactggttgtaaggacagatgatactgaggactcaaatcaggagacgcaacaagttaatctggatgcttggcacgatcttgcctttggtcaagaatagaagtttcatcattaaccagtgttgtgttttgtacttagtgagtagatggtccctgttatttggacttggcatcttcctttctatttccccgatagattgtaacttatcaactactagtacctgttaaggttatattaaggaattgtggtgtcattgctgaatgttaatgtttgctgtgcctgtcaggaaagcacttttgtatttttgcttcaaggttgaagtaagtttagggcaaccagtgcctactggtatgctctggagtctgacacctgtattaagttatgttaaagtaatattaatatgtttaataataatacatagtttctcaaaa

SEQ ID NO: 64 - DNA, 1729 bp, Arabidopsis thaliana
ttctcctatttctctcttctctctctctttaagtgagcttcgccgttaaactttctccggtaccgggaaattaacgaagaaagcgaaaagtcactgttacactaatatcacaaatctctctctgtctctctctctctctttgtcgaagtcgtgcgtgatgctagttacggtggtgaagcagcggttagtgtactctcgccggagaaattggttatgaccggaatctcacctccgtgatcgaagaaactgttttcgtttttttatcgttacgaagaaatggaaaaacaggcgaagctaacgaggacacagtcgtcgttactccggtcatcgtcgaatctccgttcgtcatatcaaagcttatcttcaatcgtcgaaggcgagcaagatctagaagccggagagaaagaagagaaacagagaagaaaaccacctaaaccattcggttcaccaaatcctaaaaccggtttaaccagaatcaatcccggtttagctttcacaatggtatctctctctttcctaagtctctcatcgttcttcttcttcgtcgtcttctcacaaaccgatgagattctcacatcggagaatcttttactagctttaatcttcgtcgctgtagctctcttcttcgcttccaagaacatctctctactaaaccaaaccgtaatcgcaatcaaaaacttagggttccaaaacagagactcgaaatcaaaaccggtacaatggtacatcggagacgattcaaaaccggagaagaaggtaatcaagagattcgttaaagaaggagttcaattctacagtaatggagatttctacgaaggtgaatttaacaaagggaagtgtaacggaagtggtgtgtattactatttcgtgagaggacgttatgaaggagattggctagatgggagatatgatggtcatgggattgagagttgggctagaggaagtagatataaaggtcaatataggcaaggtcttagacatggttttggtgtttatagattctacactggtgattgttatgctggtgagtggtttaatggtcaaagccatggttttggtgttcaatcttgttctgatggtagctcttaccttggtgagtctagatttggtgttaagcatggtcttggttcttaccatttcagaaatggagataagtatgcaggagagtactttggagacaagattcatgggtttggtgtgtatcgatttgctaatggacactgttatgaaggagcatggcatgaaggtcgtaagcaagggtttggtgcttactcgtttagaaatggtgatgctaaatctggtgaatgggattcaggggttcttgtgacttcacttcctcttacgagtgagccagtttcaagagctgttcaggcggctcgagaaacagcgaataaggcagtgaatcggagacgagtagatgagcaggtgagccgagctgtggctgcagctaataaggctgctacggctgcaagagtggctgctgtgagagccgttcagaatcaaatggatggtaaattttgtcaaagttgaaaaaaggaaaatgtaaaaaatctttttttttaccggtttctctgtaaccctgaatcgaaagtttgtttcagaggtttgtaacagagagttaattttcgatctttttactaatgtaacaaaactgtaaatagttgaagaagaagctttgtttttgttgtaaaatcaacggcttgaaatggagcttattttggttttgatc

SEQ ID NO: 65 - DNA, 1328 bp, Medicago truncatula
caacaaacaaaccccgctctcccctcaatcagatctactttttcctcaccggtaaccaccatccctcaccgccgtactttcccgccctttcccttcttcaatttcattttcgcaattctttcatttttcacatcctacaactcaaattctccctctgcactcgatcatttcacctcagaaaacgaaactacaactgaattagggttttgttgccaaacgatgggaacaagatcgcagcaatcgtgtgtcgacgaagatgaggaggaatttatcggttgtggaactacgatttcgggacaatcaggctcaaccagcaggagtgccggcgggttagcgtctagccgaagcgagcagacgattgggacagccgccggtgataacactgctctcagattgaatcatcttgatatacaggatgatgatgctgcttcccaaggagtagttgctagcaagaagaaaaagagaggccaacaacgagctaccggaggtgataaaagtggaagagggcttcgccaatttagcatgaaagtgtgtgagaaggtagaaagtaaaggaagaacaacttacaatgaggtggcagatgaacttgtggctgaatttgctgatccaatcaacagtgttttgacccccgataagcaacaatatgatgagaaaaacattcgtcgaagggtctatgatgctctgaatgttctcatggcaatggatattatttctaaggataaaaaggaaattcaatggaagggtcttcctcgtactagtctgaatgatattgaagagctaaagacagagcgtcttgggctcaggaatagaattgaaaggaaatcatcctatttgcaggagctagaggaacaatttgtaggtcttcagaaccttgttaaacgaaatgaacaattatatagctctggaaatcctcccagtggaggtgtatctttaccctttattctggtacagacacgtcctcatgcaactgttgaagtggaaatatcagaagacatgcagcttgttcattttgattttaatagtactccttttgagttgcatgatgacaattatgtgctcaaggcaatggaatttggtgatagaacacagagtgatattgttacacacaatgttacagatggaggggaaggttctagcatgtcaggcatgcatcagtcacaggttcctccttcagcttcaagcgtgtcaactagacctccaacatcacctccactccctggaatattaaaagcaagagtcaaacaagagcattgatctgcaagattatgatatcgtcgtaccctaattaagcatgtctgtacattctgtaaagaaattttcccaattaa

SEQ ID NO: 66 - DNA, 1427 bp, Solanum lycopersicum
ctctctaaaacagttttgcccatctttcaaactcctccgccaaaaaaaaaacctcctttccttctcattagggtttcctttgaaaaagaaagtattgattgatatgttgtagtatttctagatctgaaacgaagctatgcaatcagattatgaaatgggtgggatccatcaagagtgtgaagatgagcctagattcatggtggaaaataatgcttccacttcttccccattttacccaaactatcacttccctccgacgtctcatcctattctccaacaaatccacagtttaccgattactcaacattttttcccttatcaacatgctcattacagatctatgtcagaagaaataagagtagatcagtctcagacggcggagttagtggcttttcctgcaagtgaaataagaggaggacaagaagatgctttgattcgtgggagtgagcgatactgtacacagcctcgacaaacttgtgtagctgtttggcaaaaccaagaagattctgctatgaaacaacctgtttggaaaggagaatattcaaatggaaatgcaattgagaaaaacaaacaagaagaagatgaggaattgtatagtttagaagaaactaataaacgtagagtagtattcggagagttagaagctatttgtattcgtggaattgcatctgaatctgctgataatttgccaaccaaccacaatgtcacttttcctgaattggctctcaatgaagccatggttaacaaaatggataatactatgggtaaatttcataaaaggaagagagggaaagatgaatggggaagatttttcaagtcattagtgaagaaactggcgaaccaccaagaagatctacaaagaagtttgatggaaacaatggagtgattagatcaagaaagaaaagaaagagaagaattatggagagagaaagaattagaaaaactccaaaatgaagaagctgctagagcccatgaaagaagattggcttcaactagagaagctgctcttgtttcttgcttagaaaaactcacaggtcagaaaattgattttcaaacattcaaaataaaggaagacgaaacctgagataacaagtaagtatggaaagaaataagtaagtcaatcaatgtctgcaatgggatattatgagccgcaaagagaagtgatgcacaagtgtagtctcaagaaaagatcacaagggaacagttgagaatagttgtactcaaggaaatgatactaatattgatggcgatgaaaacagacgtaacaaacaacaacaatgagtgataagctataagaacatcactgcttactttcttctttattattgtttattttctcatttctttttcatgtatttgttttgttcatcctgtcatttccttttcttccaacaatgatatcagttcccatgtcgtttttcatacta

SEQ ID NO: 67 - DNA, 1366 bp, Arabidopsis thaliana
atcatcattatcatcatgttgacgaacacgatctaatttttccttttacatatacaattcccaaactccagatttcttccttattcgtcctgtttcatttctacggttcatgttctctactttcaaccctcgctaacgttttcgacttctccacatctcgattcagcttctccttcgtccaaattcgattagattttgaattgggaagctgacaagtttgaagatttctcatttgatggattgatctgatttcgcaattttcattttcccgtttcgggttcaattgatttcgatcagattgaacccaatccaaatccaatcagggctacttcgatttgatctgtttcctcaaaaaaggattcgactttctctgagatggtatatttccagaactcaatctccctcgtagaccaatctccaatcatggctcactcaccagattttcatcatcattcaaaacaatcaagaaccagcagcagcaacagaaagtcatcatcgtcaagctgttcttcaaatttctctgtttgctgtgacggatctagatcagctgctatcgatgttgtgatcttaatcgctgtgatcacatcctccgggtttttaatcttcccttacatcaaattcatcactatcaaatctgttgaaatcttctctgagctctcttgtttagtgaaagaagagattttgcgtaaccctgatccaattgtctacggtttaatagctttgagtatctcgtgtactgcgttatctgcttggatgattgttatactactgtgtagtcgtcatcgatgtgggaaaccgaactgtaaagggcttaggaaagctaatgctgagtttgatattcagttagagactgaggattgtgttaagagctctaatagtggcaagagtgttagtaagaagggtttgtttgagttgcctcgtgatcatcaccgtgagttagaggcggagttgaagaagatggctccacctaatgggcgagccgtgcttgtttttcgggctaaatgtgggtgttcggttgggagattagaggttcctggacctaagaagcagcaactgcagcaaaggaaggttaagaaatgaagtataaaggttcaatctttttgagtgatccaaacccttgtatatgctctggattctggcgtttatgtgtttctggtttatgacctggttggcagttttatcataaatgttagaattgttatgtctagtgaggaccgataaccaattacatagtaacccttgtaggcagtcttttccatggacttggctcgagtctaaggagcaatggggcctcagagattattatgaaactctatatgtcattttagcttccaagtgtatggttaaatttaagttgaaaaagtaa

SEQ ID NO: 68 - DNA, 794 bp, Arabidopsis thaliana
cctccaagtctttctgaaaaacacatctttacacttgaaataagttttttcctttcttggtaataaaaatatccttttcgtttcttcttctccacacttctagaagttctagatttttcctagctaacgtaccagaaaaaaggaagccaagcctagaaacactataaagataagacacaaaggaagtctgagaattgtgagtaaaaatgtgtttggaagttgtgtatcatgaagagaagacggagcttggtcggcaacaagcaccagggatgtgtccttattgcggcggaaaagtatcggcggtggatatagagacgaagtggttgttctgtttcttaccactttgtttcaaggtcaaacgcaaatactcatgttcttcgtgcgagcgtcatctcgtcttgtattattgaagaaacacgtagagagatgcgaaattgaagtaaagagaaaaaccaaaacagaaagaatgaagaaaagaaacagaggagaaactgaaaaagattgttttatctctttcatttatttggttgcttctcctctcaatgttgaggtttttgcagatttcctcttgtgacttctgattttgctagaaacgccctctcgtgttggtgagtggtgacattggtcaattttcattgagttctttatttctcgtctgagttttgtgcaatgtatataatttgttggatttgtttaataaagattgttattcttaagtgaattactttgctattctattttcatataatttattggtaattcctagtcaattcttaaataaatctctttttatt

SEQ ID NO: 69 - DNA, 536 bp, Arabidopsis thaliana
ctcctcaaaaaccctaaaatcccaattgagaaaatttagacgctcaaggttctgtttacatcttgtccggtggcttgaagcaaattcaacttctgtgtactgtttctttgttgaatcatggatccagcacccgaacccgttacttacgtctgcggagattgtggtcaagagaacactttgaagtctggggatgtgatccaatgcagagagtgtgggtaccgtattctctacaagaagcgtacccgtagagttgttcaatacgaagctcgctgagaactactactcctgaaggtggttcatagtctgttaagatgggttgagactttttggcactgtttgtgatatatatatcgacatggttattgctacattgcctgttcgatttgatttggtcacagtgtgactgtgtaatcactttaccgttttgatagatgtaattcgtggaataactaagttcacattgctataatccttgattggctataatctctcgttgttttgctacctttgttctttagtgtactctgcatttagtt

SEQ ID NO: 70 - DNA, 503 bp, Solanum lycopersicum
aagcgaattattaaacctctgtgctctaatttcaatattaagctaacaaattatcgtccatagttcaatcaggatttttatttagagctatttatctttagatctgtgctttgctgttggagaatcaagaatgtctcgcgggaaccagagagatcgagatcgtgaaagggcacaagccaggggaaatcacaagtccaagacacctaaaaatgatggattaactcctgaacaacgaagagaaagggatgcaaaggcacttcaagagaaggcgaaaaagaaagcagcacaggcggaagatggatggaatatcaacaaatcggaaagccataacatcaagaagaaatagattcatgacgagtttcatggaactttttatcctcagtaattctggcatgtattgtttggcttttgtacctttgatttgtgtcttcatctgcaatgaaatttactcactcttcacattgttggaaagaaatatatattgatcaaagaaatttgaattg

SEQ ID NO: 71 - DNA, 3984 bp, Arabidopsis thaliana
acaacgaggtcggaaccgaccagtcacggtcttctctctgcttttctctgttcggttggtttcacgtaaaaaataaaactttgaggttcaatggtaggaggtggaacaaagagaagaagaaggagattacaactaagtaaactatatacactaacatgtgctcaagcatgttttaagcaagaccattctcaaatcggaggacctggtttctctcgtgttgtttattgtaatgaacctgattcacctgaagctgattctagaaactactctgataactacgttaggactactaagtatactcttgctacttttttacctaaatcactctttgagcagtttaggagagttgcaaatttctactttttggttactggggtcttggcttttactcctcttgctccttatactgcttctagtgctattgttcctcttctttttgttattggtgctactatggttaaagaaggtgttgaagattggcgccgccaaaaacaggataatgaggtgaataataggaaagttaaagtgcatagaggtgatggaagtttcgatgcgaaggagtggaagactttgagtattggagatatagtgaaggtagagaagaatgagtttttcccggcggatcttgttttgctatcttctagctatgaagatgctatttgctatgtagagacaatgaaccttgatggggagactaatctgaaagttaagcaaggacttgaagtaacttcgtctttgcgtgatgagtttaactttaaagggtttgaggcttttgtcaaatgcgaggatccaaatgctaatttgtattcgtttgttggaaccatggagcttaagggagctaaataccctctctcaccgcagcaacttcttctgagagactcaaaactcaggaacacagatttcatctttggagctgttatcttcacgggtcatgacacaaaggttattcagaattcaacagatcctccatctaagagaagcatgattgaaaagaagatggataagattatctacttaatgttcttcatggtgattactatggcatttattggttctgttatctttggagttacaacaagagatgatctcaaggatggtgtgatgaagagatggtacttgagaccagatagctccagtatcttctttgaccccaaaagagctcccgtggctgcgatctatcattttctaaccgcggttatgctgtacagttatttcattcctatatccttgtatgtctccatagagattgttaaagttcttcagagtatcttcatcaaccaggatattcacatgtactatgaagaagctgataagccagctcgtgcacgtacctctaacctgaatgaagagcttggacaagtggatacaattctctcagacaagacaggaacattgacatgtaactccatggagttcattaagtgttctgttgcagggacagcttatggtcgtggtgttacagaggtggagatggctatgggaagaagaaaaggtggtcctttggtgtttcagagcgatgagaatgatattgatatggaatatagtaaagaggcaattactgaagaatctacggtgaaaggattcaactttagagatgaaaggataatgaatggaaactgggtcactgaaactcatgctgatgttattcagaagtttttcagattacttgcggtatgtcatactgtgatacctgaagtggatgaagatacagagaagatctcttatgaagctgaatcgccagatgaagcagcatttgttattgcagcaagggagcttggttttgaattttttaacagaactcagactaccatatcggtaagagagctcgatcttgtgagcggcaaacgagttgaaaggttgtacaaagttttgaacgttcttgagttcaacagcacgaggaaaagaatgtcagttatagtgcaggaagaagatggaaaactcttattactttgtaaaggagcagataatgttatgtttgaaagactatccaagaatggtagagagtttgaagaggaaacacgggaccatgtaaacgagtatgctgatgcagggctgagaactttgatacttgcttatcgtgaacttgatgagaaagaatacaaagtattcaatgaaagaatcagtgaagccaagagttcggttagtgctgatcgagaatcgctgatagaggaagtcaccgagaaaattgaaaaagacttgattcttcttggagctactgctgttgaggataaactccaaaatggagtccctgattgcattgacaagcttgctcaagcaggaataaagatttgggttttgactggtgacaagatggagactgctatcaatattgggtttgcttgtagtttgctcagacaagacatgaagcagatcataatcaacttggagacccctgaaattcagtcactagagaaaaccggagaaaaagatgtcattgcaaaggcatcaaaagaaaatgtcttgtcgcagataattaatggaaagactcagttaaagtattctggagggaatgcttttgctttaatcattgatggaaaatcacttgcttacgcgttggatgatgatataaagcacatctttctagagctggctgttagttgtgcgtctgtcatttgttgccgttcatcaccaaaacaaaaagctctggtgacaagactagtaaaatctggaaacggtaaaacgactttagcaattggtgatggtgcaaatgatgttggaatgcttcaggaagcagatataggtgttggtattagcggtgtggaaggaatgcaggctgtaatgtccagcgacattgcgattgctcagtttagatatttggaacgtttgttgctagtccatggacactggtgttacagacggatctcgacaatgatttgctacttcttctacaagaacattacatttggtttcacactcttcttatatgaaacatacacaacattctcatcgacacctgcctacaacgactggtttctatctctttataatgtctttttctcgtcccttcctgttattgctcttggtgtcttcgaccaggatgtctctgcacgttattgtctaaagtttccgttgttataccaagaaggtgtgcagaatgttctgttcagctggcgcaggatacttggctggatgttcaacggattctacagtgcagtaatcattttcttcctctgcaaaagctctctccaatctcaagctttcaaccacgatggaaaaaccccgggaagagaaatcctaggcggaacaatgtacacatgcattgtatgggttgtgaatttgcagatggcattggctatcagttacttcactctaatccagcacattgtgatttggagctccattgtcgtttggtactttttcatcacggtgtacggagaacttccatcaagaatatcaaccggtgcatataaagtctttgttgaagctctcgcgccttcattatcttactggctcattactctctttgtagttgtagcgacgttgatgccatacttcatctactctgcacttcagatgagttttttcccaatgtaccatgggatgatacaatggctaaggtacgagggtcagtgtaatgaccctgagtactgtgatatagtaaggcaaagatcaataaggcctacaacagttgggttcactgccagattagaagctaaaaagagatcagtgaggatatctgagcctgcatcatgacaacgaaaactaaccaaacatcaacttgactcgcagaacgtaaatagcaccaagaatatatggaagctagaagcttacttgcttcagactggatcgataaaggctatccaaccagttgttgtacattctgattcttgcggccttgcccggttacgaaacaagatcttacagttatgtccagtaaattgtgtttacagaacagctgaagattataccttggagtctcagtagagagatttccaattgtcttttctcttcttttgctctttcaagattgccattagtccttta

SEQ ID NO: 72 - DNA, 906 bp, Arabidopsis thaliana
gcgaaatcattgtctctcttctcttgttttctccggatgaattctctctcgatcagcttcatgcggcgtccacatcatcaaattggagaagataaccgaagaaaatcgtcccccttccgccgtgatcatcatctcaaccgacggtctcaacatctgtgacttcgaacataatcggcgattttgatgaaccaaatcggagagagaagattaataagatagttttgaggaagaaatcacaattagagcttaaagcaagaataaatcacaatcacaagatgagaatttttcggacaacgtagtgataatcagtcaatcggagaaagaaggtgacccgagtgttataaccatcaattgtcctgacaaaacgggtctaggttgtgatctttttcgtatcctcctcttcttcggcctcaacattgtctgaggaggtgattgggaaaccaaacacgagatggaatctgttgaaggtttgtgcaagtctttaatgtggttgtgagaatgccgtgtggtagggtcatcatcttagagggtctattgcagggcttcactctccttcgctactgttcctaatagatccttcaaaagagaaaccgtcatggaggatcctaaatgtcccagggaaaccacccaagttagcttggggacatagcacatgcgttgttggaggaactagagtattggtccttggtggtcacaatggtgaggaatggatactcaatgaattacatgaactctgcttggctagctggcaagactcggatctgtaaagactctttccttattcatttagtttgtggttatgtatctgtcacattccaaactcttatgacagaagcgtgtgtacatagtaaattagtgattgttgtacgctttagatattaatgtaatgatgttaatggttttgct

SEQ ID NO: 73 - DNA, 4064 bp, Arabidopsis thaliana
gagacaagttagagaagagaagagcttgacgacgatgaatatgatcgaccctttaaataaccttctcttctcgtcaacgcgtttccttcttcttctttcctcgtttttctcttgtcttccaactccaccacctcctctcctgttcatggtggatgggagtcggagatcctcttccacttccgccggaaaagaaccgtcgggaggttaataaaccgccggatattgcgtcgacttcctcctcctccgcttcggcggtgaataatgctcggttgtccgatgctccgattcttttgtttgtttatttccataaggctttccgtgcgcagctagcggagctccagtttctggccggtgatacagtccggtccggttctgatctggccgtggagctccgctctaagtttgagtttcttaagcttgtatataagtatcattccgcagctgaagatgaggttatattttcagcgttggacactcgtgtgaagaacattgtttttaattactcgcttgaacatgatgccacagatgatcttttcacttcagtttttcattggctgaatgttcttgaagaggaacaagggaacagagccgatgtacttcgtgaagttgttttatgcattggaaccattcagtcatccatatgtcaacatatgcttaaagaagaacgacaggtgtttcctttgatgattgagaacttctcctttgaagaacaggcatcgttagtgtggcaattcatttgtagtgttccagtgatggtgctggaagagattttcccatggatgacgtctttactctctcccaaggagaaatctgaagttgagacttgcttcaaagaagttgtcccaaatgaactctctttgcaactggtcataaactcttggctgattgatgacagtcaatcttctttgacggctcttacaaagattatgaaaggagttcagtctgtagaagtgtctgaaaatatgaccaactctcagacaaattcatcatcaagtggtgtgtttcaacgtttttggcagtggagtaaaaaaatgtctttttctagtccaaatacaggacacattttggttcatggtatccatctttggcataatgcaattagaaaagatttggtagacattcaaaaaggactatgccaattgacatttccaagcctttcattggacctcaatgttctggtggttcggctaaacttccttgctgatgtccttatcttttatagcaatgcatttaagacgttcttttacccagtgtttgaagatatggtggatcaacaacactcttcctcttccaaacaattcaccatagatggacatgtggaaaacttcaagaagtcactagaccttgaaactagagcagggagtgacaattttgtcataacccttcaggagaaactggagtctcttatattgacagtagctaagcagttctctatagaggaaacagaggtattcccgatcatcagcaagaactgcaacattgaaatgcagaggcaactactatatagaagcatccatttcctgcctcttggattgcttaagtgtgtcataatgtggttctctgctcagttaccagaagatgaatgtcaatcaattattcactacttaagctctgaagattcctttcccaacaaaccttttgcgcacctcttgttgcagtggtttcgcttcggttattcaggcaaaacaccagttgaaagtttctggaatgagctgtcctttatgttcaaaccaagatgttcttttgaagaggaactcactgaagaagcttctggatctttctttcaacaatcaccgcagaaactattcaaagtatccgatccctattctatggatccacctgctggttacatgaatgagacaccttactcaagtgcgatgaatcagcaaatacttatcccaggaaagctcaggccacttctgcatcttcctgatctttttggtgacaagactattggtgaacacttaactatggacttgaaaccaatcgatctgattttctacttccacaaggcaatgaagaaagatctagactaccttgtacgtggttcagctcggctcgcaacagattatagcttccttggagaatttcaacagcggtttcatcttataaagttcttgtatcagatacattcagatgcagaagatgagattgcatttccagctttggaggcaaagggtaaactacaaaacattagtcagtcatacagtatcgatcacgaactcgaagttgagcacctcaataaagtatcattccttttgaatgagttggcagaattgaacatgctggtactagaccacaagaatgtgaagtatgagaagttgtgtatgagcctccaggatatatgcaaatccattcacaagctattgtctgagcatctccaccgagaagaaactgagctttggtgtttattcagagactgcttcactattgaagaacaagaaaagatcatagcatgcatgcttggaagaataagtggagaaatattgcaagatatgattccatggctaatggaatctttgatccctgatgaacaacatgctgtgatgtccttgtggagacaagcaacaaggaaaactatgtttggtgaatggctaacagaatggtacaattctcatgctgtcgaggaggaaacagaggaagcaaataaggatccatctgagaattcagatccattagacgttgtctggagttatctctttgaaggagctgctgatgagtacaaagggagcatttgcagcaaacctctggaagagacagagttaaaaggtatcatgaataagcctcttggaaaggctgctcctaataacaaggtagaatttggaaacaaagaggagaatcatcttgagatctcaggaagtaaaaaggtgtgtacaggagctgatgaaacgaagtacaaagaacaaactgacagcaacgcgcaagcttttcagatgtcgcataatactagccaatctggccaagacagtagatatgagtgtctgttatcaatgagtcaagaggatgtggaagctacaattcgaagaatatctcgagattcttccctggatcctcagaagaaatcgtatatcattcaaaacttgttaatgagccgttggattgctacacaacggatatataatcttgaaccatccattctctcaagcaatagggaagcagttccggggcagaatccatcttatcgagatcctcacaaactgatctttggttgcaaacactacaagagaagttgcaaacttcttgctccttgttgcaacaagctctacacatgtatacgatgccatgatgaagaggttgatcacttattggatagaaaacagatcacaaagatgatgtgcatgaaatgcatgataattcagccagtaggtgctagttgctcaaatatttcatgtagttcatcaatgggaaaatattactgtaaaatatgcaagttgtttgacgatgatagggaaatctatcattgtccatactgcaatctctgccggctaggaaaaggactgagcatagactactttcattgcatgaaatgtaatgcttgtatgtcgcgactcatagtagaacatgtatgcagagaaaagtgcttagaagataattgtccgatttgtcatgaatacatatttacctcaaattctccggtgaaggctcttccatgcggtcacgtgatgcattcaacatgctttcaggagtacacatgttcgcattacacatgccctatttgcagcaagtcgctcggggatatgcaggtttactttagaatgttagacgcactgcttgcagaacaaaagatgccagatgaatacttaaaccaaactcaggtaatactgtgtaatgactgtggaagaaaggggaatgctccttaccattggctctatcacaagtgttcttcttgtgcctcctacaacaccagacttttctagttccttctccaattttccttctttgttttcttctttgtacatctgcaaatcttttaacaagtttttcttttctttttggaagcatttgattttgtatgaaaaaaaatactctacatattattaaatctagataattgtttacacctc

SEQ ID NO: 74 - DNA, 633 bp, Solanum lycopersicum
catcaaaaaaaaaaagaaaaaaaatccccaatctccaatggcaaaatccacaaaaattctctcatcaatcctcattctcttcttcattttcagtctattttcttcatcaaacgcattaggcggaaagctcggcggaagaacacaaatcaaagacgtgaaaacaaatcaggaaattcaagatctaggtaagtactgtgtcgaagaacacaacagagatttgcggcatatcaatggtgctttgagttctttattgagtttttctcaagttgttgaagcagaaaaacaagttgtttctggtgttaaatattatctaaaaatctcagctattgttaaatcatctagctcaccaaaattgttcgatgctgttgttgttgttaaagcttgggagaagaagaaggaattgcttacgttttctccttctccttcaccggctacaaagtgaattttcgatggttgatagtggctaaaagttaaaacttctagtagtgctaatgttgtttaatctaattttgaagtactttaatttgtagcctttttattttttttaacctattttgagttctcttgtgtactatgtgatgcaataatcaatgaatgacatatgtattagtatgttattatagataaattatg

SEQ ID NO: 75 - DNA, 482 bp, Arabidopsis thaliana
atcattgaaccctaaaccctaattgatcggccagaaatggagggtttggagaagttttacagcaagatggtgaaagaagcgaaatcggcagcttcttcttcgtcgtcttctctatctgattttgcggataatctgatgcaagacaaacgagccgccgccggcaacttgactactacatacgacgcaggatccggcactctggtaaccagacctcccagcggagtttcggtctggacgtgttcaaagttgtgcgctgttttctttgtcgctggagtgtttgtgggttatacacttaagagacgggttcgacgctgggcttctaaattactgagaagaataaaggatgattaactccaacctcgtcttctactgcaagttttggtacacttagcacaaaggcattactctattcttatccttgaatgtgttttagtaccaatatactgtgctgaggcaccttatcaatgaaaatttgttgtttg

SEQ ID NO: 76 - DNA, 1185 bp, Arabidopsis thaliana
aggctcactccaactccaactccaactccaactaacaacactcttcttcattcttcttcaatcaatggaatctgaaatcgcctccgagtttcttcctttctgccggatttacaaagacggtcgtgtagaacgactcatcggcaccgataccatcccggcctctctagatccaacatacgacgtcgtttcaaaagacgttatatactcaccggagaataacctctccgttcgtctcttcctccctcacaaatcaacaaaactcaccgccggtaacaagctccctctacttatctacatccacggcggagcttggatcatcgagtcacctttctccccactctaccacaattacctcactgaagtagtcaaatccgctaactgcctcgctgtctctgttcagtatcgccgtgcaccggaagatcctgttccggcggcttatgaagatgtatggtccgcgattcagtggatttttgctcattctaatggatctggtcctgtagattggattaacaaacacgccgatttcggtaaagttttcctcggcggagatagcgcaggcggtaacatatcgcatcacatggcgatgaaagctggtaaagagaagaagctagatctcaaaatcaaaggtattgctgttgttcatccagctttctggggaacagatccggttgatgaatacgatgtgcaagataaagaaacgagaagcggaatcgcggaaatttgggagaagattgcgagtccgaatagtgttaatgggacggatgatccgttgtttaatgtaaacggatccgggtcggatttttctgggttgggatgtgataaggttttggttgcggtagctgggaaagatgtgtttgttaggcaaggattggcttatgcggcgaagctggagaagtgtgagtgggaaggtactgttgaggtggttgaggaagaaggtgaggaccatgtgtttcatttgcagaatcctaaatctgataaggctttgaaattcttgaagaagtttgtcgagtttattattggttgaaacttgaaagaatgttttttgtgtaaatgttcttcatgatcatgtaatcttgtttttaagaaataaaatacatgaatttcagactgtgtgagagttatatgaacctgttaaatgtgtgttattattttcttcaacatgagaaaaaaatatgtgtaaaatat

SEQ ID NO: 77 - DNA, 1320 bp, Arabidopsis thaliana
aatagtaaaattaaagaccccacttattatttcttccctcaataaaaaaaacaaaaacatttctctacaaaaatcataaatgttataaccaaaataattgaaaaaagtagctcgagagagaagtagcatttgctactttacccaaaatccctaaccacataataaaccaaacccaacaaagaaaataaaatttcaaaccaaaaaaaaaaaaaatgagaactttagaagaatcgaagatctctattgtcttcttgttgcttcttctcttctcaatcttcatcagttccagtcaccaggcaaatgaggtattaccagctgaaggagataatgagatgatgatggtgccattgggggaggagaagtttatggtaatgaatgaaacaagaaggaaacttggaagttttcagatatgttcagtttgtacttgttgtggtggtgctaaaggtctttgcttgccttctccttgttgctatgctattaactgcaatatccctaatagaccctttggttactgttctttcactcccaaaacttgcaattgctttggttgccatatctgagatcttctacttcattgtaatttgggagagaaacaagtgaatctaaatcttgattcatcttcaagtgtgaaagggaggaaaaaaagaagaatatctgttcttggtttgagtcttctacttattttttgtctataatttatttttcagtcttcattaaatttcattacctactatctcagcaacatcatcatcctcattaattaattgtctttttgcatttgccattttttcataattttctagggttttttttgttttgagaatcttgttcacacttcaagcaagatttgtttcttcttctctgttcaatcaattctctctatctgtctttctctctctctttttttttttttttcattctcttgtttacttcatcattttgtttcttatgtgttttaagaaagttaaaagttagaatttagcatattttggaaaagagtcattgtttggttaagctggcaattggaagagtatttaatatgatgatgatgatggtattgatggtgatggtggtgatagtgaagctgttaaagttaagtctttgtaatgagtgacatgttaagaaaatggatcaagtttagtgccttattctgatctgataagatctttaagtgttttagtttaaaatagaggaaaaagagtaaaaaagcaattattcatcttcaagtgcagagactagacaatatctttgaatatgtttatttatctgacactgttattattgtaagagatgttttatgtcaaatgtttgttccaactc

SEQ ID NO: 78 - DNA, 1761 bp, Arabidopsis thaliana
tgcaacttttataacatctctctctctctagaagcagaaaagtcagcagttgattctaggacggcgacttgacttgacacctgaaaaatccttaccgtgtttgatagtttttcgaaaacccttcaaattgtttcattttttttaagtcttgagactttaaaaaatcctcgcttgctcttgttttaggtctcctgacaaggaaaaatttggaaacttgtgggagttgattgataagagttgttaagatggcaaatgatgcggctgcatgtgcagaaagggctacaaatgatatgctgattggtccagattgggctattaacattgaattgtgtgatcttatcaacatggatcctagtcaagcaaaagaagctgtgaaggtgctcaagaagcggttaggaagtaaaaactctaaagtccagattcttgcactttatgcattggaaactttaagtaagaattgtggcgaaaacgtgtaccagcttatcattgaccgtggtctattgaatgacatggtcaaaatagtgaagaaaaagccggaactgaatgtgagggaaaagatactaactttgttagacacatggcaagaagcctttggtggacgtggaggtcgatacccacaatactacaatgcctataacgatctcaggtctgctggaattgagtttccgcctcgaacggaaagcagtctatcgttctttactccaccgcagactcagccagatgaagatgctgctattcaggcttcgttgcaaggagatgatgcttctagcctcagcctggaagagattcaaagcgctgagggatcagttgatgttttgatggacatgcttggagcacatgatcccgggaatcccgagagtttaaaagaagaagttatagtagacttggttgagcaatgtcgtacttatcaaagacgtgtaatgactcttgtgaacactacaacagatgaggaacttctgtgtcagggattggcattaaacgataatttgcagcatgttcttcagcgtcacgatgatatcgcaaatgtcggctctgttccttcaaatggaaggaatactagagctcctcctccagttcagattgttgacatcaatcatgatgatgaagatgacgaatcagatgatgagtttgctcggcttgctcacaggtcttcaacacctacaaggagaccagtacatggtagtgattcgggtatggtggatatccttagtggggacgtctataaacctcaaggcaactcctcctcacagggagtaaagaagcctcctcctcctcctccgcatacttcttcttcctcttcttctcctgttttcgatgatgcaagtccacaacaaagcaaatcctctgaggtaattaggaatcttccacctccgccttcaaggcacaaccagaggcaacagttctttgagcatcaccactcgagtagcggctcagattcctcttacgagggacagacccggaacctttctttgacaagtagtgaaccgcagaaagaagagaaaccagaggatttgcttttcaaagacctggttgagttcgccaaaaccaggtcctccaaagccaacaataataataggtcgctctgagtcttttgtttgtggctttttaccattcaagttttttttttcttttgggttttcagagagtgatgatgatattagagtgtgccttattatttagagatagtatctgataataccaacaaccatatgttttacttctctaacttcactccaaggacacagctttaaaatactttta

SEQ ID NO: 79 - DNA, 393 bp, Arabidopsis thaliana
gatgaaattggaggaaatcgaatcgaatcgaaacatttagggttcctccttccttgagagttcaggtcaagctttctttccaatttcgccatgccagaagaagatgttgttgatcagaaaagatactttgaggaatcttgcaaaccaaaatgtgtgaagccactacttgaatatcaggcgtgtgtcaagaggatccaagatgatgagtctggccacaaacattgcactgggcaatattttgattactggcattgtgttgacaaatgtgtaagtgtgtgagtgctgtttttctgtatacacctaaagtttcgcgaaactaaaatgacaaagacagctacttggagtctatttttctttccagggttatataaaatgatgtggatgcttaacatt

SEQ ID NO: 80 - DNA, 2187 bp, Arabidopsis thaliana
ttgtcttctctcttactctcaggttctcaacaacaaaagaggaaaacaaaatcagaagctatcgtaatcagttctcatctctatgaccggactatccgtagagaaaaccgggtcgacccggtccactgtcttcttcatcatctttaatctatccatttttagtttatcgattgaagcaaggtcgaggcaacaacatgctagctttcctccaagaggatggaattcgtacgattccttttgttggactatctctgaagctgagttcttgcagagtgctgaaattgtttctaagcgtcttcttcctcatggttatcagtatgttgtggtggattacctttggtatagaaagaaagttgaaggagcttatgtggattctcttgggtttgatgtgattgatgaatggggaagattgcatcctgatccaggtagatggccatcttctagaggcggtaaaggtttcactgaagttgctgagaaagttcatagaatgggtttgaagtttgggattcatgttatgggaggaatcagcacacaagcttataacgcaaatagtctcgttatggatagtgttaagggaggtgcttatgaagaatcaggtagacagtggcgagcgaaagatattgggatcaaggagagggcttgtgtttggatgtcgcatgggttcatgagtgtgaataccaagttaggtgcaggaaaagcattcttgaggtctctttatcgtcaatatgcagaatggggcgttgatttcataaaacatgactgcgtatttggcactgacttcaatatagaggagataacttatgtgtcagaggttctaaaggagcttgatcggcctgttttgtactccatatctccagggacgagtgtgacacctacaatggctaaagaagttagccaattggttaacatgtatagaataacgggtgatgattgggacacatggaaagatgtcacggcacattttgatatctcgagagatttatctgcttctagtatgattggtgcacgagggttacaaggaaaatcatggcctgatctagatatgttacctcttggatggcttactgatcaaggttcaaatgttggacctcatcgagcgtgtaatctaaatcttgaagaacagaagtcacagatgacattgtggtccatcgcaaagtcccctctcatgtttggaggtgatgtgagaaatctcgatgccactacttataatctgatcacaaatcctacactgctggaaataaactcttatagctctaacaacaaggagtttccttacatcaccgcgacaagagtttctaggaataagcacaaaggctatcctcatcatccaacgggcaagaacatttcaactaagcatgcttttggtctcactagctgcaaagaacaaaaagccaacacttggttcattgtagacaagaaccgtggacaaatttgttggaaccaacactctagtgaaaaattagagaagccattttgcttatacaacagaaaagctcttctagcttccgataagaagttaaaacacaaccagctttaccaaggtaagcttcatttgcatacaaatgataaagcacagtcttgtttagcagcttcctcgcagcaaaagctcacttcgaaagattatagtcaaggtgctttatcaccttgcaaactagatgcaaaccagatgtgggagctccacagtaatggaacactggaaaacagttattccggtctttgcgctgtgttaaatccagtgaaagcagccgaagctagctccaatggcgttcgttcttggattgccacgggaagaagaggagaagtatacgttgcgtttttcaacttaaatcaggagaagacaaagatatcagccaagatatctgacattgccacggctcttagaggcaagaagaatcttgtaggagcttcgtgtacgagccacgagctatggagcggcaaagatttcggaccaacaaaagattcagtatcgattcaagtcgaacctcatggtcctgctctgtttgttcttcattgtagcaacgcctgactatatcagatcaacaggcatttcttttaccttctcacgtcttttctcatcgtagtaatgtttcatctttagtctataaaactcttgtgtaatcgaaagtcgaaacatacaaagtaacgaataaaaaaaatgcaagtatcaacttagataagtaaaagaaa

SEQ ID NO: 81 - DNA, 1372 bp, Arabidopsis thaliana
caattttatgaatatattaaaataaaaatagttattattattatgaaacatataatgtatcactacagacgataaaggatttgattttttcaaatggtaagttcataacttcccaaattactataaataagtgttaaagttagtcattatcaaattaagccactccactaattacaagctccaaaagctttctccttctttttctctctaatctctatttcgtacggatttctctaaccggagcgatggagattgacggtggagatcgtatttccggtgaacgaccgatcattatggtcaccaacgacgacggaatagacgcgcctggccttcgttctcttgttcgtgtcctcgtctccactaacctctacgatgttcgcgtttgcgctcctgattcggagaaatctgctgttagtcacagtataatatggagtagaccactcactgcaaaacgagtagagatcgatggagctactgcttattctgttgatggaactcctgcggattgcactggtttgggcttatcggaagcactctttccttctcgtcctgacctggttctgagtggtataaacgtgggtagcaactgcggttataacatcgtctattctggaactgttgctggcgctcgtgaagccttcctttatgatgtgccttctgcctccatatcatatgattttgattggaaacgtggagagatgaatgctaatgattttgccctttctgcccaagcctgcttgcccattatcaacggcatactcggtgcaatcaagaacaaaactcaccctatgcaatgctttctgaatatcgatttgccgactgatattgctaaccacaagggatacaaactaactagacaaggtaaaagcatgggtaaaatgggatggagacaagtggaagaggaagcacaagggccgaagatgttatcaacaatgacaatggatacagagtcaggagtagtctcatcagagaacgacacatctgctcatgcgggaaaagatagccgtttattcaaaagagagttaagggcaagcatcagtgaagaagggagtgattctcattacctaaaagaaggatttattacggtgacgccgcttggagctctatctcagactgatgtggattgccaaaactactacaaagaatggcttcccaagattacaaaccagtcatgctcctcctcatccctttgatgctacaacatgagagaaaataaaaactctattaggaaattacccattgtggaccacaatttgtggtagacctattattatatcagtaccagttctttagttttcttaagtcttgacttactattgttgtgagcagcaaaatagttgttgttacaagtccattaattatcgtgagcagc

SEQ ID NO: 82 - DNA, 2728 bp, Arabidopsis thaliana
ggaaaactccaaaattaaatccataaccctaatcgatatctctcttggacaggccagcacatgtaacgagcaatcgtgaccgttgagacagtaacacgtggcaacagtccttatgatgagacctttgatgagaatcagcagcctccatttctgatagcttacgcagcttcagactcgggttcttcttttcgatctagcctccgtcctctttcttcttaccacggatctcgcctgctctttttccgtacgacggtctgctttgtggatagtttggctgacgacgaggcgatttgaacattaacagttactgggtaattgccaaggatggagggtttcctaacggatcagcagagagagatgatgaaagttgcaactcagactgcagatgatcttccaccctcacaaaaacctcactcggttttacttgagcatctgcctaaaccatctggtggtgggaaagcttctggtgcgtcaaatgctgtgaagcacagaaggtctcatgcgggaaggtctattcgctctaagaaggatggaggtggtgggaaaggaaattggggaaaacttattgacactgatggagactatcacattgacccgaatgatcctaattatgacagtggagaggaaccattcgagcttgttggtgcaactctgtcagacccattagatgattacaagaaagctgcagcttccatcattaacgaatacttcagcaccggtgatgttgatgtggcagcagctgacctcattgaacttggttcaagtgaatatcatccctacttcatcaagcggcttgtctcggtagcgatggacaggcatgacaaagagaaggaaatggcctcggttttgctttccgcattgtatgctgatgtcattaacccgaaccagataagagatggatttgtcctgctgctcgagtcagccgatgactttgtggtggatatacctgatgctgtcaatgttcttgctttgttccttgcacgtgctgtcgtggatgacatacttcctccagcttttcttcctagggctgccaaggcacttccaataacttctaaaggttaccaggttgtccaaactgcagagaaaagctatctatcagctgcacaccatgctgagctagtagaaagaaggtggggtggacagactcgaaccactgttgaggaagtcaagaagaagattgctgacattttgaatgaatatgtggagactggagagacttatgaggcatgtcgttgcgtaagagagttgggtgtttctttctttcaccatgaggttgtgaagagggccttagttactgccttggaaaaccacgcagcagaagcacctgtattgaaactgctaaatgaagcagcttcagaaaacctgataagctctagtcaaatggtgaagggattttcaagattaagagaaagccttgatgatcttgctcttgacattccttcagctagaaccaaatttggtttgattgtgccaaaagctgtctcaggtggttggcttgatgcttcgtttggttatccctctggtgaatgtggacgacaacagaacgaggatgagaaactaaagcggttcaaggaagacattgtgaccatcattcatgagtatttcaactctgatgacataccagaactcatacgcagtcttgaggatttaggagcacccgagtacaacccaatttttctaaagaagctgataacacttgctttggacaggaagaatcacgagaaagaaatggcatctgttcttctctcatctcttcacatcgagatgttcaccacagaagatgttgcagatggtttcgtcatgctcctggagtctgcagaagatacagctcttgacattctggatgcgtccaacgaacttgctctgttcttagctagagctgtgatcgatgatgttttagcaccttttaacctggaagagatcagtagcaaactacgccctaactcaagcggaactgaaaccgtgaagatggctaggtcactcatctttgctcgacatgcaggagagaggcttctaagatgctggggaggtgggagcggttgggcagtggaagatgcaaaggacaagatatcaaatctcctggaggaatacgaaagctcagggctggtatcagaagcatgcaaatgcatccatgagctaggcatgcctttcttcaaccatgaggtggtgaagaaagcactggtgatgggtatggagaagaagaaggacaagatgatgctggatcttctgcaggagagtttcagtgaaggactcataaccacaaaccagatgaccaaagggttcacaagagtcaaagacggacttgaagatcttgctttagacatcccaaacgcaaaggagaaattcaacgactacgtggagtatgggaagaagaatggttgggtttcgtcgtcgtttttaacttccctaactgaagatgctaatgtaggctagagatcaagaggagatatcccaaatggtgtgtgaactaaaaaaaactgatagaatgtacaagtctctttctctcttgagcatccctgtggttgttttgttttgcacttttaggctttgagaattctgcccagggagcttatcttttcacgaatgtttaacttttttcttcagaggacctttttattgctctgaatttagtccaacggaactttggggctatattggatcaagtttcaattcagagtcaataataatgccttgatgacaattagacaaaacaaactatattatttgc

SEQ ID NO: 83 - DNA, 976 bp, Arabidopsis thaliana
gatattttttatcccaatttccctaaatcataaagaaacttagggttcgttatcatcgccatctcgattctcctaaatcataagcgatgttatctccgattgagaatgagagatccgaaattccttcccctgagaagctgaagttagtggaggagccatccgacgatgaatctaagttctctaattatgattcggacgattgggaaactttgtcagatgatcttcgactgttagatgaagagtggggcaagagcgggggttttgatgtggacttctcgaaagtgcgtcacagatttggtcgcggagctgttcatctcgacgacgacaatatggttagcgagcctcatgagaccaacagagatttgctcaacaggttgtccaacatggctatctccttctacaacgacaagacggggataaaactggaacttgtcaaggttttgagagcaaattttcacccatctgctgcaatcacactctacatcacgtttgaagccaatgacccttcagatggtaaccagactaaacgttaccaagcagtggttcgatacttgtcctttgatatcgaagtttgctcttgcaatcctgaaccatcttcttcttgaattctcttctgaaagttttccaccggcgagtttatgcatctatctatctatctatctaggggaagcaaaagggcactagcaagtttcaatttgttccttgaacttctctatttgaaattaagttgtatttttatgcccaaatgttggtctctcggtgttttactgttattgcgactaagtcactactctttccattagctacttctattattatatggataatgttgttacactccttcatttttcctccctcagaggttaggtgcttaaattcttcaccagttccagctgtttggcattgcttagttattagttcatcacattgttttggtagaaagaaaataaaacaacattcttagaatcacaataca

SEQ ID NO: 84 - DNA, 1106 bp, Arabidopsis thaliana
acaaaaaaattcaaagagtcgttccaatagaccccttttcccaataaaccctaattccttgcggcttcttcttcttcctcctcctccattcctctgtaattatcaaatgtttggtgtttcgatgagaacattaatctcaccatctcttgctcccttctctcttcatctccataaaccctctctcttctccaccgctcttcgcttctccttctcaatcaacaacataacccccacaaattcacctccttccaccatttccaccagaaagctacaaacgaaagcgacgagggtaacatcatcatcatcatctcagccgctctcctcctcatctcccggcgaaatccacgtcgtagtcggtccaatgttctccggtaaaacaacaacacttctccgccgtatactcgccgaaagagaaaccggtaaaagaatcgcaatcatcaaatccaacaaagacacaagatactgcaccgaatcaatagttactcacgacggtgagaaatacccttgctggtcactccccgatctctcgtccttcaaagagagattcggattcgacgactacgagaatcgattagatgtgattggaatcgacgaagctcaattcttcggagatctttacgagttttgccgtgaagctgctgataaagagggtaaaactgtaattgttgctggattggatggtgattttatgaggaggaggtttggttcggttcttgatttgattccgattgcggatacggttacgaagctgacgtcacggtgtgaggtttgtgggaagagagctttgtttacgatgaggaagacggaggagaaagagacggagttgatcggtggtgctgaagtttatatgcctgtgtgtaggagtcattacgtttgcggtcaaaacgttttggaaaccgctcgtgccgttttggattcaagcaataatcatagtgttgtagcaagttcactttagtttgtaggatttgagagtgtttagatatttggtttattagctttgagatatttggaattttaaacataattatgtactatttaatcaatgattttaagataacactcttatttgtgaatttcttgtagaaacccttatatcgaaaaaattt

SEQ ID NO: 85 - DNA, 1525 bp, Arabidopsis thaliana
aatttatttccctcaaagtaccacttaatcatcgactttttgaccatttctccatctgggttttattatcttcagttctttgtgtcacaactccagtttctttttgtattttgttgtttttttcacaaattgagattgttgtttcctataaggttttgttttattctatttatggaagtctcttgatttcgcttttataacctcaaaaagcatctttcttgatagcaccaagtatgatttgatcatcaaaagggtttggatttgacaggtctctattttaggtttgtttttggttagaagttaaaaccaaaataaaatcttaacttttggaaatgggatctgttactgggttttactcaaatgaagtgtttgaattagatcctaaatgggttgttgatcctcaacatctctttgttggtcccaagattggtgaaggtgctcatgccaaaatctatgaaggaaagtataagaacaaaacagttgctattaagattgttaaaagaggagaatctcccgaagagattgcgaaaagagagagcagatttgcaagagaggtctctatgttgtctagagttcaacacaaaaatttggtcaagttcattggagcttgcaaagaaccaatcatggttatagtcaccgagcttttactcggtggtacattgcgtaaataccttgttagcttgcgtccagggagtttggacatacgtgtagctgttggatatgcccttgacattgctcgggcgatggaatgcttacactctcatggagtcatccatcgcgatctcaaaccagagagcttgatcttaactgcggattacaagactgttaaactagcagattttggtttagctagagaagaatcattaaccgagatgatgaccgcagaaactggtacatatcgttggatggctcccgagctttacagtacggtcacgttgaggcatggtgagaaaaaacactataaccataaggtagatgcatacagcttcgccattgtcttgtgggagcttatccacaacaaattaccttttgaaggcatgtcaaatctccaagccgcttacgctgctgcattcaagaacgtgaggccaagcgcagacgatttaccaaaggatttagcaatgattgtaacatcttgctggaaagaggatccaaacgatcgaccaaacttcacagagattattcaaatgcttctacgttgcctctccacaatctcatcaactgagcttgttcctccggccattaaacgtgttttctcgtcggaaaacacggtcttgccaccagaatcgccgggaacttgctcattgatgactgttagagacaaagatcagattcctaccgatgcaaactcggcgcagaatgaagttagaggaagcttcttcttcttctgctgctaatatttgatttattggttataaagtgaaacatgagagaatgtggtttgatatatcatatgtaatgtattaatttgaatgataatagcttagagttattgttatgagtttaacgtttttcctaaaaatgttct

SEQ ID NO: 86 - DNA, 2214 bp, Arabidopsis thaliana
agacaattcactctcttatcacagattttacaagatgaaccccaaaatcagaaaacccaataattcatcttcgaagaaggtcacagtttccgttctctctgttttcttagtgttcgtcttcgttaatactttcttctacccaagtttttactctgactctggctcaattcgacgcaatctcgttgattctcgagaaagtttccattttccgggaaattttcgtaaaacgaaggtttacatgtacgaattgccgacgaattttacttacggagttatcgagcaacacggcggagaaaaatctgatgacgtcaccgggttgaaatatccgggtcatcagcatatgcatgagtggtatctttactcggatcttacccgacccgaagttaaacgagtcgggtctccgattgtaagggtttttgacccggctgaggcggatttgttttacgtctctgctttctcttcgttaagcttgattgtggattcgggtcggcccgggtttgggtacagtgatgaggagatgcaggagagtttggtgagttggttagaaagtcaagaatggtggaggaggaacaatgggagggatcatgtgattgttgccggtgatccaaatgcgttgaaacgggtcatggatcgggttaagaatgcggttttgcttgtgacggattttgaccggttaagagcagaccaagggtcgcttgtgaaagacgtaatcataccttattctcataggattgatgcttatgaaggcgagcttggagttaagcagaggaccaacttgttgttcttcatgggaaatcgatatcgcaaagatggaggcaaagtccgagatttgcttttcaagctgcttgagaaagaagaggatgttgtgatcaaacgcggaacacagtcaagagagaatatgcgtgcggttaaacaaggaatgcatacgtctaagttttgtctacatctagctggtgatacttcttctgcttgcagattatttgatgccattgctagtttatgtgtcccggtgattgtaagcgatgggattgagctaccttttgaagatgtcatagattacaggaagttctctatattcttgaggagagatgccgctttgaaaccagggtttgtggttaagaagctgaggaaagtgaaaccaggaaagattttgaagtaccaaaaggttatgaaagaggttaggcgatattttgactatacacatctaaatggaagtgtgaacgagatctggagacaagttactaagaagataccgctaatcaaactgatgattaatcgggagaagcgcatgatcaagagagatggaagtgaccctcaatgttcttgtttatgctcaaaccaaaccgggatcatccatggtgtctagtaaggttaaatgcctagcaagctcatgctaagcaacaaaatgtgatcattattaatgatgaatcaaagactggaaaggaacaacaagagaaaccacatcactctctaattccgggtcaagggtttgatcaagaatgcgcgtttcctggtgggttttgactttgggagtgttaaatatcaagagagattcaagcaaagagagatctcagggcacgctcccaaccctcgaccctctcaggctcccctgcatggttttgcttcagttgcttaaaaggaagggaaaactctccatcaagattgccttctccatcgggattggctgctctttttacatcgtccgatcttacgttatagaagattggaatcaccacgagtttcttttccttcatctgttcattcatcgtcacaagctcatccaaacaccactttgactcacagtacctcttggagaagatagcaagcgcgatttttgacttcttgatccttgtgaagagatattgtagtcttctccctttctgctctttagtgtctatgaagacgttgatccctgcgtttcttaattgcagctctagatggttgacaaagatttcgcgcagctcatctcctcggaagttgataaacacctgatcagaaagaggttcttggacctgctcatccattggaatggtgtctaggttcgtctgaataaaaaatagtgaatatagttggtgagagactttgttgtctcactttgtcctttaaaatacattacagagaaacgattctttaattcttcagaccaatcagtggctcgatgccaagtctgcgcctatcctcagtctttctttaatattatacaacattattgtc

SEQ ID NO: 87 - DNA, 2320 bp, Arabidopsis thaliana
atactatatagctttgagtctcctgtgtgagagagagagagagaattgtgttgttgcatagttccaataatggcaaagacgaatcaagccatcactatctgttcccttcttctgcttcttctactctctgaaacaacttctcaccttctttgctcagattcaaagactccagtcaacaacaacgagacactccagttctgcgattcctacaaagaaagatcttgctgcaattctaaagatgatcttcaattacagaatcgcttcaactccatgaacatctctgactctaattgttcttctcttctcaaatccattctctgttctaaatgtgatgaattctcaggacaattgtttggtgatgatgatagttctctagttccaattctctgcaactcaacatcacaagacttatgttcaaaactttgggattcatgtcagaacatttccattgtttcttctccttttagtcccactctacttggtggtgctacttcgccttcaacttcatcaaattcatcgacattaaccgatctttggaaatcccaaaccgaattctgtacagcctttggtggaccatctcaaaccaacaacaacaaaaccaaatgcttcaatggtgaaccggttaacagagacactagtgatgatgatgaggatgatgttaagacacctaaaggaatatgtcttgagaagataggaactggttcttaccttaacatggtcgctcatcctgatggttcgaaccgggcctttttctctaaccaacctggtaagatttggttaggtacaataccggatcaagactcaggtaaaccgatggaaatcgatgaatcaactccttttgttgatattaccgatcaagttagtttcgatacgcagtttggtatgatgggaatggcgtttcatcctaagttcgcagagaacgggcggtttttcgcgtcttttaactgcgataaagtcaaatctcctggatgctctggtcgttgtgcttgcaattctgatgttaactgtgatccttcgaagcttcctaaagatgatggcacgacgccttgtcgttatcagaccgttgtgtccgagtataccgcaaacggtacttcctcgagcccttcaacggcaaagattggtaaagcatctgaagtgaggaggattttcactatgggacttccgtattcttcatctcacggtggtcagattctctttggacctgacgggtatttgtatctcatgactggtgacggaggaggagtttcagatactcacaactttgcacagaacaagaagtcgttgcttggcaaaatcttgaggcttgatgttgatgttatgccaagcgtatctgaaatctctaagcttggtttatggggaaactactctataccaaaaaacaatcctttccaaggaaatgaaaatgagcagcctgagatttgggctttagggctacgaaatccatggcgctgcagcttcgattccgaaagaccagattacttcttgtgcgcagatgtcggaaaggatacatatgaagaagttgatatcataacaatgggtggaaactatggctggagaacttacgaaggaccatatgttttctcaccgttatcgccttttggagaaaatgtttcctcggattcaaacctgacattccccattctcggttacaaccactctgaagtgaacaaacatgaaggatctgcttccatcattggaggttacttttatcgatccaacactgatccttgctcttatggaacgtacttgtatgcagatctttatgcaaacgcaatgtgggcagcgatcgaatcaccagaagatagtggaaacttcacggactctctaataccgtttagttgcagcaaggattcaccgatgaagtgtaccgcagctccaggaggagctagctcaggacctgctcttggttacatttactcatttggacaagacaataacaaggacatacatttactcacgagctctggtgtgtatcgaattgttcgtcctagtcgctgtaacttagcttgctccaaggaaaacaccaccgcttctgccggaaaacagaaccctgctggttctgctcctcctcagcctttaccttcttctgcaagaaagctctgtttctctgtgtttttgttattgtcgttgttgatgatgtttttaacgttgttagattagaatgatgattgtttcagactctgttttgtaacagttcttatggatgttattcaaaaactattttgtgattgcttatattagacgaactcatatgtaataaaccattaagtttgagttcttttgtattgttatgtcgcagcaatgtgatcaatctcccagg

SEQ ID NO: 88 - DNA, 1216 bp, Brassica napus
tagaaaatattggatatggatttgatcaaaatctaatctttctattgttactccgaccactgttacatcacctctttctcctttcatggcggaagctaacaagacaagtagagaaattgcaagaagcaatagttgtgtgttcccaagagatctgcttcagagattcatctctaactcagccgaaggtgaagatggtgatcacgaggaagaagatgatgaagagatcgagttgaatctggggttgtctctcggcgggagattcggagttgacaaaagcaataagctcgtgagatcttcctccgttgtcgtgacgatgcctcttttccgggaagctcatcagccggagacgacgaagcctgcggagacagccgtagcgagaccgagacacacgggcttaacgagaacgacttcgttgccggcggagtcggaggaagagtggcggaaaaggaaagagatgcagactcttaggagaatggctgccaaaagaaggagaagcgagaagcttcgcaccggcggtggaaacagcaccaagtcaaccgaagctaataataatccgggagaagcggccaccacttcgaggcggcgaggtagaccgtcgtcgggacttccacggtggtcagcgacggctaacagtggtggactcttacggcaacatagcgctggtcatgagtcactacaaggctcccttgagtcccaaggcggcggcggcggtggtgtcggaagctcttcaagtgtctccgagttggaaaccaaatcccatcaagcatctagtgaagaagcaagaagcttaccgtcgacacaacaacaacaggaagcgatagcaaagccgaacactcggcttagaagattgagttcagtggacatgaagatagagccaccacaagggaaagggaaaaacgagatgccatgtgtgttcacaaagggagatggacctaacgggaagagagttgatgggattctttatagatatggcaatggagaagaagtgaggatcatgtgtgtctgccatggtgacttcttgtctcctgctgatttcgttaaacatgctggtggtcctcatgtagatcatcctcttaggcacattgttgtcaacacttcttctccttctaatctcttatagaaccccttcctaacccctctcctcatttgatccctttattttaagaccagagtgttgcgaagatgttgtaagaggtttaagcagctattcttgttg

SEQ ID NO: 89 - DNA, 1897 bp, Brassica juncea
cttatttcttgaagcagcttggttaaaaacaatggttgtgtttgggaatgtttctgcagcgaatttgcctcatcaaaatggggttttgaaggcaatctcatccggaggttgtgatttaatgggacatcgcagcttcaaaatttcaacttcttttaagacaagaacaaggaggaggagtgctggtcctttgcaggtggtttgtgtggatataccaaggccagagctagagaacactgtcaacttcttggaagctgcaagtttgtccgcatctttccgtagtgctcctcgtcctgcaaagcctttaaaagttgtcatcgctggtgctggattggctggattgtcaacagcaaagtacctggctgatgcaggacatcaacctctgttgcttgaagcaagagatgttcttggtggaaagatagctgcatggaaggatgaagatggagattggtatgaaaccggtttacatatattttttggtgcttatccgaatgtgcaaaacttatttggagaacttgggatcaatgatcggctgcagtggaaggaacactccatgattttcgccatgccaagtaaacctggagaatttagtagatttgatttcccagatgtcctcccagcacccttaaacggaatatgggctattttgaggaacaacgagatgctgacatggccagagaaaataaagtttgctattggacttcttccggctatggtcggaggtcaggcttatgttgaggctcaagatggtttatcagttgaacaatggatgagaaagcagggagtacctgatcgagtgactgatgaggtgttcattgccatgtcaaaggcgctaaactttataaaccctgacgaactttcaatgcaatgcattttgatagctttgaatcggtttcttcaggagaaacatggatcgaagatggcgttcttagatggtaatccaccggagaggctttgtatgccaatagtggaacatattagatcactaggtggtgaagtacgtcttaactcaaggataaggaagattgagctcgagaatgatggtactgttaagaatttcttactcactgatggcaccactatccaaggagacgcttatgtctttgccactccagtggatatcctgaagcttcttttacctgattcatggaaagagataccatacttcaagagattggagaagttagttggtgtgccagttattaacgttcatatatggtttgatcaaaaactaaagaacacatatgatcatttactctttagcagaagtaaccttctgagtgtgtatgctgacatgtcgttaacttgtaaggaatattacgatcctaaccggtcaatgctggagctagtatttgcacctgcagaggaatggatatcacggaccgactctgacatcattgatgcaaccatgaaagagctcgagaaactcttccctgacgaaatctcagctgaccaaagcaaagctaaaattctcaagtaccatgtcgtcaaaactccaaggtctgtgtacaagaccatcccagactgtgaaccatgtcgtccactacaaagatctcctattaaaggattctacttagctggggattacactaaacagaagtacttagcttccatggaaggcgccgttctctctggcaaattctgctcacagtctattctacaggattacgagctattggctgcttcctctggaccgcaaaagttgtcggaggcgactctatcaacataagacaggaagcttaaatattttgtaacttttgtgtacaaacctcatttcaatacaaagttacagatttggcaaaaaggaaacaatgtattgccaggaaaatatgaatgcacttgatttatatgtgtactatatatcaatattttaaataaattatgaattcatttcaaataa

SEQ ID NO: 90 - DNA, 1200 bp, Brassica juncea
aaagataacctcatagtgtcgacatggcttgcaaaaacagtcttgttgtgaagcagatcatcgacttatacgaccaaatttcaaagctcgagtgtttgaaaccttcaaaaaatgtcgacactttgttcggacaactcgtgtccacgtgcttacccacggacacaaacatcgatgtcacaaagatgagtgatgaagtcaaagacatgagatctaacctcatcaagctatgtggtgaagccgaaggctatttagagcaacacttctccacaatcttggggtctttaccagaagaccaaaacccacttgaccatttaaacatctttccttactacaacaactacctcaagctaggcaagctcgagttcgatctcttgagccaacactcgagccatgtccccaacaagatcgccttcgttggctcaggaccgatgcctctcacatcgatcgtcttggctaagtttcacctctccaacacgacgttccacaactttgacatcgactcacacgcaaacacactcgcttcaagcctcgtctctcgcgatcctgacctctcaaaacgcatgatcttccacacgacggacgtgctaaacgctaccgaagggctagaccaatacgacgttgttttcttggcggctcttgttggaatggacaaagaggcaaaggtcaaagccatcgagcacttggagaaccacatggctcctggagctatcctcatgctaaggagtgctcatgctcttagagctttcttgtacccaatcgttgactcttctgatctcaaaggcttccagctcttgaccatctatcatcccactgatgacgtggttaactcggttgtcatcgcacgcaagttaggtggttcgaccacgaccggagtcaatggtactcgtggctgcatgttcatgccttgtaactgctctaaggtccatgcgattatgaacaatcgttgcaagaagatgatgatcgaggagtttagtgccatcgagtaatcaaagcaagtaattactgaacacatctcatctcttgagactatgtgttaatgttttgtcttatattaatttttctttttaatttcatgtgatcttgtgtgttttctgacgtgtgtggttcgtataagttggtgaattttgagttctttgatcttcgttatgaactgtgaagatacagaagaactctttcttcgttccttttttctatcaataa

SEQ ID NO: 91 - DNA, 1517 bp, Brassica juncea
attcaaaagcaaaatatttctaaacagagagaaagaagtaagaaatggctaccacaccaaaatgcactgagtggcaattcagcgggagtgaggctgccaaagaagctgctgcggccaccctaggcgcctacacctctaaactatatgctctctgtgactctaatggcaagctcattttgcccccaagtaacaaggccatcgagaccagccataccgccgaaaaagctgttgttaaagttgttctctccggcactggaaacgcctatgctcctagcattggccttccgctcgccaaaagtgccgtagcagagtatctaaaccgagatcttccaaagaagctaacagcagatgacgtgtttatgactgttggatgcaaacgagcaattgaccttgcggtggatattctggctaaaccaaaagccaacgttttgcttccgaggccgggcttcccatgggatgtagtccgctccatctacaagaaccttgaggtccgttactatgatttcatccctgaaaacaactttgagatcgacttcgaaagcgtcaaaaaggtgacagacaagaacacgtttgctatatttatcatcaaccctcacaatcccaatggaaacacctactcggaggctcatctcaaacagctcgctgaattggctaaggaactctcgattatggtggtttctgatgaagtttttagatggaccgtcttcgggaataacccttttgttccgatgggaaagttttcttccatcgtaccagtggttacactcggatccttatctaagggatggaatgtcccaggatggcgaactggctggctcgcgctgcacgatctagacggtgtcttcagaaacactaagataatacaagctgccaacgaatttctccagataaatgccaaacctccgactgttatccaggcggctatgcctgacattttggagagaactccattacatttcttccaagataggggaaattttctgaaacataaagtagatattggatattctaaagccaagcacatacctggcctcacttgttacatgaaacccgaagcgtgcaccttcttatggaccaagctggatatatcgtgctttgctgacattgaagacgatcaagacttctgcagtaagcttgctatggaagaaaatctcgtcgttttgccagggattgcatttaggcagaagaactggttgaggcattctatcgacatggagacgccaacagttgaggacgcatttgaaagattgaagagcttctgtgaacgccattccgttgaaggtggagcttcactcaaaaacgtcaatggcgtgaactaaataaagggtcaacatgatgatatttgcctacgtctatttacatatgctaggataataaatgggtgtttttggtaacgtgagataaatcatgaacactttcgtatttgtaacaaataaaattggtgtacttatcatcaatcgtagaatgttttctcatgatgtatctactttcgaataataaaattaatttgtaccaaa

SEQ ID NO: 92 - DNA, 742 bp, Brassica juncea
agtacgcggggaaagaaacataagaattttcagattcttgaaaaactattagggttgaattttccatgggcttactagatcatctatgggatgataccgtcgctggtcctcggccggagaacggtcttggcaagcttcggagacaccataccttcagtttccggcctaactccggcagtgatcaatcggacggtggaagcgtgagatcgtacggtgaagaatcaccggaggaggcgctgaaagtaacacgtagcatcatgataataaaaccaccaggataccaaggcggttcagctccggtttcacccgccggttcaactccgccggtatctcctttctctgagcaatcgcaggaggaaaggaaccctttcggtttaggagaaggtcgacgtcggacgcgttcgataagggagcagcaggatcagagaatggaccaaggaactctcctcctacttacggcctgtgatctctaatctcttaactcaaatgagagagagaagaagaaaaagaacagagtagtcccaacaagctttcgtttagacgacacatcaaatggtccttccttgcatgcagagttcgtgtttcttctgtttgtaggccatagaggttctctcttgtgtgtgtgcgtgtgttagtttgtttttagttttgtgtgttgtgaatacgtctctgtttttgtatgtcgtcttgttttcgtaattcttctacgtgtctgtacatatttgatgataataaaaatacg

SEQ ID NO: 93 - DNA, 432 bp, Brassica juncea
acaaagacgagatttcaagacgcggaaaacatagagagaagaaacatatacctcaaaagcaccaaacacaaaccaaagaagaagaacacaatatggtgtctcaaaagctggagatttgcatcgaattagtgaagtttgccgtcgtttttgtagccaccgtggctgaatcagtagaaaaggctttccggaagcctttgccggcgcttccagcagttcatgatggtagccggaatacttactcggccgttcccattcctcttgttggattcatgtgatgagctttcttttgtttgtttattttatttttcttctcttttttgggttttgacctcgttaaagttaggagtggcgttttgaagttgttgatatgtgtatacgcataatcaaagtaatcatgaagagttgcagatgaatcaaaccgttgaactttac

SEQ ID NO: 94 - DNA, 756 bp, Brassica juncea
gaataggaaataaagcaaaaaaagagacaaaacaaaactgaggaaaaagaaaaatgagtggctccgttgcgcagcttcacaatgttttcgtctatggtagctttcaagagcctgaggtcgtcaaggtcatgcttgatcgtactcctgaaatcatccctgtaacactccctggctttaagaggtttaggcttaaaggacgtttgtatccatgtgttataccgtgtgaagatggagaagtcaaaggacagttactaatgggattaacggatgaagaacttgagaatgttgatgctgttgagggtaatgaatatgagagagtgacagttggtgttgtacgagaggacaattctgagaagatgactgtgaaaacatacatatggctcaataaagatgatcctgatatcgatggagaatgggatttcgaggaatggaaacgactacacatgaagaaattcatagagacgttcaaagaaatcatggaatggaagaggaatcctcatggaaagggaagggacgacttcaaccatgtcctgcgcgatgctccatcggcttgaattgaatctgtgttaagagtatgttctatgtttcatttttctccagattccgagtataataaaacctagaaaactgataggtattgtggcgatcagttaaaataatagtaatgctatatgttattttgtatgttctatgtatcacatttcttctagagattttggcattcatcttgtgtatggtttggttgatgctaatgct

SEQ ID NO: 95 - DNA, 1900 bp, Brassica juncea
ctctctctctcgccgccgacgctacaacaatggcgtctctcgctctctccggctcctgctctctcgccttccccctcaaatctcgctccctcctcctccctcgtcctccctcctctctcaatctgctgaaaaaacctctccgacgcatctcctcagtgaaatctccactctccgtctctctcaccaactccaagagatcgactctcgtcagagcctcctccgtcgccgccgcagcttcctcctcctcctcctcatctccatcccccgccgccccagctccggccctgtggcaaggagccgcgatcaagcccctcctcgcgtcgatcaccaccggcgtcatcatctggttcctccccgtcccggaaggagtcacacgcagcgcgtggcagctactcgcgatcttcctcgccaccatcgtcggcatcatcacccagcccctccccctcggcgccgtggctctcctcggcctcggagcctccgtcctcaccaaaaccctgacgttcgccgccgccttctccgccttcggagaccccatcccctggctcatcgccctcgccttcttcttcgcccgaggcttcatcaagaccggcctcggcaaccgcgtcgcctaccagttcgtccgcctcttcggcagctcctccctcgggctcggatacagcctcgtcttcagcgaggctctcctcgctcccgcgatcccctccgtctcggctcgcgccggcgggatcttcctccctttggtcaaatccctctgcgtcgcttgcggtagcaacgtcggggacgggaccgagcaccgtctcggctcgtggctgatgctcacctgtttccagacctctgtgatctcttcgtccatgttcttgacggctatggcggcgaatccgttgagcgcgaacttggcgtttaacacgattaagcagacgattgggtggactgattgggcgaaagccgcgattgtgcccgggattgtgtcgttgatcgttgttccgtttcttttgcatgttatctatccgccgacggtgaagagcagccctgatgctcccaagctggctcaggagaagtttgataagatggggcctatgtccaagaacgagttgattatggctgccacttggttcctcactgttggtctctggatctttggtgctaagctgagtgtagatgctgtgactgcagccattcttggattatcagtgcttcttgtgacaggtgttgtcacatggaaagagtgcttagctgagtcagtcgcatgggacacactcacttggttcgctgctctcattgcaatggcgggttatcttaacaaatacggtctcatcgaatggttcagccagaccgtagtcaagtttgtgggaggattgggtttgacatggcaactatcgtttggaatcctcgtcctcttgtacttctacactcactacttctttgcgagtggagctgctcacatcggagctatgttcaccgcctttttgtctgtctcaacagctctaggaacaccaccttactttgcagccttggttcttgcattcctctcgaacctgatgggaggactgacccattacggtatcgggtctgcgcctatcttctacggggctaactacgtgccgctggccaaatggtggggctatggattcttgatctcgatagtcaacattcttatctggcttggtgtaggtggtgcctggtggaagttcattggcttgtggtgagtgggatcaccacacagtagcattctcattcttttccttacttatatataatctctcacgagtggctttgagattcagatttgttaaggattaaggattgataatcaggatttgtaagagtttgagttcgcgatagttgatactctcgcacacattttgagttgtaaaagatcttaacttgcatcaattttgttttt

SEQ ID NO: 96 - DNA, 864 bp, Brassica juncea
aaaaaaaagattacaaaatacatacgtttgcatttgaaaagaaaaaattggaagagaatacaaaatggcaacgcgaggagctgctgctgcgttcgtaatatggaagcaccgaaacaacccttctcttcgatcgatatcatcgcaccatttctatcccattttcaaacctcaaatgatcccaaaagggtgtagatatcaaattagggcaatacaaggagaaagtgttgatcgcggtacacaatcgaagaacaacgatgagccaaaaccaaaacctgagaattggaaaatcaaaatgctttacgatggggattgccctctctgtatgcgtgaggttgatatgcttaaggaaaggaatgaggaatatggaacgataaagttcgtcgacatcagttccaatgattattccccgcaagagaatcaagggcttaattacgaaactgttatggggcaaatccacgcgattcagtccgatggaaatgtggtaacgggtgtggaggcaattaggaaactatatgaactggttgggcttggatgggtttactctatcactaaatttgaaccaatagggaaggtagctgatgcagtgtatgatttctgggctaagtatcgacttcaggtcacagggcggccacctatagaagctattcttgaagcgagaaagaaaaataaggtagagacatgtggtgacagtaaggcgtgcaagacgtgatttttcttacaaattacatataccacaaccagtttgtagttacatatgctctgttttcccgcattatgtaaacttgagtgtttcgatgtattagataaaaagtacgttacgtatatatcggaccagatcttcctttggaaataagaatattcgaa

SEQ ID NO: 97 - DNA, 893 bp, Brassica juncea
gagtttcttctatgttcgtctacgactcctatctaaccttaatcatcatcccttgtgttggcttctttaagaacttgctttccaagcaaagctcgaaaatacaagaaagtaaaaggtatggcgtcgaacaacagcaacgatgatttgtatgctgttcttggtttgaacaaggaatgtacctcgaccgaacttcgcactgcttataagaagcttgctcttagatggcatccagatcgttgttcatcgatgggaaacttggagtttgtagatgaagcaaagaagaaatttcaggctattcaagaggcttactctgttctgtctgactccaacaagaggttcctctatgatgttggagcttataacagtgatgatgatgtcgaggaccaaaatggaatgggagatttcttgaacgaaatggctgcaatgatgaatcaatccaagcctaatgacaataattcaggggacagttttgagcagctacaagatttgtttaacgagatgtttcaaggagacgccgcggcattcccaccctcatcatcatccttctctgcttcaactttcgcttcctcttgtaactttgtctttgatacaaactatcagcagtcaccgtttgggatgggctcgatggggactagcgatcctttcggatttgactcaagatctcacaccttctctttaggggtggaacatcagcaggatttcaagaaagagaagaacaatggtggaagaaggaacagacggaagaacaatgctcaatcttctaacaactatggagtccctacttcatagcgcccttcagaccatattttttatttgtcgactagtcacaggactactggttatggtctcctcaacggcgatgcatgaaaatactcaaaagcattgtcgtttgt

SEQ ID NO: 98 - DNA, 1157 bp, Brassica juncea
gctgttcttccccctttcggtttcgaaattagggtttccctctgtgctctcctttaatccccagtttggaagatgcctaggtatgatgatcgttacgggaacactcgtctgtacgttggacacttatcatccagaactcgtaccagagaccttgaacgccttttcaacagatacggaagagtgcgagatgtggatatgaagcgggattatgcctttgttgaatttagtgatcctcgtgatgctgatgatgcgagacattacttggatggacgagactttgatgggagtcgcatcacagtggagttttcaagaggagcacctcgtggctctcgggattatgacagcagaggcccacctcctggatcaggtcgctgctttaactgtggtcttgacggtcattgggctcgagactgcactgcaggagactggaagaacaagtgttaccgctgtggtgaaagaggacacattgagagaaactgcaaaaacagtcccaagaagctcaggcggagtggaagctactccaggtcacctgtaagatcccgttctcctcgtcgtagaagaagcccaagccgtagcaggagccttagccgtagccgaagctacagccgctcaagatcccctgtgaaaagaagagagagaagtgcagaggagagatctcgcagtccaaagcgaatggaggactctctgtcgccaagaggcagagaccgtagtccgattatggatgatgaaggtagcccaaggatcatagacgggagccctccaccatctccaaagcttgaaaagcaagaccatgatggtggtagccctcaagacaatgggaatggcaggaaaactaatgccagtcccgtggtgggacgcgacagtccgagagaggaccgaagccccgttgatgatgactacgaggccaaccgtgcttcccctagaggaagcgagtcaccttgactttgatggctcatggcctcaagtcacaggcacttagcatgttgtactatttgatcagactgccccagatatttactctctttttatgtgtgtttgctttggatattcttaagttcatgttgtcaggagttctttcttttacccaactgagatgatggttaaacttgtaagacattaatgggttggcttttcattttcagacaattttttgttac

SEQ ID NO: 99 - DNA, 363 bp, Brassica juncea
tcactgagctattgctcgagtacacggcggccctcgcgaaactcaccgccgggattcttcctagacggcaaggagacagggacgttgtgaggattggtggcttctctctacgttgtcctccaagatcattgcctattcctgacttctcttctcatctcgttgacttctgatatgccccgcaaaggacttctttctgatctcagtgttgtgctactaggatattgtgaggccgagactttttcattttccctctgatcctatctctgtaacttcttttttagctgaaggaaacgtcatctagattcttgatcatagctttgtaaaattgtatccaattataaatagagtggttatgatgaacgg

SEQ ID NO: 100 - DNA, 1958 bp, Medicago truncatula
cggccggggacacacctttcttttttcttctacttctatctctcttataacaattcaattactcacactaacataaaaacataaacataaacatggaactaagtatcatgttatgtttctttacttctattctcttcattgttctgttcagaatattcatcaaatcctttgtctcaaaaagacatgacttgccactcccacctggttcaatgggttggccttacataggagaaacttttcaactttattctcaagaccctaatgtcttctttgcatcaaaaatcaaaaggtatggttctatgttcaagtctcacattttgggatgtccatgtgtgatgatttcaagtcctgaagcagcaaaatttgtgctgaataaagctcaacttttcaagccaacattccctgctagcaaagagaggatgttgggaaaacaagctatcttttttcatcaaggagagtatcatgctaatttaagaagacttgttcttcgcacgttcatgccggtagccatcagaaacattgttcctgacattgaatccattgctgaagatagtcttaaatcaatggaaggacggttaatcaccactttccttgaaatgaaaacgttcacattcaacgttgctctactttcaatttttggaaaagatgaaattcactaccgagagcaattaaaacagtgttactacactctagaaaaagggtacaattcaatgccaattaatcttccaggaacactcttccataaggcaatgaaagctagaaaagaacttgcacagatcctagctcaaataatctcaagtagaagagagaagaaagaagaatacaaagatttgttaggttcattcatggatgaaaaatcaggactaagtgatgaacaaatagcaaataatgtaattggagttatttttgcaactcgtgataccacagctagtgtgcttacgtggattgttaagtaccttggtgaaaatatcagtgccctagaatcagtgattgaagaacaagaatctatattgaagagcaaagaagaaaatggtgaagaaaagggtcttaattgggaagatacaaagaaaatggttataacttcaagggttattcaagagactcttagagttgcttcaattttgtctttcacttttagagaagcagttgaagatgttgaatatcaagggtatcttataccaaaagggtggaaagtattgccactatttaggaatatacatcatagtccaaataacttcaaagatccagaaaagtttgatccttcaagatttgaggctgccacaaaacccaatacttttatgccatttggcagtgggatccacgcttgtcctggcaatgaattagccaagatggagattttagtcctcttacaccatctgaccacaaagtacaggtggtctgtggagggtacaaagaatgggattcaatatggcccttttgctcttccccaaaatggattgcccataacattatatcctaagaagtagataacacttcaacataagattgatcagccacaccatattctatagaatcattttaaatatggaaataatgaattcttatcattgttctcaaaattggctctaactctctcaacaaaatgaggaaagatcaagacaatgttgcaagggagattagatcaactcttgctttctttttggcctatagacacccaaagggtagtcttgagaatagaacagaaatagggatggagtttgtcaagtgtatataagaggtttcatagcaagagcaaatagtttgagtttttattttttatttttttaactttatttttctttccaattttgaggaaaagtcctcaaaatattgtattggtagttgttacttgttacattttatctcacctttgtaacctacaaataattttagtgtccacctaacaaatttcctaaggacatttgttagagacacctgattgaataattttaattact

SEQ ID NO: 101 - DNA, 1246 bp, Medicago truncatula
taatcggcacgagattcactatagcaatggcaagtttcagtgcaaaatccatgacaatgttctttctcttcacaattatctttggttttggatttcttcatgcatctgcacaattgcaaagatttacacacacaccaaaaactgatggttctcttaatttcttggttattggtgactggggaaggagaggtaaatacaatcaatccgaggttgctttccagatgggagtggttggagagaagcttgacattgattttgtagtttcaactggtgacaatttctatgatgatggcttaactggtgaacatgatcctaattttgaggaatcattctccaaaatttacgcagcaaaaagcctgcaaaagcagtggtacagtgtgttgggaaaccatgactacaggggtgatgtagaggctcaattgagcccattccttagacaaattgatagtaggtggctttgtttaaggtctttcattgtagattcagagctggttgagattttctttgttgacacaaccccttttgttgaagaatacttcactgtaccagaacaccattatgattggaatggagttaacccaccacaaacttatattgccaatttactaaaggatgtagaaatggcattgagagaatcaacagcaaagtggaagattgttgttggtcaccatgcaattagaagtgctggtcatcatggtgatactaaagaacttgttaacctgcttcttccaattcttcaggcaaatcatgttgatttttacatgaatgggcatgatcactgtcttgaacatatcagtgatttaagcagtcctattcagttcctggttagtggggcaggatcaaaggcatggagaggagacgttcgagaaactaccggaaacggtgtaaatttcttctatgatggacaaggtttcatgtctgttcaattgactagaacagatgcaaacattgtgttctatgatgtttctggccaggttttgcacaaaaccacttcatcaaagcagctacattcttccatataaagttcagaacatgtataagatcgatagaaagaaaatgagattaaaaaggttttggggactataggattggtttttaaattcaagtcaccaattcttgaatacattactataagttgtatatatatttctattgcttaggattttcatgatttgaaattttgaagttctatttcttggtatattgtattttgtaaataaatattttgatggatgagttttactag

SEQ ID NO: 102 - DNA, 2239 bp, Glycine max
gttcgccatattcataggtagtggttgtgagcgaaactatgccatataccacaacacaacacattaatataccataacactcctattgttttgtttctgtgttccctacgttacacgcgttagtagttactcactttccttctcttcacaaacctacttgtttctctctcattttttccccactataacatgtctctaagtctagccatcaaactacacctggcttcttcttctccttctttttccctccttaccctcaacaaccaccaacatgcaaacaagttaacaacttccgaaacttgttccaacaccaaggttcgtcccaaacccatttatagcaccaaccctttgatcattcccacgtgtaaagtgaggccaagagtgcaatactgtggcaccatgatcaagagttctttgatagagcctgatgggggggcattggtggatcttgtggtgcctgagggtgagaggggtgctaagatcaccttggctgagtcactgcctaaggtgcagctcacaaggattgatcttgagtgggtgcatgtggtgggggaagggtgggctagtcccttgaaagggttcatgagggaggatgagtatcttcagagtttgcatttcaattcccttagggtcaaggatggttctgtggtgaacatgtcccttcccattgttttggccattgatgatgagaccaaagagagaattggatcctcttcccatgtggggttgctcgggcctgatggagattgtgttgcaattcttcgaagtattgaaatctacaagcataacaaggaagaaagaatagctagaacttggggaacaactgctcctggattgccatatgttgaggaggtgattactccggcaggaaattggcttattggaggagatttggaagtgctaaaacctatcaaatataatgatggcctagataactacaggctctctcccaaacaactccgtgaagaatttgacaagcgtcaagcagatgcagtttttgcctttcagttaagaaaccctgtacacaatggtcatgccttgttaatgaatgatactcgtaagcgcctattggaaatgggctacaaaaatcccattttactgcttcatcctcttggaggttttgtaaaggctgatgacgttcccttggatgtcaggatggagcaacatagcaaggtcctagaagatggagttcttgatcctgagactaccatagttgccatatttccatcacctatgcattatgctggtccaactgaagtacagtggcatgcaaaggcacggataaatgcaggtgcaaatttctatattgttggtcgtgatccggctggtatgggccacccaactgagaaaagggatttgtatgaccctgatcatggaaagaaggtgcttagcatggctcccggtctggagaagcttaacattttgccattcagggtggcagcttatgacactaaggtaaacaagatggcatttttcgacccaacccgtgctaaagatttcctctctatatctggaaccaagatgcgggcttttgcaaaaagtggggagaatccgccagaaggtttcatgtgcccaagtgggtggaaggttcttgtcaaatattatgaaagtttgcaggcagaagagccatcacaacagcctgtgctatctacttagacattcttctaaaagtagaagcttagcatcaattgattccaatgggagagtgttaaaaacacatttctgggagtgccaatttttatgcctggtcttccagcttcatgatcaagatttaagcaatgcgctagcatatttgaattttttgtaccatattgaattgtccttttctttttaagttactatgactaaagaatttgttgtggtgcatcaagcataattgcagatgtagtcttctatctatggactcctgtaagaccagttcaataagggtgtgagaaattcagcagagccttggtgcttatggctatttagagaggggatatatgggatcaaggttttaaaaaacggttcgtaaccgcaattgtagtcgcaacttgaaggattttgaggtatgtgtgaccacatcatgaccgtaattgtggttgcattagctaaatttgtttacagtatcgaagattgtgataaaaccgtgactacaatttgaatgagctagaaagtggcagtgagatgtgatcactgttattcccactagtcaagtgaaccaaattgtgattttagaataaaactattgtttattagg

SEQ ID NO: 103 - DNA, 1005 bp, Glycine max
aaaatgaaacacttttagccattggtactgcttatgtgcaaggagaggatgttgctgcaagaggacgtatcctattgttctctttggggaaaaatactgataatccacaaactctggtttcagaggtgtactctaaggaattaaaaggtgctatatctgccttggcctctcttcaaggccatctattaatagcatctggtccaaaaattattctgcacaagtggaatggcactgagttgaatggtattgcattttttgatgcaccaccattacatgttgtgagcttaaatattgtaaagaacttcatccttattggcgatatccataaaagcatatactttcttagttggaaagagcagggtgctcaattgagcttattagccaaggattttggctctctcgattgttttgcgacagaattcttgattgatggaagtactctcagtctcatggtttcagatgataatagaaacatccagattttttactatgccccaaagatgtctgagagttggaaaggacagaagcttctttcaagagctgaatttcatgttggtgcccatgtgactaaattcttaaggttgcaaatgttatccacttcggatcgagctggtgctgtaccaggctcagataaaaccaatcgttttgccttattatttggtaccttggatggaagtattggttgcattgcgcctcttgatgaaatcacatttcgcagactgcagtctttgcagagaaaacttgttgatgctgtaccccatgtcgctggcctgaaccccagagcttttagactatttcggtcaaatggaaaggcccatcggcctggccctgacagtatagttgattgtgagctgctatgccattatgaaatgcttccattggaggaacagcttgaaattgctcaccaggttggaacaactcgatcacaaattctgtcaaatctaagtgatctgtctcttggaacaagcttcttgtgaacattcatctttcgtagatcatggaaca

SEQ ID NO: 104 - DNA, 1799 bp, Glycine max
tctcccccgtctattttacgcccctcctctgttcttcgctctctccactctgtttccactgagagaaaaaaaaaaaaagcatgaagaaaatccgcaactcgatcctactcttatcattcgtgctggcagcctcggcggcggtttcatccgcagagcagattccttccgctgcttacgaccgcgtgctgttcccggaccgccggtgccagaagacggcgtcggagaacatgacgcggcgaggatcctctgcggcggcggcggagtgtgaggtgtggagtgagtcatgttcggaggcggtgctgagcgtggcgcggcggccggagacggcggagtggctgaagaagattcggcggaagattcacgcgaatccggagctggcgttcgaggaaatcgagacgagtggtttgataagagaagagttggatctgatggaagttagttatcgataccctctagccaagaccggtattcgagcctggatcggcacggggggtccgccttttgttgcgatcagagctgacatggacgcacttccaatccaggaagctgtggaatgggagtacaaatctaaagttgccggcaaaatgcatgcttgtgggcacgacgcacatgtggctatgcttatcggcgctgccaagattttgaaaactcgagagcatttattaaagggaactgtaattctgttattccagccagcagaggaagctggtaatggagcaaaaagaatgatgcaagatggtgctttggaggacgtggaggctatatttgcagctcatgtatcccatgaacatccaactggtataattggctcaaggcctggacccctccttgcaggttgtggattcttcagagctgtcattagtggcaaaaagggtcttgctgccaatcctcaccgttctgttgatccagttttggctgcttcagctgcagttatcagcttacagggtattgtctcccgcgaagcaaatccattggattctcaggttgtctctgtgacttcgtttaatggaggcaacaatcttgacatgatacctgactcggtggtcctattggggactttcagagcgttctctaacaccagcttttaccagctacttgaaagaatagagcaggtgattgtggaacaggctagtgtctacagatgcttggcagaagttgacttctttgaaaaggagtacacaatttaccctcccacggttaatgataaccgaatgtatgagcatgtgaaaaaggtgtccattgatttgctgggtcataagaatttcagggtagttccacctatgatgggtgctgaagatttctctttctactccgaggtggttccctcaggtttcttctacataggagtaaggaatgaaacactggggtctactcatacgggacactctccatatttcatgattgatgaagacgttctaccaataggtgctgctgctcatgctagtattgcagagaggtacctcattgaacatggttgatgttggaaaatagttgaaagaaccctgctcttgttgtcacgtcttctcaaattcgtacaaaattggtacacgagttcacccgtccccctcatgtttctcacacgagtaaattctcagtttagttcgtgatattgcaagtgtttgtcactttagttattaaattaataaaatctttactttagtctctacctttatataatcccattaactgtaaataacattttacaaagtcgaaagactaaattaaagatttcgagtggtcaaggattaaaataccaaacacttaaaagttaagtgactaaaatagaaatttactttctt

SEQ ID NO: 105 - DNA, 1634 bp, Glycine max
acaagttgagcgagtgagtcacagttgttctcatcgaagcagaagaagaagaaatggcgacttctctgcaactgttccaatgcaaactagcgagaccctttcggccattccctttgcgaaggtcaactccccctctgagtctgaggtgttgcgcttcgcccccttcttcctacagcatcactctcattcccggcgatggaatcggccccgaaatcatctccgtggccaaagacgttcttgtcctcgtgggttctctcgaagggatcaaattcgagttccaagaggttcttatgggtggagctgcattggatgccaccggagtccctttacccgatgataccctttctgccgctaagcaatctcatgccgttctgcttggtgctgttggaggttataaatgggataagaacgagaaacatctcaagcctgagactggcttgcttcagatacgtaaagagcttggagtatttgcaaatcttagaccagctaccgtgtactctccgttagtggatgcttcaactttgaagagagaggttgctgaaggggtcgatatcatgcttataagggaactcactggaggtatctattttggagaacccaggggctttggcaccaatgaaaatggtgaagagattggctttaatactgagatttacgctacacatgagatagatcgcatagctcactttgcatttaaggttgctcagaagcgttgtgggaaactttgctctgttgacaaagccaatgtactagaggcatcaatgttatggagaaagagatttttggcaatagcgcaagaatatcctgatgttgagctctcacatatgtatgtcgataatgcttcaatgcaactaattcgcgatccaaaacagtttgacaccatggtgacaaacaacatttttggcgatatattatcagatgaggcttcaatggtcactggaagtattgggatgcttccttctgctagcctaggggcttcgggacctggactttttgaacccatacatggttctgcacctgatattgccggacaggacaaggcaaatccatttgctactgttcttagtgctgctatgcttttgaggtatggcctaggagaagaaaaggcagctaaaagaatagagaatgcagtggtggacactttgaacaggggatttcgaactggtgacatatattctgcaggaacaaagctggtaggatgcaaacagttaggtgaagagatactgaagtcagttgaatctaacgttcatgctggtgctgctacagtgtgatctcgagaccaactcgccatagaactttggattctggtttttatcctagagatcactacgactgccaaagctgagaaaatctccctaatttggctcccttcgtgtttccactttcttcttttactaattttactggctaagacaagcattttttttaaataccttttagtatatctggattaatattttaaaagtattgaaaattgtagttggccgttaaacaaggttaagtgaggtaccacggcgattcaataagggtgggagaaaactctctcattcaaatgaggactttgcctatacatgataagcacaaacaccaagcaaaaaggttttttctagtaatgacaatgaaattgagaatcc

SEQ ID NO: 106 - DNA, 2304 bp, Glycine max
attcatatttacatttcgtcaaacttagccttcttgtttcatctaaaagagtagcaaccatgtggtctgcagtaacagatcccattagagctttttttgcaaattttctccgccatttcatccacaaagacttccatgaagcagtggccagaatgaccataatagatgctttcctcttcgttattgtgcactccattgataagttggggatatggccacgcttgccggttttcttagggctattgtacctggcgattcggcggcggcttcatcaggagtacaacctcttcaacgttggaacaacaccggtgggggttaggtttaaccattctgattttccatacagaacagctgatggaaaatataatgaccctttcaacgaagttgctggcagccatgggactttctttggcagaaatattctccctgtggatcagaaaaaaaagctattgaaacctgatccaatggtggtagccacgaaactacttgctaggaggacatacaaggatactggaaagcaatttaatgtgatagcagcttcttggattcaatttatgattcatgattggatcgatcatcttgaggacacaaaccagattgaactcatcgcaccaagagaagttgcaaggcaatgccctctcaaatctttcaaattctacaagacaaaggaaattcccactggcttctttgagattaaatccggatcatcaaacatccgtacaccttggtgggatgcaagcgcagtatatggaagcaatggagaagttttacagagagtgagaactttcaaagatggaaagataaagatatcaaaggatggccaccttcttcataatgaaaatggaacagcaattgcaggtgacatccgcaatagttgggctggtgtttcaaccttgcaggcccttttcattcaagaacacaatgcagtttgtgacaatctcaagaaacattatcctcaattgggagatgaagaactttatcgccatgccagattggtgacctcagctgtgattgcaaaggttcataccattgattggactgtagagctccttaaaactgatactttacttgcaggcatgcgtgccaattggtatggattattagggaagaaatttaaggatacatttgggcatgttggtggagtcatcttgggaggattagtgggtcttaagagaccagaaaatcatggtgtcacatactctctaacagaggaatttgtgactgtttatagaatgcactcactcctacctgataacctacagctaagagacatatccgctactccaggacccaacaaatctcctccattagtcaaagaaattcctatgaagaatttgattggactgcaaggagaaaaaacattatctgaaataggagttgcaaggcaacttgtgtcaatgggtcaccaagcttgtggggcattagagctttggaactacccagagtggctcagagacctcgtaccacaaaacatagatggcacagataggcctgatcatgtggatctagctgctcttgaaatttatagagatagagagaggagtgtggctagatacaaccaattcaggagggcattactgttgatacctatctccaagtgggaagatttaacagatgacaaggaagcaattcaagtattggaagaggtatacggtgatgatgttgaagagcttgatgtactggtaggcctcatggcggaaaagaaaataaagggttttgcaatcagtgagacagcttttgttatattcctactcatggcaaccaggaggttagaagctgacaggttcttcacaagcaactttaatgaagagacatataccaagaaaggactggaatgggtgaatacaactgagagcctaaaggatgttattgatcgtcactatcctgaaatgtcacacaagtggttaaactcttctagtgctttctctgtttgggactcaccaccaaactctcaaaatcatatacctctctatcttcgtgttcctcactaatttgtttgccctcacaatatctctttgccattaatgcctttaatttaatcattgggtctattttgggtgtttgtatttcggtttatatccttttgttgtatttgagttaactcgtgtatactttatcttatctctatcccaaaattcagcccacttaggtgcttgtatttagtcttcttaaacaatattttgatgcatttgagtttatggatgaataatagtctgtttgtatcttgatgtattcaacaacaaaaaaatgtatttagttaattgtttttttttaagtatgtacatgttgcataattttacaatt

SEQ ID NO: 107 - DNA, 1569 bp, Glycine max
aaccctagttaaaatgaagaagcagagagtatgtagggtttaagatcgcgttccgaaactctggcgaagtttctccattaattcttcttgtgcgtttctcccacactttagatgtgaagatgaaggagttatctcagacccagagtgttgttgtccatgggattgctggtgctggttcagtggctttagccactgccttcacttatcctctcgacagcatcaaagtcctcattcaggttggttccagcaccggtaaagaattggaccctgcccaggctttgacgagactactctctgtgtccggcaatgcaggtttgtttaatggttttggctggttgttggctggaaggatttttggtctgggagcacgatttggggtttacgaaatcctgactgccttttataaagatggtcgggaaaataattatttgtttgcttctgaggctcttttggctggcgtggtagctggtgccgttgaggcagtcataagctctccattcgaactcatcaagcttcgtatgcaagttactgctgcttcatatgttccaagctccaactttgctttggaaaagggggctcgttcacctttaattgcaagattacttcatggccgttatccagacaagagggcattggacctatatgttggtctcatctccatcctaaaaaccaaaaatacaaacgtgaccagtgccttgctagagtatccatggacaatgacaggatctgggaggccaccatcagtttccaatgtcaggagaccatctgacattatatctttggaaggatggaggacattttggagaggactccgtcctggaattgtccgagattctgtgtttagcggcatatttttttcgacctggcaatttctgcaccaagcaatgctagattggaaggctgtagggatggatcctccacccaggttaaatgaagaagtcggtccattgtctcctttgattgttagtcttactgctggattctcagcttcagttgctgctactgcttcacatagttttgatactacaagaagtagatcacaatgtactgtgctgccgaagtacatctccatggagagaaagattctgaagtggaaacgaccaggaaccaagtttgaaagaattactggcatccatccttctgacagaggtgtcttgttccgtggtattggttggcgaatggctcgctctgggctggcatcattcattattgtaggaagttatttatttgttgctgatcagcttggttctagtttgacttaattaccacatattcataccccgattttggttaataagtaattgtaatgtttaatatatttttttctggagaagtcatgtaatttgggatgctgctctgtgctagttagtaaagaaaaatagagcggagacagtacttgatgtacccggattgtagtccagatagaaaaagataatttgttcaatacatataaatgatccttgatgtggggattcacaatgggaatttgattttttaattctcttgtacaagagtttgtaccttccaatgactggtaattaaataagaatatacattttctgcttgttc

SEQ ID NO: 108 - DNA, 2397 bp, Glycine max
aacaaacaaatgagaaggtgtgaactggctactggctgtcatcccttcattcatcttcttccagtgtctgtctacactacggatagagcttttttcacaccacagctaaaagtgctggaatagagcccttccccttcttcttcttctcctccaaatcctccttctttttctcttctctctaccacacaaaaacccttaccaagttctttctttctaattcccttgataatgtaaaatcacagaaaaagaaaaagctactaaaaacttggctctaaacctttctttttttgaggaaaacctgaaaagttccacacaatgtcttcttcttcttcttctagagctttcttcttcttcttcttctttcttatcaacgtctccttgctcctcacactctcttctgcagcggatccattcgtttcctacgaatttgaggtctcttacatcactgcctcccctcttggagttcctcagcaggtcattgccatcaacaacaagttcccaggtcctactatcaatgttaccacaaacaacaacgttgctgtcaatgttcggaacaagttggacgagagcctcctcattcattggtctgggattcagcaaaggaggacttcgtggcaagatggtgttcttggcacaaactgtcctattcctgcaaagtggaactggacttaccagtttcaggtgaaggatcaaattggaagctttttctacttcccttcccttcatcttcagagagctgctggtggatttgggggtttcatcataaacaacagacccatcattccgattccttttgataccccacatggggacattgttgttttcattggagattggtacacccgcaatcatacggatttgaggaaggctcttgatgatggaaaagatcttggcatgccggatggtgttctcatcaacgggaaaggtccttaccgatataatgacacccttgttcctgatggcattgattatgaaacaattgaagttcatcctggaaaaacttaccgacttcgtgtacataatgttggagtatcaacaagtctgaatttcaggatccagagtcacaacttacttctagcagagacagaagggtcttacacagtgcaacagaactacactagcttagatattcatgttggacaatcttattcttttctgttaagcacagatcaaaatgcaagtacagattactacattgtagcaagtgccaggtttgtgaatgaatcacgttggcaaagagttactggagttgctatcttgcgctatacaaattccaaggggaaggcccgtggtcctctcccaccgggtcctgatgatcaatttgacaaaacttactcaatgaaccaagcaagatccatcagatggaatgtatcagcaagtggtgctcgtcctaacccacaagggtctttcagatatggttccatcaatgtgactgatatttatgtattaaaaaataagccactggagaaaattaatgggaagcagcgagcaacactcagtggaaactcttttgtcaatccttccactccaatcaggcttgctgaccagtacaaactaaagggagtatacaagcttgatttccccaccaagcctcttaccggatcacctcgcacagaaacatcaatcattaatggaacttataggggatttatggaagttatactgcagaacaatgatactaagatgcatacttatcacatgagtggatatgcattttttgtagtcgggatggattttggtgattggtctgagaatagcaggggtacatataacaagtgggatggaatagctcgcactacagcacaggtctatcccggagcatggacagcaattttggtttcccttgacaacgtaggagtttggaatctcagaacagaaaaccttgattcatggtatcttggtcaagaaacatatgtcagggttgtcaacccagaggtcaataacaaaactgagcttcccattccagacaatgcccttttctgtggtgcccttagcaaattgcaaaagcctcaaaaggtttcgtcagatgcaccatcaatcactgggaacaaactgaagctgctcttcacttggctcgttgtatgggcatggatccacattttccagtaaaaagcacattttgggtcatctactcttagttgcttgccggtggacttttggcttgttggtgaggttttgtgattgagttattagttttgtaagtcttgtttataaattattgatcttttgcagtgattttgacttgtattcttcttcctattagctttatgcttgtggttccatgtttaatttattgggacttgtgattcttttaatgcctataattgatgtagtaatcacaatttaatcatactcttgatacatgtaactttacctgccgactcctactttcatctt

SEQ ID NO: 109 - DNA, 1150 bp, Glycine max
ctagtaaatttcgcgaaaaagacaaaggggtttgtatgtgaatctgatcatctagagttgagaatggaaggagggaaacgaggcacgattctggtcaccaacgacgacggaatcgatgctcctggcttaagggcattggttcactccatcgtcaacgccaaccttttcaacgttctagtgtgcgctcctgatagcgagaaatcagctgttagccacagcatcacttggctccatccagtagctgttaagcaagtacagatcgagggaaccaccgcatttgccgtttctgggactcccgctgattgtgcttctctagggatttccaaagctctctttcccacagtacctgatctggtggtcagtggcataaacaagggtagcaactgcggttatcacattgtttactctggcactgtagctggagctcgagaggccttcttcaatgatataccttctatctccatttcatatgactgggttaaaggaaagagtaacctacatgacttcacccttgctgctcaagtatgcatacctatcataagtgctgtgctggttgaaacaaagcatccaagttaccctagaaaatgttttttgaatatagacgtgccaaacaatgttcctaaccataagggttacaagctaactaagcagggtaaaagtatcatcaagattggatggaggcaagccacatctgagacagaaggaccaaaaatgtcatctgatatgaccaatacagatacagaaacatcaaagaattttgactcatcatctgtatcaccagaacatcttttgtttgcgagagaggtaaaaggttccgtacttgatggagatgatacggactacagatgtttgcaggaaggatatattactgttactcctcttgctggtctttctcatgcggaggtagattgtcaggcctattttaagaattggctacaaagtgtccctgaactcccctcgtcatcatctttataatacgtaagtcctatcacgtatttgtagtttatataacagccttgattgcaattcaccactggcagtatttggttttacaattatagcattcttgctagttaagaatgattattcttctgagatgaatggaaaatttatgaaaattttaatataatgtttttaattgacaccacta

SEQ ID NO: 110 - DNA, 1042 bp, Glycine max
tatagaacagaggcgtcccacgccgtcttacgtcgctttcaccgattccgagcctttgatcggtgatgtcgccatgaatcccactaacatcgtcttcgtgaggaaattccagctccaatctcttccaatcccttccacgcgtaatcacttgcgtgcaaactgaatttgttgatattggacagttccctcacgtagcaattttgaagatgtaagtgtagctctgactgatatcttgaagctacctctgatggataaaagcaatggctgcagcttctctagcatatcttcaattgctgtcttttcaagtgctgtttttgttgtctccttgattttggttcgtctcctttatgtcttatactgtagcagcaagcccttgagcaaaagggcttcaaaaccttttagtacccttattattttaggatcaggtggtcatactgctgagatgcttaatctactggcagtgttacagaaaggtaggtttaatccaagattctacattgctgctgctactgataatatgagtcttcaaaaagctcagttgttggagaattccctggctgctgagaatgcaacaagggtcactgatactgcacagttcatgaagatatatcggagtagagaagttggtcaatcatatataacctccgtttggactacttttgttgcaatggtgcatgcgctatggctaatgattaaaattagacctgaagtgatactttgcaatggacctggaacttgcattcccctctgtgctattgcatttatatttaaggtactgggaatcagatggtcattaattttctacgttgagagtatcgcaagagtgagaaggctctccttgagaggcctgctcctgtacaagttgcggatggctgataaactttttgttcagtggccacagctgcaacgacagtatccccgagctacctatgctggtcgactcatgtaaccaattggttcctttaatatcattaagcaaaagctgcattccatggttcatggttgtattgattattatatttaagttctccctgcatttatt

SEQ ID NO: 111 - DNA, 792 bp, Solanum lycopersicum
atttgtaatggcagcacttaaacttatcctgctagcagctttcctttttctgttcaatttcactgcaaattcaacggcactccccacaagttttatcaaaacttcatgcaaaatcaccacatatccacaagtatgcgttacttcgttatcagtttacgcaccaaccatcaaacgtagcccgcagcagctggcgcaaacagccttgtcagtaagtctggacagggcacaatccgctcacactttcatcaccaaactgaacaaatttaaaggtttgaaatcaagagaatacgcggctctaaaagattgtttggaggaaatgagtgagacagttgatcggatcaataaatctgttaaagaacttacacggatggggagttcacgtgggaaggatgttcagtggcatatgagtaatattcagacatggatgagtgcggctattacaaatgaaaatagttgtgcagatgggtttgctggaagggctttgaatggtaggattaagagttcgattagagccagggtgactcatgtaactcaggttacgagcaatgctttggccttaattaaccaatttcctgcaaaacattaagacctataaatagtttaattttatgttttcacattttgagtaatattcacttttttttttttttgtgtgtgtgtaagttttggtttgatgggaactatatatataaaagcgagaatgaaattttattcgtgtaaaatggagaactaaaggattatgatgtggatgctttaatctctgtctccctaaataggcaaattaaatgtatg

SEQ ID NO: 112 - DNA, 2281 bp, Solanum lycopersicum
gaacgccttctttctctctcttcctcctcactttctcactctactttgctttctccgatggcgcacgatagcgatctcccttgtgacggcgatggtgtctgtatggcctgtaaagtgaagccatcggagaacgaatcgctcatctgtaagacttgtgctactccatggcacgtcagctgtctctctactcctcccgattccatgggagacgccgtcaactgggagtgccctgactgctctatgcctcccgccgctgttgttgtgcctgttaaacagaatgctgttgctacttcatcttctgaaggaagaggagatttgattgcggctattcgggtcattgaatctgattcgactcttaccgagcaggaaaaggctcagaaacgacaagaccttatgagcggaagttccaaagacgaagacgtggctgttgaaggggctaatcaggacaaggatgtgctgaatattctcgatggaagtttgaactgctctatgtgcatgcaactgcctgagagacctgttacgacaccttgtggtcataatttttgcctgaagtgctttcaaaagtgggttgggcagcgaaagagtacctgtgctaattgtcgtactcctattccagctaaaatggcaagccagcctcgaattaactccgctctggtcattgccattagaatggcaagaatgatgcggtctggtgcctctagcgggtcatcaaaagtttcacatttcgttcacaaccaaaacagacctgacaaagctttcaccactgagcgtgcaaaaaagactggaaaggctaatgcttgcagtgggaagatttttgttacaatccctggtgaccattttggaccaattacagcggaaaatgatccagagcgcaacgtgggtgttatggttggtgagacttgggaggatcgttttgagtgtcggcaatggggggctcatttccctcatgtggctggtattgcaggacagtcagattatggggcccagtctgttgcactttctggtggttacgaagatgatgaagatcacggtgaatggtttctctatactggaagtggtggaagagacttgagcggtaataagcgaacaaacaagctacaatcgtttgaccagaaatttgaaaagcttaatgaagctttacgtgtcagctgcctcaagggttatcctgtccgagttgtgaggtcccacaaggagaaacgctcttcgtatgcaccagacaaaggagtacgatacgacggggtctacaggattgaaaagtgttggcggaaaccgggaaaacaaggattcaaagtttgtcgatacctttttgtgcgctgtgataatgatcctgcaccatggaccagtgatgaacaaggtgaccgtcctagggccttaccttccatcaaagaactaaaaggcgccacagatatgactgagagaaaaggatctccagcctgggattatgatgaggaaaagagttgctggatgtggaaaaaggctcctcctcctagtaggaaaccagttcaatgtgaaaatgaagatggaacaaaagtgagaccagtcagaccaaagagacttacaatgtctgtaaagcagaggctcttgaaagagtttacatgtcatctttgtcaggaagtgatgaataacccgcttactactccatgcgcgcataacttctgcaaggcatgtttggatggtgcctttgcaggtcaatcctttacaagacagaggacgtgtgaaggcagacgtacattacgagcgcagaaaaatataatgaaatgcccatcatgcccaactgatatatctgatttcctccagaatccccagattaatagagagttgatgaatgtaatcgaatctctgaagcgccaaattgaggaagaaaatgcagcattgagtgctgatgtagatgatggcagcttagatggaaatgagattctagctgaaacagataaaagcatggaggatgatgaagaaggtgcacagcctgtcaatgagactgaagccaagcagactaacaagaggaagagatctggcagcattgacaatgcatcatcacccaagaaatccattgacaaatctgatgctgtgcataatcttgaggaagttgatcctgcccatacctgaagaagcaaaatggtggcaactgttggctctcatgtttattgttggatagttttaggttaattttagttttggacttgtatgaacttggtacattagtcaaaattccaattgcatagaattttgcttttatgtcaaccaattggtgttctatcgtaatctttttggatagtagatt

SEQ ID NO: 113 - DNA, 694 bp, Solanum lycopersicum
acctttgtgactctattctgccatatctctgttacttccgggtgatctaagtttctttaattgccacaagttttgcagcaaatctggtatatacgcaacaactgctattgaagctaaaattaaggttgtggctgcagtagacttgcctcagagagttttggtttcgttataattgtcactagtgccccaaatatgtgtttggtgtttgtatgtgatgaagatgagagggtgttacaaagacaggcagctccaggagcttgtccttactgcggagggatggttcaagccgtggacatggagagtcagtggagattctgctttgtcccttattatttcaagactaaacgcagatactactgtaccctttgcaccagacgtctcatcatccaataattttacctaatcttatgatatagcctctttgtggtccttgaactttctagaaaacaaagatgtatgatcttttggcttttcaggtgtaaagggtgtgtatgtgttattgttatctgagttttatatgttggtttaccatttctctttaattatttgttggttatctatagataactactctgttctggttccaaaatcatatggttagaagttagaattacaaaataaggaaaaaggaaaatgtacaaatttacctgtgatatttgggatttgtcttgcattttccctttgtttacctttc

SEQ ID NO: 114 - DNA, 1187 bp, Sorghum bicolor
actccgtccggtgctgctgctgctgctgccgcctgctggtgccttgagcagtgcgatcgggtcggatccgtagggtgttggcgggtgcaggtggtggctggttgccgatcgatcgagaccggtgaggatgttggcggtgttcagcggcgaggtggtggaggtgccggcggagctggtggcggcggggagccggacgccgtcgcccaagacgaaggcgtccgagctcgtcgccaggttcctggggacctgcccttccgccgccgtgtccgtgcgcctcgccgccgacctcggacacctcgcctactccaacgccaaccaggccctcctccgcccaaggtcgttcgcggcgaaagacgaggtgttctgcctgttcgagggggtgctggacaacctggggcggctgagccagcagtacgggctgtccaagggcgccaacgaggtgctcctcgtcatcgaggcctacaagacgctccgcgacagggcgccatacccggccagcttcatgctctcgcagctcgccggcacctacgccttcgtgctcttcgacaagtccaccaactccctgctcgtcgcctctgacccggagggcaaggtgcccctcttctggggcatcactgctgatggctgcgtcgccttctctgatgacattgacatgctcaaaggatcgtgtggcaaatcgcttgcgcctttcccacaaggttgcttctactctaatgctcttggaggattgaagtgctacgagaaccccaagaacaaggtgactgctgttcctgcagatgaagaagaagtctgtggtgcaaccttccaggtggaagggtctacagtgcttgcagcgctgcattaggagatcatcacatctccgtctccaggcgtggacggccgggggaggacaatgcaaagctctgtacatggagccatggtggtgtaatgtaacataacggcaaggcatgcaactgatgctgatctatctgtatcatctccctcccataaaagagaagtgcgtactgccggcatgcatggtcaggacttctgtgctagctgttggttgttgtgtgtgcatctgtatccctagtttgttcgacttacatggaacaacctgagagcttagctgagaccaggtgctgagcatagctgcatgcatggatgaagtgctgtaatctgtactgataacgaagctttgtttctcc

SEQ ID NO: 115 - DNA, 1674 bp, Arabidopsis thaliana
tgtttggtgaaatcaataacgtctttggctttaaacctttgtgactttgtgtacaaattccggagtgtctctctcccaaatcagcatcgcagattcgatttctcatcctaagagagctgaaaaatggaggttggattcaaggcattgctcgatgatcttgacgttctcgagaaatctctctcagatccggctctgatcaacaagctgcgatcacatgttgagaatctagccactctgtctaaatgtaatcctcaccggcgttccaaagtcaaggaactaagctcggaagtggtagatagtaatccttacagtaggcttatggcacttcagcggatgggcattgtggacaactatgagagaattagagagttttccgtcgccattgttggaattggtggtgttggaagtgttgcggctgagatgcttaccagatgtggtattggtcgtcttttgttgtatgactatgacactgtcgaactagctaacatgaacagactgttttttagaccggaccaggttggtatgacaaagactgatgctgctgtccaaacccttgcagaaataaaccctgacgtagttcttgaaagtttcacaatgaacataacaacagtgcaaggctttgaaaccttcacgtccagcttgacaaacaagtcattttgtcctagcaaagagggcggcagtggtgtggatcttgttttgagttgtgtcgataactatgaagcaaggatggctgtcaaccaggcatgcaatgagttacgtcaaacatggatggagtcaggtgtatccgaagatgctgtttcaggtcacatacagctcttggttcccggagaaactgcttgttttgcttgtgcacctcccctgtggaatatgggtggttttaaggattctgtgatccagggtattgtcgtggcatctggaattgatgaacggacacttaaacgggaaggggtctgtgctgcatctctgccaactactatgggtgttgttgcggggcttttggttcaaaactctctcaagttcttactaaattttggtgaagtttctccatacttgggttataattcactgaaggattttttcccaaccatgaaaatgagaccaaatccacaatgctcgaatgtagcttgtctagagcggcagaaagaatatatgcttgcaaaaccagaaagggatgctgctgctaaagctaagatggaagctgatgcatccacaactatcgatgaaggtccactccatgatgataatgagtggaacataagtgttgtcgatgatgaaaatgagaaggatactacaaaagctgcctcaagttcagatacattacccgaagggcttactcgggagcttccagttgcagatgagtatgagaaagcaatagccatagcctcagggtcaggagaaacagaggaggaagatgaccttgaagatctgaagaaacagctcgaagctctcaacgctgcttgagtctttatgagggagaaaaaatagttgttttagcatatttatacatgaaagaggctacaagtgcaattgtgtatgcaaaaagagtgtgttaggattggtaaattggatctcatggacatataaacgtttttgatgatgacttctcccgtttttttagttgttaccaaagacaaaaagatacaattttgaagatgtttcatggatttattgtca

SEQ ID NO: 116 - DNA, 3318 bp, Arabidopsis thaliana
ctcctttcccagatctagagattgtacttagctcttcttctctcttcttcttctcattctcttcgcttgtaaccacagaactttgcagtggtcttgttccactaatattagcctcgtttttgcttactaaaagtttatctctattctcatcaccatggggagttgtttttctcttcaagttagtgatcaaacactgaatcgtatctttaattgcttaattggtaaaagttatattcgaaccctcgagaagaatctcagagctctgcagagggaaatggaagatctcagagcaattcaacatgaggtacaaaacaaggtagctagagacgaggcacgccatcaacgaaggcttgaagctgtccaggtatggcttgaccgtgtcaatagcgttgatatagagtgcaaagatctgctaagtgttactcctgttgagcttcaaaagttgtgtctatgcggtttgtgttcaaaatatgtatgttcaagctacaaatatgggaaaaaggtattcttgttactggaagaggttaagaaactaaactcggagggaaattttgacgaggtttctcagccgcctccaaggtctgaagttgaagagaggcctactcagcctacgattggtcaggaagacatgctcgaaaaggcatggaaccgccttatggaagatggagtcggaatcatgggtctgcacggtatgggtggtgtaggcaaaacaacccttttcaagaaaatccacaacaagttcgctgaaataggtggtacgtttgacattgtgatctggatcgtggtgtctaaaggcgtaatgatttcaaagcttcaagaagatattgcagagaaactacacctttgtgacgacctgtggaagaacaagaatgaaagtgataaggccactgatatacacagagttttaaagggcaagagatttgttttgatgctagatgatatatgggagaaagtggatttagaggccattggtattccctatccgagtgaagtaaataaatgcaaagtagcattcacgacacgttctcgggaagtttgtggggagatgggggatcataagccgatgcaagtcaactgtttggaaccagaggatgcatgggagctgttcaaaaacaaggtcggagacaacacattaagtagtgatcctgttattgtggagttggcaagagaggtcgctcaaaaatgtcgtggtctgccattggcgctcaacgtcattggtgagacaatgtcatctaaaactatggtacaagaatgggagcatgcaatccatgtttttaatacatccgctgcagagttttctgacatgcaaaacaaaattcttccgattctcaagtacagctacgatagcttgggggatgaacatatcaagtcgtgtttcctatattgtgctctgtttcctgaagatggtgagatatataacgaaaagttgatagactactggatatgcgaaggattcatcggagaagaccaagttataaaaagagcgaggaataagggttatgcgatgctcggtacccttacccgtgcaaatttgctaacaaaggttggtacatattattgtgtgatgcatgacgtggttcgtgaaatggctttatggattgcttccgattttgggaaacagaaagagaattttgttgtgcaagcaggagtcgggttacatgaaataccaaaagtcaaggattggggagctgtaagaaagatgtcattaatggataatgatattgaagagataacatgcgagtccaagtgttctgaacttacaactttgttccttcaaagtaataaattgaagaatctaccaggtgcattcattcggtatatgcaaaagctagttgttttggatctttcatataatcgtgacttcaataaacttccagagcagatatcggggctggtctcgttgcagtttcttgacttgtcgaatacaagtatagagcacatgcctattggtctcaaagagttgaaaaagctaactttcctggatttgacttatactgatcgactttgtagtatcagtgggatatcaaggttgttgagtttaagattgttgagactgctagggtctaaagttcatggagatgctagcgtattgaaggagctgcagcaattgcagaatctacaagagctagccataactgtatccgcggagttaattagtttggatcaaaggttggcgaagttaatctctaatctttgtattgaagggtttcttcaaaagccattcgatttatcattcttggcgagtatggagaatcttagttccctacgggtggaaaatagttatttctcggagataaagtgcagagaaagcgagacagaatcgtcttatttacgcatcaatccgaaaattccatgctttaccaacctctcacgactggagataatgaagtgccatagcatgaaggatctgacttggatattgtttgctccaaatcttgtcgtgctactcattgaagattcaagagaagtgggagaaataataaacaaagagaaagcaaccaatcttacaagtattacaccatttctgaaactagaatggttgattttgtataatttgccgaagctggagagtatctactggagtcctctcccctttccggttttgttgaccatggatgtttcaaactgtccaaagctgagaaagcttccattaaatgctacaagtgtttcaaaagttgaagaatttgaaatacatatgtatcctcctccagaacaggaaaatgagcttgaatgggaggacgatgataccaaaaatcgattcttgccttcaatcaaaccggtaatcatttcttttaatctcttatgcttgagttatttgtatttcttgctaatgtttctttcaaggttagcatgagatattgtccttctgcaaaatggatcacacaatagaatatactgtgcctctcaatttcaatgcattgttactaacattgtttcattttcttcttctttagtacaagtacttcgtctacccaggaatgagtttcctcactgtctaaaatcagaattcacgcttcttcttcttctattgctttatctatcttcttgtagtgctgcatttggattgtataattgatttgcattctgatacttctggaatgtgttgttgtgttgttcacttggattatgtttttcattttccttttgtattccctaaaacgttttgcatcctgttcaaactacatttttacacaatcaaaagtttatgcgtttaggtaaaatccatttgttggtttctctttcaccttgcagtgtctttcttcatctgttggtttctttttcatgttccagttgttaatgaaaagatttgattttggt

SEQ ID NO: 117 - DNA, 2418 bp, Arabidopsis thaliana
taatcatctctctccttttttcaaacatacacagagaatggtggattcgaaaacccctgcgaaaaccaaattgttagattcgtcttcgatttctaatgtcagagtcgtccttagggttcgtccttttcttccccgggagatttcggacgagagttgtgacgggagatcgtgcgtttccgtaatcggcggcgatggaggagataccagcgaagtggcggtttacctcaaagatccagatagctgtcgtaacgaaagctatcagctggatgcgttttacgggagagaggatgataatgtgaagcatatattcgatagagaagtaagccctttgattcctgggatctttcatggtttcaatgctactgtgcttgcttatggagccaccggaagcggaaagacttttacgatgcagggaatcgatgagctaccaggtctgatgccattgaccatgtccaccattctgtctatgtgcgagaagacaaggagtagggctgagatttcatattatgaagtttacatggacagatgttgggatcttctagaagttaaagacaacgagattgctgtttgggatgataaagatggacaagttcatcttaagggactttctagtgtccctgttaagtccatgtctgagtttcaagaggcgtatttgtgtggcgttcagaggaggaaagttgcacacactggtttaaatgatgtctctagtagaagccatggagtgcttgtgatctcagtaacctcacaagggcttgtcactggtaaaatcaatctgattgatcttgcaggtaacgaagacaatagaaggacaggcaatgaagggatccgtttacaagagagtgccaagattaatcagtcattatttgcattgtccaatgtggtttatgcactgaataataacctccctagagtgccatacagggaaaccaaattgactagaatactgcaggattcacttggtggaacaagtagggctctcatggtcgcatgtctgaatcctggagaataccaagaatctcttcgcaccgttagcctggctgcaaggtcaaggcacatctcaaacaatgtttctctgaatcccaaggtagagacccccaaggttaagatagacatggaagcaaaactgcaagcttggcttgaatcaaaaggcaagatgaagagcgcgcatagaatgatggcaatacggtctccattgatgggtacaaaccagacttcaatttctcaaagctcagtcaagaaattactctgtcatagatcagccattgcagaaagtgctaagcttgccggcacaggacagagggacgcatttgtgaccgcaagaaacttatttggtgtggaaactcttgctgcttcacatttatgggaacctatacggaatctgcagttagcttctccaaccaaagaagatgagagagacacatctggcgaagagaatctattggtatcagaagcaagcttgagagataacacattggatgtcgagaagaaatatactgaactgagtcctcttcgagaagctctatctccaatagactccaatgcaaaaccaaattcagcacacggaagctctccttttctgaagccaatgaccccaaaaacaccttttctttctacaaaccctgaaattatgcagatggaaggcacttgccagaagttcaatgcatggagcaataatttaaagacctctctcataaaagagtacattcacttcttgaacacagccaacagagaggagctaagggaattaaagggaattgggcagaagatggctgagtacatcattgaactcagagaaacaagccctttaaaatcgcttaccgacttagaaaagatcggtttcacctcaagacaggtacataacctattcaaaaaagccactgaaggagtcctcgagaagccagtttctgcttcaacaacaccttagttgttgtctctagcaaacaacaacacttgtgtattatatcagttctatctcgtgtaatttcattattgtctgttcttgtatgtttaagctttataaccagagagacaatgggcttgaatcttaattgtgtagtgagcaagaaagaagcaaactttaatacaaacccataatagtcttaggattaataaagtcacaaagataaaactttgcagagatatcttaatgaccaaaccataaaaacacacacagaagaagagaaagaccaacgtcgccggcaaaactaccggaaaaatcagccaattattacatataagcaaacctaacataacattagggttattacagacttagggtttatgaagttcttcatttgcaggcagatccacaaccacagcttccaccacagcaagacatgttttttctagaaaattggaagagatctgagaagatttatgaagatgatcttaatttgccttaaacgataatcagtgaat

SEQ ID NO: 118 - DNA, 2685 bp, Arabidopsis thaliana
tcataaatcctgtcagaagtaccggagcgagcctgactggagaaatcgagaatggaggacggcgaaatagaggaaggaatggtaactgccgacgaattcccgacgccggaagtaactaccatagagactatacaacctccccgagagccaggaaaatctccactcgagctacttcgagagagcaaaacctccgtagaagaaatcgtcgcgaagatgctctccatgaaaaaacaaggaaaccacaaatctgagattcgagaactcctcactcaaatgttcctcaacttcgtcaatcttcgtcaggcgaatcgggcgattttgactgaggaagataaagtgaaagcggagacggaaagagcaaaggcacctgttgatttcacgacattgcaattgcataatcttatgtatgagaagagccattacgttaaagctatcaaggcttgtagagatttcaaatctaagtatcctgatattgaccttgttcctgaacaagacttctttcgtcatgctcctgaagctatcaaagatcaatcgctttcaagtgatagttctcatgttttgatgcctaagagactcaattttgagcttcatcagaggaaagaattgtgtaagcatcgagcgagattggagcaacagaagaagagtttattagaaaccattgcggagcgtaagaagtttttgtcgagtcttcctctacaccttaagtctctgaagaaagcatcgcttccagtacagaaccacttgggtatacagcacacaaagaaactgaagcagcataatttagctgagctgcttcctcctccgctttatgttctatactcacagctcttggcacaaaaggaagcttttgaggagagtattgaattggaggtagttgggagtcttaaggatgctcaagcttatgctagacaacaatccagaaaggactcaggtatgtcgagtaatacagagagttctaggttggaggatgatggacctgatgacgatgatgatggacaaaggagaagaaaacgacccaagaaacttactagcaaagaaggttctgacaaggcaggattatatcaagtccaccctctcaaaattgtccttcacatatatgatgatgagataccagatacaaaatccttgaaacttgtcattctcaagtttgagtacttgctgaagttgaatgttgtatgtgttggcgctgaaggctctcaggatggaccagaaaaaaacatattttgtaacttgtttccagatgacgctggacttgagcctcctcatcagtcaaccaagctcatccttggtgatggtcagacgtttgatgagaacagaacttcaaggccttataaatgggtacaacatttggcgggaattgatatttcaccggttttattaggccaagaagctcataacactgacccagctaaaagtgatacgtttgtgcctgatctttcattgtatcgccagcagcatagagtgcaaacagttctgcgaagaatacgcttgcggaaaaaagcgcatctggctcttgcggaacagcttgatttgcttatgaaacatgagttaccagtggtgaactgcgaagatgctccttgggcactgcataaggttctctgtgctttggattcctggttacatatacaatcttcagctagtaagtcatgctctctgactctgaacagtgtggaacaagttccagaacctatggaaatcgatgtagatggaagatctatttctggaaaagaagattttgaaagtatacgggaagatggagaacttccctctttggtcacggcggctgcttcgttaaccagttccaatcataccccatcgaaagtatctaatcaagcacggtcaaggcagttggccttgatgacaaagaatctagattctccgattagcaaaggaaagtccccaagtttcaagaaatacgaagatgatttggatcttgttctggacgatgatagtgaaatagatgagccaaccggaagaactgaggcgcatgtggaagagttatgccctgagaaagctgataattcatgggtggattatggttcgagagagtttgcgcttgtgttctccaggaaaacagatggcggaaagttgtggaagttagaagcaatggtacaaattagcatggagtatcctcttcgacctcctttgttttctctgtctctccacgcatcttcttcatcaggaaatgaaaatgggacaaatgaaagtgaccattacaatgaacttcgagcaatggaagcagaagtgaaccttcatatgttgaagattattccttcagatcaagaaaactatctcctatctcatcaaatcagatgcttagcaatgttgttcgactattacgtggatgacccatctccagattccaaaagaggaacagccacaactgtggttgatgtcggtttgtgcaagcctgttgacggtaagcttcttgtgagatcattcagaggcagagatcaccggaaaatgatctcatggaagggcagaggatgtgcatcgggttatccatgctagagattacatcgccactcacttctctatattatctttctctggtggtacaagcaaaagtttttgcatgtaacatttttttatcgtataaaccgttattgaaacagcctacttgttgggtgaggacctggtctgttttaaacctggcaatgtttcaagtccaatccgttttagcct

SEQ ID NO: 119 - DNA, 1318 bp, Solanum lycopersicum
ataatttaagaggcagaaaaactcatctttttttcagtgtatagaaacagagaggaaagaaagaaaatccagaagaagaggaagtgctatattgcttcttcttcttcttcttcttgagaaattattctcaaaatgggtgccgaggtgtctaaacaaatcgaaagacgaaaagctatcgatactcagaagaaaaacctgtgtgatctcaaggagaaaaatggatgcaattttcctggctatgattataatgtacaggacagaaaaaattggatgtcaacacttggtcctgaaaagcttcatgtgaatcaaatagtttggccaggtacacatgattctgcaactgatgaaattggaatcccattcatttctcgccctttcggacaatgccaatcattgtctatttatgaacaacttgtacttggtgttcgtgttcttgacattcgtgttcaagaagatcgacatgtatgccatggcatccttctttgctatcacattgatgttgttatcaacgatgttaagaagttcctgtctgaaacacattcagagataataatcctggaaatccgtacagagtttggacatgatgatccacctaatttcgacaagtatttggaggctcagctaggggagtttctcatccaccaacatgacaatgttttcaacaacactgttgcagagttgttgccaaaacgaatcatatgtgtttggaaaccaggaaaatcacctaaacctagacaaggaagtcctttatggaattcgtgttacctaaaagatgactggatagacactgacttaccggaaaagaaattcgaaagcaacatgaagtatttgagtgagcaaccaccaataacatcacggaaattcttttacagggtggagaacacggtgacaccacaggcagataatccagtactgtgggtgaaaccagtgaccgaaaggattcatccgtatgcaaggttgtttataatggaatgtatttctcgaggttatgctgatcgattacaaatattttcatcagacttcatagaggaagattttgtcgatgcgtgcattggtctaacaaacgcaaggatcgaagggaagctctgaatctcaacatgtgtttaccagtataaatatgtgtttcgggaatttcaattatgtacatagtttgatcagaaagcaatgcatccttcttgttgctgaaaaggtaattgttgtgccataggtagctagtttgaatttttagtccttatttaggtgtctgaatgcgtctgcatctactatgtatctgtaactaagaatatgtgaattatcatttgcatgtttgggttttgtg

SEQ ID NO: 120 - DNA, 2097 bp, Solanum lycopersicum
gtgtccaaacccctcaaagcctccaacaacttttgagttttgcagtcagtctatttgttgctctcataaaaatggcgtccatcccttctcctcacactgcccgcctcaattctctcctctcttcttcttccgtcaatcacaacaaaccttcaaatctctctttcctccatgcctcctcaaatccatcttccatcaaactccttcactctgtttcaccatcaatttcttcttcttcgacgacggtgatttgtaatgtcctcaaaactgttgaatctgctgacatctccctctctagagatcttcacggcgttgtatccacttccaaaccaaccattctcgtatccgagaagcttggagaggcgggtctagatttgctcaagagtttcggcaacgtggattgttcttacgacttgtctcctcaggatctctgcgctaagatctctctgtgcgacgcgctcatcgtccgtagtggtaccaaggtgacccgtgacgtgtttgaggctgctcagggaagactcaaggtcgtggggagagctggtgttggtatagacaatgtcgatctgcaagctgcaactgaatttggttgcctcgtcgttaacgcacccacagctaatactattgctgcagctgagcatggaatcgctttgctcacctccatggcccgtaacgttgctcagtctgatgcctccatgaaagctggaaaatggctgcgcagcaagtatgtgggtgtttctcttgttgggaaaacattagctattatgggatttggtaaagttggttccgaggttgctagacgtgcaaaaggcctcggtatgcatgttattgcccatgatccttatgctcctgctgacagagctcgtgctattggagtcgatttggtttcatttgagcaggccatatctactgctgacttcatctcactccacatgcctctcacacctgctacgaacaaggtattcaatgatgacacttttgcaaagatgaagaatggagtcagactaataaacgttgctcgaggaggtgttatcgacgaggatgcattagttagagcccttgacagtggaatagttgctcaggcagcacttgatgtgtttactgtggagcccccaccaaaagatagcaaactagtgcagcatgagaatgttactgttacacctcatcttggagctagcactaaagaagcacaggaaggagttgcaattgaaatagctgaggctgttgttggtgctctaaatggggaactttctgctaccgctgtgaatgctccaatggtccctcctgaggttttgtccgagttggctccttacgtcgtgctcgctgagaaagtgggtagattagcagtacagctagtgactggtggcagtgggattcagagtgtgaaagtggtttacaaatcggctagggaccctgacagcttggacactagacttcttcgagccatggttacaaaaggcattattgagcctatatcggatacaatcatcaaccttgtaaatgcggatttcagtgcaaagcagaagggtcttcgcattagtgaagaaaggattattgttgattcatctccagagtaccctgttgagtcaatccaggtgcagattagtaatgtgcaatcaagatttgcaagtgcgttatcagagaatggaaacattagcattgagggtagagtgaagtatggagttccccatcttacacgtgttggaccatttagcgttgatgtgagcttggagggtaacctcatcctttgcaaacaagtggatcaacctggtatgatagggaaagttgggaacatacttggtgagagtaatgtgaatgtgagttttatgagtgttgggagaacggtgaagggaaagcaggcaattatggcaattggagtagacgaagaaccagacaaggatactcagaagaagattggagaggtgtctgcagttgaagaatttgtcttccttaaactatagtcaatattgctggctaatgggatggaatggaacttgttattacgtattattattaagtaaaagataaaaagggtgtaatgaaattttagctgtgtctgcttaatgtgttgatcaaattaatttacaaggaacacttatcctc

SEQ ID NO: 121 - DNA, 651 bp, Solanum lycopersicum
gttcattagtgaagtgagatacaaccaagcacaagagataaaaaaaaatggctagtatttcaggcaccataattagtacctccttcatgccaagaaaaccagttgtgacgagcttcaaggcatttccagctatccttggggttaaatatgcaaatggtggcaaaataacttgtatggctacatacaaagtgaaacttatcacaccttcaggagctgtagaatttgattgtccagatgatgtgtatattcttgatcaagctgaggaagaaggacatgaaattccttattcatgcagggcaggttcttgctcatcttgtgctggtaaaattgtatctggaagtgttgatcaatctgatggaaactttcttgatgatgaacaaataagtagtggatatgtgttaacttgtgttgcctatccacagtctgatgttaccattgaaactcacaaagaggaagaactcacaagctgaactaaatttggagaaaattttatgtttataatgtgctaaagtttatagtatatgtgagtgtgattttcttccattataatgtgtataattgtctgttttgtagatttgtttgtcgctcgttcgacagaatttggctcggtaaaaagagctcgtttttattaatgttccacaaatgtttttc

SEQ ID NO: 122 - DNA, 612 bp, Brassica juncea
gtgtcttgaaaaatttgtaaagaaacatgactattgctttaacgatcggaggaaacgggttctcgggtctgcccggatcttcgttctcctcagcttcttcatcgcttcgattgaagaacagcagacgaaagaacacgaagatgctgaacaggaaaggagtcgtctgttcttcgtcttctgtaatggatccgtacaagaccctcaggatccgaccagattcgtctgaatacgaggtcaagcaagctttcagacaactcgccaaaaagtatcatccagatgtttgtagaggaagcaactgtggagtacagtttcagacaatcaacgaagcttacgatattgtgttgaagcaaataaagaatcagatggagggaacagaggaatttgagccattcgatgtgtacgacgagggattcaacggaatgaatgatccagattgtgacacgtgggaagagtggatgggatgggaaggtgcaggaaccagagactactcctctcacgtcaatccttacgcttgaagaagcaataagaagtaatgattcgagagtgcgcacataaataaacaactgagacaagagaacgatgtaaatagttgaaattgtctcgtgaaaatgt

SEQ ID NO: 123 - DNA, 1371 bp, Brassica juncea
cctcacgaaccattcacagacactaacataagaccttctcttcagtttgctcagagagtgaactaacaattatggcgaagatgatgatgatgcaacagagccagccttctttatctctccttacttcttctctctctgactttaatggcgccaagctccacttacaagtccagtacaagaggaaggttcaacagccaaaaggagcactctatgtatcagcctccagcgaaaagaagattcttataatgggtggcactcgattcatcggtatcttcttgtccaggctccttgtcaaagaaggacatcaggttacattgttcacaagaggtaaatctcctattgccaaacaactccctggcgaatctgaccaagactttgctgacttttcttccaagattcttcacttgaaaggagacagaaaggactatgactttgtgaagtcaagtctttcagctgaaggctttgatgtagtttatgatatcaacgggagggaggctgaagaagttgagcccatattagatgcacttcctaaactagaacagtacatctactgttcttcagctggtgtttacttgaaatctgatgtcttgccacactgtgaggtggatgcagttgacccaaagagcaggcacaaggggaagctggagactgagagcttactgcaatcaaaaggtgtaaactggacttccatacgccctgtctacatctacggtccgttgaactacaaccctgtggaagaatggttcttccaccgtctcaaagctggccgccctatcccagttccaaactctggaatccagatctcacagctcggtcacgttaaggacttggcaacagcctttctcgccgtgcttggtaacgagaaagccagcagagagatattcaacatctcaggagagaagtacgtcacctttgatggcttagcaagagcttgcgcaaaggctggtgggtttccagagccagagattgttcactacaaccctaaagagtttgactttgggaagaagaaggcgttccctttccgtgaccagcatttctttgcctcggtagagaaagcaaagcatgtgcttggatggaaaccagagttcgatttggtggatggtctcactgactcatacaaccttgacttcggtcgtggaactttcagaaaagaggcggatttcaccactgacgacatgattctaagcaagaaacttgttcttcaatagaaacatattgatttgtatggttgtgtgatctcacactgaagaacattctcaagtttattgtcgtctcaaatgtattttggtttcggattgtgttcgacttcttctaagaagcggcggtctggctcttgaagtttacttagtgaaggagagagagacatagacc

SEQ ID NO: 124 - DNA, 848 bp, Brassica juncea
ataccaactctacagctaagatctacctcaccttttaatagtctttatttcatactttcttccgtattttattcaaacactaaagttttagaaatggcaacagcatcggttaacatgcaatcagtcttcgccggtgggttggccactcgcaagatcaacacaaacaagcttttcttcgccggaaacttcccaaatctcaagaggaactatccggtgggagtgaggtgcatggctgagggagaacccatgaaagatgagtctgcaccttcgacctccgcggctcagcctttgtctagttcatcaccgcccccacctcctccacgtcctactaaaccaaaggtgagcacgaagtttagcgacttgctagcgtttagcggtccagcaccagaaagaataaacgggcgtttagcgatggttggattcgtggcggccttggcggttgaactttccaagggtgaaaacgttttggctcagatctccgacggtggcgtctcgtggttcctcggtacgactgcgatattgactcttgcgtcgcttgtaccccttttcaagggcatcaccgccgagtctaagtccaaaggtttcatgacgtccgacgctgagctttggaacgggcgtttcgcgatgcttggtttggtcgcgttggcgttcactgagtttgtcaagggtgggacccttgtctgaggaaagaaattttcttattggggagaatgttatattacagttttaccccttgtaaagttatctggtatgacatgtgtttaagcctatggtgtgtttctttacatatgcattagtaacatgagactttgtggtaaagcactatatcagtaaaggtagtgatgttt

SEQ ID NO: 125 - DNA, 833 bp, Brassica juncea
caaaagaaacaaaagaatccaaaattttctctccttatagaaagcaagaaacttccaggatctggtgaaaaccatggaagaaggcgactttttcagttgcttcagcgaaattaatagtggcatgactatgaataagaagaagatgaggaagggcactaatcataagaggtttagtgaggaacagatcaagtcacttgaggttatattcgagtccgagacgaggcttgagccgaggaagaaggtgcagttagctcgagagctagggctgcaaccaagacaagtggctatatggtttcagaacaagagggctcgttggaagtctaaacagcttgagaaagagtatgatattcttagagccaattacaataacttggcttcacaatttgaaatcattaagaaagaaaagcaagcactagtctctgagttgcagagactaaatgaagagatgcaacagacaaaagaagaaaggaatgatgagtgttgttgtggacaaagagttgctctaagcagcagcacatggtcagataatggaaagtatgagccagaagtcaggctaaatcaagggattgttttgtgtaatgacgacattaagacagagtattttggatttgaggaagagtccaatcatgagctcataaacattgtggagcaagctgatgatagtggcttgacttcatccgataactggggaaatttcaattctgaatctctcttagaccaatctagcagcaattacccttggtgggatttttggtcataaataaaatagtgaagagaaagagtgtgtatagttttctagataaatcataaattttctttttgcattgtgatat

SEQ ID NO: 126 - DNA, 823 bp, Brassica juncea
gatcgctccagatataaaaaaaatagttaaaagatggctctcgaagtctgcgtgaaagccgccgttggtgcccctgatgctctcggcgactgccctttcagccaacgggttcttctcaccctcgaggagaagaatcttccctacaaaatgcatctgatcaacatctccgacaaacgtcagtggttcttagccattagtcctgaagggaaagtaccagtcctcaagaacgacgacaagtgggtgtctgattccgacgtcatcaccggcatcctcgaggagaagtatcctgagccatctctcaagactcctcctgagttcgcctccgttggatccaaaatcttcggtactttcgtgactttcttgaagagcaaagactccagcgacggatccgagaaggccttgcttgatgagcttgaagctctggagactcatctcaagactcatgacggtcctttcatcgccggagggaaagtcagcgccgtggatctaagcttagcaccgaagctttaccatctcaaggtggctcttggccactacaaaagctggtctgttcccgagagcttgccacatgttcatggctacatgaaggctttgttctctcttgactcgtttgagaaaacaaagactgaggagaggtatgtgattgcaggatgggaacacaaggttaacccctaaaactactactagtttcatctgtttctgtgtgatgatgatgtggttcaatgtcttatctactctatcagtaaaataatgttcctggaccggttatgttttgttattgtatcaatcaaataataagcctcttttgagataatattagcgt

SEQ ID NO: 127 - DNA, 1812 bp, Brassica juncea
acaacaaccatcggtaacaccaccgaaacaaaacaaaacacataccctttaaaaacaaagtttagtttcttcttcttctactaaatggagaaaggttccaacggttccgcggcgttggagatgcagacgtccgagctcgatcagccggcggctctccgtaagatcatttcggtgtcctccatcgccgccggtgtacagttcggttgggctttacagctatctctgctgactccttacgtgcagctactcgggatcccacataaatgggcttctctgatttggctctgtggcccaatctccggtatgcttgttcagcccatcgtcggttaccacagcgaccgttgcacctcgagattcggccgtcgtcgtcctttcatcgtcgccggagccggtttagtcaccgtcgccgtgttcctcatcggttacgccgccgatataggtcacagcatgggtgaccagctcgacaaaccgccgagaacgcgagctatcgcgattttcgccctcgggttctggatcctcgacgtggcgaacaacactctccaaggaccatgccgcgctttcttggctgatctatccgcgggaaacgcgaagaaaacgcggaccgcaaacgcgtttttctcgttcttcatggcggtcggaaacgttttgggatacgcggcgggttcttacaagaacctctacaaagttgtcccgttcacgatgaccaagtcctgcgatctctactgcgcaaacctcaaaacgtgttttttcctctccataacgcttctcctcttggtcacgttcatgtctctatgttacgtgtcggagaagccatggacccctgagccaaccgcagacgggaaatcctcgagcgttccgtttttcggagagatcttcggagcgttcaaggagctgaaaagaccgatgtggatgcttcttatagtcactgcactgaactggatcgcttggttccctttcctcctcttcgacactgattggatgggccgtgaggtgtatggaggaaactcagacgcaactgcatccgacgcctctaaaaagctttacaacgacggagttagagctggtgcgttggggcttatgcttaacgcgattgttcttggcttcatgtctcttggtgttgaatgggtcggtcggaaaatgggtggagcaaaacggctttggggagctgttaacttcatccttgctatttgcttggccatgactgttgtggtgactaaacaggcggagaatcaccggcgagatcacggcggtgctaaaacaggaccgcctggtaacgttaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccacagatggtggtatctgtgggaggtggaccattcgatgaactattccatggtggaaacattccggcgtttgtgctaggagcaattgcggccgcggtgagtggcatattggctttaaccgtgttgccttcgccgccaccggatgctccagctttcaaaactggggctatgggatttcattaaagttttagaagtgtttgggtggctatgtaactctcataaaacagtagtgttattgtgcaaatcctacataaagagaaaaatggaaattaatcttcttgggttgttggtttatattgtacctaaacccattgtgttccttttttgtaactgaaattttcaatttggagtatatttcaccttttgccaccttcaaggcttcat

SEQ ID NO: 128 - DNA, 758 bp, Brassica juncea
caaatctgctgatgtgttgttatcaaccccgcgtactcttacaaatcatcttaagcatactttgatcgtttcgtattctcatcaacaaagcaaactaaaacttttcgaccactatggcagaggaaaccaagaacgttcacgagcatgaggtgccaaaggtagcgactgaagaatcatcagcggcggctggagaggttacagatcgtggattgttcaatttcttggggaagaagaaagaggaaacaaaaccagaggagaccatcgactctgagtttgagcataaggtacatatctcagagccggtgcctgaggttaaacacgaggaaaaagaagaagagaagaagcatagtctcctcgagaagcttcaccgtagcgacagctcttcaagctcttcaagcgaggaagaaggtgaagatggtgagaagaggaagaagaagaaggacaagaagaaggttactactgaaggagaggtgaaaacagaggaggaggagaagaaagggtttatggaaaagttgaaggagaagcttccaggacacgggaagaaggctgaggatgcttcacccgcaccggttgttgctcctccggtggaggaagcgcatccggcggagaagaaggggatcttggagaagattaaagagaagcttccagggtaccatgctaagaccgtagaggaggagaagaaggataaggatgatcattaaagatatttataatgatgatgatgtgttcttgtgttgaatgataatgatcatctttta

SEQ ID NO: 129 - DNA, 588 bp, Brassica juncea
gaacatactgattactaaaagcagaacaaccacaaaggtgtttcaaaaaaaaagaacaaccacaaagacagagaaacaaagaagaagtaacatggtaaagatgatgtggggttccagtttagctctcgccgcagcgcttctcctggtgacggtggcaaacattccggtggcggagggagtgacgtgctcgccgacggaactgacttcatgttcgtcggcgtttatgtcagcttcgccgccgtcagcaacgtgctgcgccaagctgagagagcagaagccatgcctttgtggatatctgaggaaccctgccctcagccagtacgttaactctccaaacgccaagaaagttgccagcagttgcaatgttgcaaccccgaaatgttaatcatgattaattagtgacaagtttcgctgatcatgagtgtttaattactagttaaaataggtctggtcttcgacactactgtttagaataatagtgtggtggtgattatgatgctcatcatcatgcttgaatgttatgttatgtcatgttatgctatgtatgttatgttatgtatgtttattgtcttatgaaacaattttcct

SEQ ID NO: 130 - DNA, 605 bp, Brassica juncea
agtacgcggggacacacaatacaactataatcataaaactcacctcttcccagatgcagtactacgaaacccgtgcgaaagaatactacgatgtggctcaaggtcagagccgccaaagctatggccagaaccaccagggatatggacagagccaaagtcgcccagtatatgggcatagtccgactctaaactaccgtagccacggtgggtttcttgatgggttattcaagggtaaaaatggtcaaaagggtcagaacggcttagggtcgtttatagggaaacacaagaaccaagatactaacaaggaccatgaacatgggaagctcttaggacagcacgagaagaaaactcaagagacaaacaaaggtgttaatggcctaggaatgtttataaactgtggagagaaaaaacttaagaagcaaaatgagcacaagaagaagaagaacaaggatgggcatgccagtggcaatgagagtggaagcagcagcggtagcgacagcgactaaatcaaatacttccataaacatgatgcttctaagggatactatataaactataaagtaactagacgtattattttgaataaaaagccacttaggtggttg

SEQ ID NO: 131 - DNA, 755 bp, Brassica juncea
aacttcagctttgaggtaaagcttaaactagaaaaacagaacagagatgggtttggtcacagaggaggtgagagctaaggcagagaagtacactggagatgagatatgccgagagaagacaaaagtcttcctcaaggaaatatctatgcctaatggcttactaccgttgaaggacattgaagaggttgggtacgacagagagtcaggtgtcgtgtggctgaagcagaaacagagcatcacccacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagtccccaaccacactttccaggactttcccagtctcagcttttgtagtcccagaggaagtggaacctgccaaggaagaacctgccaaggagaagagcagtgaagccgccgccgaggtcaaagaggctgttgcagtcaaggaggcctaatcaaagcttttctacagttaaaagagaccaaaatctattgaagtgtacttcaacaatgtaaacagactattgagagttagtgtttctcactgctcttactctcatgtattacctacccctcgtttctgcatgttttatatgtaataagatgtcaataacatcatcctgttatacaaaaagtaccgtaattatctataga

SEQ ID NO: 132 - DNA, 691 bp, Brassica juncea
ttacactcatacaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttctcactacttcatttgcgctatccccggccactgtgccggcggcatgaagctctctgtcaacgtaggtgcagcagcctcttcagacggtggcggtgacagtggtgatggtaacacccccaaaactacaccttctccaaccgtagagggcaggaaggctgctccttccgcttctgccactgctatgttgaagccgttcaaagctttggttgtgacttgtgtagctgcattattatatgctttggctctttcctagttgttttttaatttcttgttgatttggtttggctcgtttgaaaatccaggctagaggcagtgctatgagccctattattattatacgcttcttgttgtgattaattattctatgatattttcctctgtttcgc

SEQ ID NO: 133 - DNA, 1186 bp, Brassica juncea
gatatcagtaaccaaaaaacaaactaaaacatggggttcttgagtaagagtgtattggtgagtctcattgcactttggtgcttcacttcctctgccttcactgaagaagtgaaccatgtgactcaaacaccttcctctgctcctgctccagctccttaccaccatggccaccaccacccacaccctccccatccccaccatcctcacccgcaccctccggcaaaagcccctgttaaaccaccggtttctccaccagctaaacctccggttaagcctccagtttaccctccagccaaagccccggtcaagcccccaactaaacccccggttaaaccaccagtttctccaccagtcaaacctccagttaagcccccggtttaccctccgaccaaggcccctgttaagcccccagttaaacctccagttaagccaccagtttcaccaccagccaagcctccggttaagcccccggtttaccctccgaccaaagcccctactaagcccccaactaaaccctccgttaagcctcctgtctctcctccagccaagccaccggtgaagccgccggtttaccctccgaagtttaacaggagcctagtcgccgttcagggtacggtcttctgcaaaagctgcaaatacgcttcttacgattcactcactggcgccaaaccggttgaaggtgctgtggtgagactactgtgcaagggaaagaagaacatagtcgcggagaccacgacggacaagaacggatacttcttgttgttggctccgaagacggtgactaacttcggtttcagaggatgtcgtgcgtatcttgtgaaatcaaaggactacaaatgcaacaaagtctccaagctcttcggtggagatgtcggtgccgaactcaggccggtgaaaacgcccggaaaatctgcagtggtcattaacaaactcacctacggtgtctttaacgtcggtccgtttgcgttcgaccctgtctgccccaaataaagatgattaagatgatctggttactttcttgatcacgttaagttcaaaagagtgagaggagagagatgtgtttctgcgttgcgagtgtaatgttagctagtgttaagttaaatgttgtgttgcttttatgaatgtgtccctaagtgacgttgtttcaagttccatttgaataaaaatagccagcttcaagaagacc

SEQ ID NO: 134 - DNA, 1092 bp, Brassica juncea
gtggtttcagcaaacttccgtccatagtggaaaatgattaaagttaggtttgcattgattggataagaacaaagactggttgttgagtcacatttcctctctctcgcatcattcacaagcatttcattccactcgacgaacacaaaagcttctcagatttcactatcggtttctctgagacctctgaaaattctgtccttttcatcagttattgagatctgctttgttcattccatgtcctgatatagaagtgattgatctcaaatctggttggtctttagattgttaataaagagtcactgtctgataacagcagcagctgttgtttttcagttgtagggatgggttctgaaggaccaacggcagtgacaattaacatcacagggttcaagaagttccatggagttgctgaaaacccaacggagaaaatggcaaacaacctgaaagaatatttagctaagaatactcagtcgaaagacgttgttcttggaagctgtactgtgcttgagaccgctggtcaaggagctctcgcttctctttatcagttactacaatccgcaattaacacgaaagaatcagagtcagtgacctgtggaaaaaccatatgggttcactttggagttaacagcggtgctacgaaattcgcaattgagcaacaagctgtgaatgaagcgacgttccgttgccctgatgaattgggttggaagcctcagcatttgcctattgttccctctgatggtccaatctcaactgtaagaaagactactcttcctgttgaagagataacaaaggccttggagaagaagggctttgaggtgataacatcagatgatgcaggtcgttttgtgtgcaactatgtctattaccactcgctgagatttgcagaacagaacaagacctattcactctttgttcacgttcctcttttcgtcgctgtggatgaggagactcagatgagattcactgcttctctgctggaggtactcacttctgtttgcaagtaatgttgtcccaaatgtggctgattcttgttcatgaatcatgaaccgatttgtctcgccaccaatcaataaatgaaatataagttcactt

SEQ ID NO: 135 - DNA, 1038 bp, Brassica juncea
acaacctccatgtcccatatatcttttaacagcaagagaactcaaagagtttgattttctacaaaactagtttttttttttgggttttagttggtatcgtcggaagagagagagagagaaaatgttgggaattttcagcggagctatagtatcgctgccggaagagctggtggcagctggcaaccgaactccgtcgccgaagacaaccggagcggtccttgtgaacaagttcgtcgagaaaaatccctccgccgtgtccgtacaggtcggcgactatgtgcagcttgcgtacagccaccacaaagagagtcctcttcgaccaaggtcatttggggctaaggatgagatattctgcttgttccaaggctcccttgacaacctaggaagcttgaagcagcaatatgggcttgcaaagaatgcaaacgaggttctattggtcattgaagcttacaagactcttcgtgacagagctccttacccggctaaccatgttgtgtcacacctaagtggcgatttcgcctttgtggtctttgataaatcaacctccactttgtttgtagcctccgaccaagttggtaaggttccattgtattgggggataacagctgatgggtatgtggcatttgctgatgatgttgagttgctgaaaggtgcttgtggcaagtctcttgcttctttccctcaaggctgcttttactcaactacgttaggtgggctaaggagctttgagaaccctaagaacaagatcactgccattcctgctaaagaggaagaaatttggggagccaccttcaaggtggaaggagcaacagttcttgcagattgagaacggggaaaaaaaattcaagaaccatctttcttaatctctgaaacttctcaatagcagaatgaaaataatatatagagagaaacaaactgttctatgagttgtttaagctatcatggtgtgttgtgtcgtatctctcttttgtctcttgcttctttgtacagtccgtgtctctgtcttcgtgttccaataagttatgtctcagactcaca

SEQ ID NO: 136 - DNA, 736 bp, Brassica juncea
aacacaattcacaatcttctttagaatccaaaattattgttcgaagaaaaaaaaccgaagatggcaacaacgtcaacatccacgggagatatcgagaaaaccaagtcagtagaagtgaataagaaacttaacgtgttgatcgtcgatgatgatacagtaactcgtaaacttcacgagagtatcatcaaagcgatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacgtctatgattattggggtgacgacactggctgacaatgaagaggaacgtaaggctttcatggaagctggacttaaccattgcttggcaaaacccttaagcaaagccaagatcctccctctcatcaacaatctcatggatgcttgatggatggatgaattgtcgccactacatatctacattatacaaatatgaaaaacacatataataataacgtcatacacctgtgtgtgtatgcatagatatctatccgcatgtgtgtttttagggttgttatgtttgatttttattgtgcgtggcgtgatatacagtcatgtaagtcgttacttttggcttataaaataatgaataagatttgttatatgatcagatgaattcaatttccatttca

SEQ ID NO: 137 - DNA, 1136 bp, Brassica juncea
aatctctctcgctctctttctcatacgccgcaccgtaagcgaactattgaatccacgaagaaacctcgatccgtcgatactatggcgaccaacgaatccgagcacgagaacagagacacggaagagaccggagctaacgaggatgaggacaccggagctcaggtcgctccaatcgttaggcttgaggaggttgccgtcactaccggcgaggaagacgaagacgccgtcctcgatctgaaatcgaagctgtatcggttcgataaggaagcgaatcagtggaaggagagaggtgctggtactgtgaagctcttgaagcataagagcactggcaagattaggctcgttatgaggcaatcgaaaactctcaagatctgtgctaatcatttcgttaaacagggcatgagtgttcaggaacacgttgggaatgagaagtcttgcgtgtggcacgctcgtgactttgctgatggggagctgaaggatgagcttttctgcatccgttttgcttcaattgagaactgcaaagcatttatgcagaagttcaatgaagttgctgaatctgaagtagagaaagaggagagcaaagatgcctctgaagcagctggtcttcttgagaagttgaccgtggaagagacaaaaacagaggagaaaactgtggagaaggtgaagaccgaagtggaagcagaggagaagacaaaaagcgagccagagaaagctgatgaagaaaagaaaaccgaagaggtttctgctcactcaacttaaagatgcatcaatgtttaagctcctttggcgaggtattattaagcctataagtgttctgatgcatccatctcgagtctactagtgtcttggcactaactatccacatatgttttgtcgaatcatatcaagtggttgggggatcgcttgggggggggggggttgggttttgctgagtcgttttgggttttatagttttgagtcgaaagctgggtgagtgatatgagagattaaggttggtcatcagagagagtacattggattcattgtttaaagtttcctatgggttgtttttgtatggtcttattttcatggacgagagtcagaagtcttcatttctttgaattacaaaattatatgcatgttgattttaatttatt

SEQ ID NO: 138 - DNA, 2341 bp, Brassica juncea
aatcctaaatatctcccctcttcgatcttttcacctttcctcttcgtcttttgatctccgatctgtatgatccctttcaccttccttccattatccctagcaatgctcatcacttccgttggaggattaatatccttagtaaaagccacaataaatggcttctctacgctctcatctccgttgttctatttatagatcgattccgatgggtcatttctttcctcttatccctttttcaacttagacgaaaagaaaacctagacacaaatccgatgaatcctgctgtttcatccgctgttgtcaagaacgccgccgctgccaatctccccgccgcgcatgtcgagcctgcgttgttcttccgagatgttactctcggcccacgtgaagccgtgttgcgtttccgtctgattcatctctgggaggcccggaatccgaacacaagaactctcatcggacaagagatgctcctcatcgatgaagagcggcggacaaggaggaggaacaaacggtgttgaagcttcaggggatccgtcaactttcctataattaactctctttttattttagtctccactttttaatttttattttaatcgtttgtagatggtagtgggcccaacaataatttagagtccacttattgtgagaaacataaatagttagtgttgttaaagcaagatggggccggtaacttgaaagcggaaataacttctttttttttttctttttggcaaatagttagatgggatcatgggaccaagtttttgtccaaaatcatgtgtatatttaaacgagatgggaccgagtttggacccagacctaattagaatcagagtaccataagctaaaacttgacatagctccgctggaaaagaaacttatgtcagaaataataaggcctgaaagggtgctttgttttcttgacaccggtcggctggttaagatacgagaaggtggaacagactggggatggggggttgtagttaatgttgtaaagaaaacttcagttggaacctcttcacaaggtgaaggatatatagtggatactttacttcattgctccactggtgttagcgagaatggtgcaaagccaaagccgtgtcctccccgtcctggggaaaagggtgagatgacaaaccacatgatatatgaaatgactttgggctcgcttcacgcaaacatgcccgtcgaaacttatcaagctaaacgtggcgttttagattagggttggccgtcaacgtctcgcgtctcccacattcatacctcgaacaatcttttgtcttcttcgtcgggtgtgagataaggctgtaactgatcccccctcataaagctcgccttaatcaatgacacacgatatccattcaatgctcttaaggagagggcgagtcggtggaagttctgctataagaaggctggccgttcttcttcctccgttcaggtccgactgctccgattttgggaagccaggaacgtccggtgtggtggcgagcttatgggagtcgatatgctcttccttgattctcaggcgaccatggtgccggccacgatcagtgtccaccggctggagacccaccggtctaacctgaaagcgggttcggtttatacactaaacgggtttgatgttgcacagtgtaacccaaactaccgtctatctgattcttccttgctcatacgtttcaaggatgttaccgatccagctattccgatacctcctgagtcattccacttccgtaaccacagtgagatgcttgggctcgctaatactaaccatcagcttcgaggtaaattgtatcttatatgttcgtctgattatcggaatagatagctaacaatatcccctgcggctctgtcatgcgatgacaatcaataagagtcaaggacaaagtctcaaacaagctgctctatatctccctaggaatgtctttactcacggccagttgtatgttgcgttatcgagagtgacatcaccggagggtcttaagatactggacgagagctctgactcaaatggtgctgatggagtaaccaatatagtgtacaaggaaatctttgagggccttcaaggttcaaagggaaagaagccaatgtggtcttgaacaattctgaacttcgacgtagatacttttgttgacggttctgagcatcgtctactcaaccactctactatctcttcttttaccggttaccgtttgctttttcaataactatcatcttaacgctttgaaatatgatttacagtacagttgtttttttttagcaaacttcagttcagtttctttattactcttttgttgctacattccatggcagttacccttaactattctaatgcgctctcaac

SEQ ID NO: 139 - DNA, 1083 bp, Brassica juncea
gagacaattaatcagttttgtgtgtttcagagaagaagaagatcttcaaagagatttatcatctcaaaatcgttcgcgttgagacggtgaatttaaattaaataacaaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcgcgttcatattcgagaaggtatgtgtgatccttccagaggaggttaagacacgggaagtacctgtggaggaagtgaaggccgaagaaccggccaaaactgaagaaccggtcaaaaccgaagaaacaagtggcgagaaggagaaggagattgttgaagagactaagaaagaagagatcgttgcaacctcggccgttgaggagaagaaacctgaagtagaaaaggaggaggagaagaagcctgtggtcgaagaagtgaaaaaggaagaagctgctccagctccagcggtggttgaaactccggttacggcaccagaaacaacgacaccagcgccagtggctgagccaccaaagccttgattcgtttcaagatggtatgattgctttctcttgtatgaaaacatctttgttcgtaacaaaaagaaaaaaaaaagaaactgaaaggaaccaaaaaacttattttcattctttttattttatatggtttgtctttgtgtggataaatctctgttttggaagtcgttaatgcgtttttattttatttgtattcatgtgaatttgtaacaaaatattggtggatgttttttgtgtataattatttgtatgtttcgaccaagc

SEQ ID NO: 140 - DNA, 509 bp, Brassica juncea
gatttcgttttctatttgttcttctttctggaaaattagggtttgtattcttatcgagatgggtggaggaaacgcacagaaatcgaagatggctcgtgagaagaacttggagaaggcaaggcaggccggaaaaggcagccaactggaagctaacaagaaagctatgtccattcagtgcaaggtttgtatgcaaacattcatctgcacaacatctgaagtgaaatgcagggagcacgctgaggccaagcatcccaaagccgatgttgtcgcctgcttccctcacctcagcaagtgatgaaactatcatttctcaccaaaaaaggattccagtgtaaatgtatggatccgtctcctatgtttgttgtatcattcaagtgtctcgggtcaacaaaacttatggttatgtttctgtttctgtttttactcaagacttgtttcaacgctaagtctcttactactattattatggttatactatgaagctttgtttggaacttcttttcatgttc

SEQ ID NO: 141 - DNA, 994 bp, Solanum lycopersicum
agaaaatcctttcacaataaaccaaaaaaacaaatcaaagtaatggctgagaagaatggtgaagttcaagaaatcaaacaccaagaggttggccacaaaagccttttgcaaagtgatgctctttatcagtatatacttgagaccagcgtatatcctagagagccagaatccatgaaagaacttagggaggtgactgctaaacatccatggaatctaatgacaacatcagcagatgaaggtcagtttttgaacatgttgttgaaattgataaatgcaaaaaatacaatggagattggagtatatactggctactccctccttgctacagcccttgctatccccgaagatggaaagatattggcaatggatattaacagagaaaattacgaaattggccttcccataattgaaaaagctggtgtatcacacaagattgattttagagaaggccctgctttgccccttcttgatcaattacttgaagataaaaacaatcatggcacatatgatttcatatttgtggatgctgacaaggacaactacatcaactatcacaaaaggattatagaattagtgaaagtaggtggtgtgattgggtacgacaacaccctatggaatgggtctgtggctgcaccagctgatgcaccaatgagaaaatacgtaaggtactatagagactttgtattggaacttaacaaagccttagcagaagatcagagggtcgagatttgtatgcttcctattggtgatggcattaccctgtgccgccgtatcatctgatcattttacatatttttctgcttttttttcttttattttaattcaactatcaaaaaaaaaagtgtctttctttgtatttttttttttctggttattattattgaacgggagaaagttacccttttgatttatgagtttattttcactatttgtaatgataaaagaaattgtatctcaatgtactttttataattacaagcattattgaacatta

SEQ ID NO: 142 - DNA, 3391 bp, Zea mays
ttttttctcctctccacttcgttacgcggacagtgggaggagccacagccattataatagcacgccatacgccaaaagctccactggagccgagcagctactcctcccagtcccaggctcactgtcgctcctcccaagaacccgcccaaagaatcctagaaatccaagaaagggagcaaccaaaacaggaggaggtctgcaggaggaggagcaggaggaggtggtgctgaaggggaagatctcacaagtgtgtgaagaccacacagtctcgcgcactcgcaaacccagtgcgcgctgcggtcttcctcttcgcccaccttcttggagcggggaggttggccatgaggaggtggtggccggctgccctgctgggctgcgcagtggcggtgtccgttctggtggccgccgtggaatgcgctgtgacttacgacaagaaggcggtgctgattgatgggcagaggcggattctcttctccggatccatacactaccccaggagcacccctgatatgtgggaagggctgattcagaaagctaaagacggaggcttggatgtcattcagacctatgtcttttggaacggacatgagcctacgcctggaaattactatttcgaggagaggtacgatttagtcaggttcataaagacggtccagaaggctggcctgtttgtacatctccgcatcggtccctacatttgtggcgagtggaacttcggcggcttcccagtttggttgaagtatgtaccgggcatcagcttcaggacagacaacgaacctttcaagacggccatgcagggtttcactgagaaaattgtgggaatgatgaagagcgaaaacctctttgcatcccaaggtggcccaattatcctctctcaggcaagtataatcttttccttagatttgattgagaatgagtatgggccagaaggcagggagtttggtgccgcaggtcaggcatatatcaactgggcagcaaagatggcagtcggattgggtactggtgtgccgtgggtgatgtgcaaggaggaggatgcacctgatccagtgatcaatgcatgcaatggtttctactgtgatgcattttctcctaacaaaccttacaagcccacaatgtggactgaagcttggagtggctggttcacggaatttggtgggaccatccgccaacgaccggttgaagatcttgcatttgctgttgctagatttgtacaaaagggtggttcttttatcaattactacatgtatcatggaggaacaaattttgggcgcactgctgggggtcccttcatcacaacaagctatgattatgatgctccaattgatgaatatggacttgttagagaaccaaagcacagtcatcttaaagaactccacagagctgttaagttatgcgagcaggctttggtttctgttgacccagcaattactacccttggtaccatgcaagaggcccgcgtcttccaatctccatctggttgtgcagctttccttgcaaactacaattctaactcctatgcgaaagttgtgttcaacaatgagcaatacagcctaccaccttggtcgattagcatccttcctgattgcaaaaatgttgtttttaacagtgccacagttggtgttcagacatctcagatgcaaatgtggggagatggtgcctcatcaatgacgtgggagaggtatgatgaggaggttgattctctggcagctgctccattgctcaccacaactggtttgcttgagcagcttaatgtcacgagagacagcagtgattatttgtggtacatcaccagtgttgacataagctcatctgaaaactttctacaaggtggcggcaagcctctgtctctcagtgtgcagtctgctggtcatgccttgcatgtctttgtcaatggacagcttcaaggttctgcatatggtactagggaagatcgaagaatcaaatacaatggcaatgctaaccttcgagctggtactaacaaaattgcactgctgagtgttgcctgtggattgccgaatgttggagtgcattatgagacgtggaacactggtgttggtggtcctgttgtgcttcatgggctggatgaaggttcacgagaccttacttggcagacttggtcctatcaggttggcctgaaaggcgaacagatgaatctgaactccatagaaggctcaagctcagttgaatggatgcaagggtcattgatagctcaaaaccagcagccattggcctggtatagggcttactttgagactcccagcggggacgagccattggctttggatatgggtagcatgggcaagggccaaatctggataaatggacaaagcattggacgctactggacagcatatgcagatggggactgcaaagaatgcagttacacgggaaccttccgggcacccaagtgtcaatcaggctgtggtcagcccacgcaacgttggtatcatgtgccaaagtcctggctgcagcccaccagaaacctgctggtagtcttcgaggaacttggtggggattcatcgaagatcgccctagtgaagaggtcagtctcaagtgtctgtgctgatgtatctgaggatcacccaaacatcaagaactggcagatcgaaagctacggcgagcgcgagtaccacagggccaaagtgcacttaagatgtgcgcgtgggcagtccatttccgcaatcaaattcgcaagctttgggacacctacgggaacctgtggagatttccagcaaggagattgccactcagctaactctcacacagtcctagagaagaaatgcattgggctccaaagatgcgtcgtcgccatctcccccgagagctttggaggagacccctgcccgagcgtgacgaaaagggtggcggtccaggcagtatgttctcccgtcgcgtagccttacttctccaagcaatggatttggaaggcggtcgacaaaaaaaaaaaaataaaaaatggtcgaaaccagtgcagggtgagtggaactgtaagtatcgtcgactttgattattagatgtggctggcttgagaggttagcagcattcgttgtcggattccagattaggatttgtagtctgctgcatctccatgaattgttcaaagcggccggctggataatgttgtagctggtccaggaatgcagctgtagagagagagagagagagagagagagagaggagtggaggcagaagagtgactgattatgcattcttttgctgtggtgttagtagctgtgtacccgtgacacatgtcgtctttcttggaacggagaaagatgcaggtgaagtgtgcattgtgcccttttgttctactgctactgctagtggtaaggcaggagccttgcaattgtggggggagaacagtgccttctttttctgaaggaaaatcccg

SEQ ID NO: 143 - DNA, 2538 bp, Arabidopsis thaliana
aacacatcaacagaggatccaaacttttcccaattattgcaagtcaatcgatttgtttatctatataaagctcccaaatctcaaatctcaaatctcaaattttttattaaacgcctacatatattactcacacttgttttcagatcataaagttttttcttggatttatatataatgcactaatacatacacacccacatgcttacacacatgttcgaactgtaatcagtaaaagaaacatcagagaggaagagaaggagaagaaaagatggagatgggtcgtctggtcttcgggttgtgtttgattcttattgtgggtacgtttcttgaattctccggcggtgctacggcggcgaagggagtaacgtacgacggacggtctttgataatcgatggacagaggaagcttctcttctccggttccatccactatcctcgcagcacacccgagatgtggccgtctctgataaaaaagacaaaggaaggaggcatcgatgtgatccaaacgtacgttttctggaacctccatgagcctaagcttggacagtatgattttagtggaagaaacgatttagtgaagtttattaaagaaattagatcacaaggtctctatgtctgtctacgtattggacccttcatcgaagccgagtggaattacgggggattgccattttggttacgggatgtacccggtatggtataccgaaccgacaatgagcccttcaagttccacatgcaaaaattcaccgctaagatcgtagatttgatgaaatctgagggcttatatgcttctcaaggaggtccaattattctttctcagatcgagaacgagtatgcaaacgtggagggggctttccatgagaaaggagcatcgtacatcaagtgggcaggtcaaatggcggtcgggcttaagaccggagtgccatggatcatgtgcaagtcgcccgacgctcctgatcccgtgatcaatacctgcaacgggatgaaatgcggcgagacttttcctggaccaaactcacccaataagccgaaaatgtggactgaggattggacttcattctttcaggtttatggaaaagagccttatattagatctgctgaggatattgctttccatgccgctcttttcgttgcaaaaaatggaagttacatcaactattacatgtaccatggtggaacaaactttggaaggacttcatcttcgtatttcattacaggatactatgatcaagctcctctcgacgaatacggtcttttaagacagcctaagtacggtcatttgaaggagcttcacgctgcgataaaatcctctgcaaatcctctgcttcaaggaaagcaaacgattctctccttgggaccaatgcaacaagcttatgtctttgaagacgcgaacaatggatgcgttgcgtttctggtaaacaatgacgctaaagccagtcaaatacaattcagaaacaatgcgtatagcttgagtcccaagtcaattggtattcttcagaactgcaaaaacctaatttatgaaactgcaaaagtgaatgtgaagatgaatacgagagttacaacgccggttcaagtgttcaacgttcccgataactggaatttgtttagagaaacaatccctgcattcccaggcacatctttgaagacaaatgctttgttggaacacactaatttgacaaaggacaaaactgattatctttggtacacttcaagctttaagctggattcaccctgcacgaacccgtctatctacacagaatcatcaggacatgttgtccacgtgttcgtcaacaatgcactagcaggatctggacatggaagcagagacataagggtagttaaactacaagctccggttagcttaatcaatggacaaaacaatatatcgatcctcagcggcatggttggtctaccggactctggagcttacatggagaggagatcttatggactaaccaaagtacaaattagctgtggcgggacaaaacccatcgatttgagtagatctcaatggggttactcggtgggtttgcttggagagaaagttaggttatatcaatggaagaatttaaatagagtgaagtggagtatgaataaagctggactaattaagaaccgccccctcgcttggtacaagacaacgtttgatgggccgaatggagatgggcccgtgggcctacacatgtcgagtatgggtaaaggagaaatttgggtgaatggtgaaagcattggtcgttattgggtctcgtttctcacccctgctggacaaccttctcaatctatatatcatattcctcgggcgttcttaaaaccatctggaaatttattggtggtatttgaagaggaaggtggtgatcctcttgggatatctttgaatacaatatcggttgttggttcgagtcaagctcaatctcaattctcctgaagattatttttttaaaaatggtttttgggtaattgggggtgttttataaaccaaacaatacattatattgaaatgatacaatacacaaattgaatgaaatatacaggtttcat

SEQ ID NO: 144 - DNA, 1286 bp, Brassica juncea
agcctcaagcacatcgtgaaacaacaacacgatcgctttaaggctcaactctgagttcatcgaagttttcagacagaagcgagagatggaagtttccggcgttgttctccgacagattccgtgcgtttcaggctccgtcaccgatggccgttactccggtctccgattttccggcaacacgaggacaacggtcgggtttcggacgaggagattcagagggatcatgtgtaataacgagtttgcggataaagggcacatgagttactattctgggacggcgagatgcggcggtgaggggaaggataaggttaaggttatggagaaggagaagaagaaggacatgaagaagaaggctaaggttcttaaagctctttccaagaacttgaacatgttctcaagcatagggtttggtcttgatccagatgccggtttggttgctgagattcaaaacaagacaatctcggaagcaacagagattctggttaagcagctggatcagttgaaagcagaggagaagctattgaagaaacagaggaaagaagagaaggcaaaggctaaagctttgaagatgatgactgaaatggactctgaatcttcttcttcgtctgaatcaagtgacagtgattgtggcaaagggaaagttgttgacatgagctctttgagaaacaagccgattctcgaaccgttagaaccagaatctagcgtagcaacccttcctagaatcgaagaatatgcagattcttgcaagaacaccggtgaagcattgaagcttgctctgctacaatcagctgctgcatccacagcttttccctccattgttaatcctggattgccattgaagacggtggaagcagttccagttgttggattgccgtcgaagagaatagaagtctgtatgggaggaaagtgcaagaaatcaggaggagctgtgttgttggatgagtttcagaaggcaatgacggggatggaaggatctgcagtgggttgcaagtgcatggggaagtgtagagatggtccaaacgttagagtggtgaacgagactgaagatgctgtgatgactgattcagttagaacaccttccaagaccgtttgtgtaggagttgggttgcaggatgtggaaactattgtcacaagtttttttggtgaagaattttagtatttctcatattgaaagagtttaataatgatcaaagttatgtatgtagtgtggtgttttctctcattgtacatatctgtcttcgtgtgcattttcgagtggaacattgataatatataaacatatcttt

SEQ ID NO: 145 - DNA, 937 bp, Brassica juncea
ggctcccctatttcgtctttactcgacctcgaagctaaattagaatcctcaacatctctctctgtctctggcgattgaggtgtgtggttgggaagatcgagtagcgagtgatcatcatgttcgtgattgattggttctacggcgttctcgcttcgctagggttatggcagaaagaggctaagatcttgttcctcgggctcgataacgccggcaaaaccaccttgcttcacatgctcaaggacgagagattggtgcagcaccagccgacgcagcatccaacatctgaagaacttagcattggtaaaatcaagttcaaggcttttgatttgggcggtcatcagattgctcgcagggtctggaaggattactacgctaaggtggatgctgtggtctacctagtggatgcttacgacaaggagagatttgcagaatcgaaaaaggaactggacgcacttctctcagacgaatctctagccaccgttcccttcctcatcctaggaaacaagatagacataccatacgctgcatcagaggacgagctccgttaccatctcggcctctccaacttcaccacgggaaagggtaaagtgaacctagtggattcgaacgtaagaccattggaggttttcatgtgcagcatcgtcaggaagatgggttatggcgaaggcttcaaatggctctctcagtacatcaagtaacctaaccaccaagactccaaccacacatggcgttattattgttaaactcgtaagtttctataaatcccgttttgtattttgtcttgcgtttttttctttgcatgtttgtaagaaatgtcgtgaaacttagcttctcgtgtgttgtctggtttgtttcttgtagtgattttaaatttttaattcatattatatgtttcgtaatttatactatttaaataaaggtaaaatgtttgaattat

SEQ ID NO: 146 - DNA, 725 bp, Brassica juncea
ggttttctgccatacgtcctaaagatagcacataaaagttaataaaaatccactaagagagctctctctttaccattttcccactttcctttgagaaaacagagcaaaatggcactgagaatgtgggcttcctctacagcaaacgctcttaagctctcttcttctacctccaaatctcatctccttcctgcgttctccatctccagatgcttctcctcagtgttggaaggactcaagtatgcaacttcacacgagtgggtgaaacatgatggctcggtggctaccattggcatcactgaccatgcccaggaccatctaggagaagttgtgtttgtggagctgccagaagagaaaagctcagtgagcaaagaaaagaactttggagctgtggagagtgtgaaggcaacaagtgagattttatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggttcaaaggaatacaccaagttctgcgaagaggaagatgctgctcactagagggtttcacctgtctatgtttcgtaccctatctctctcagctttgtatctctgtaatactaatttggttgaaagatgatcattcaaataagactcaagagagctttttactttaa

SEQ ID NO: 147 - DNA, 2216 bp, Brassica juncea
ataatggctacgaaaccaggcatcctcaccgattggccttggacgccccttgggaatttcaagtacatagtaatagcaccatgggcggtccatagcacatacaagtttgtgactgatgatccggtggatctcgggtactccctcgtattacccttcttgctcttcagaattcttcacaaccaggtttggatctctctttcccgttactatacaaccaagggaaagaggcgcatcctggacaaaggtatcgacttcaatcaggtcgacagggagaccaactgggatgaccaaatattgttcaacggattactgttctatatagggatcatgctgctgccgcaggcgaagcaacttcccttgtggaggacagacggagtgttgatggcggcgatgcttcacgccgggccggtggagttcctctattattggctccacaaagctcttcaccaccactttctttactcccgctaccattcccaccaccactcctctatcgtcactgaacccatcacttcggtgatacatccatttgcggagcatatagcatacttcattcttttcgccataccattgttgacaacgttgttaacgaaaacggcatccatagcgtcgttcgccggatatgtaatctacatagacttcatgaacaacatgggacactgcaacttcgagctcgtccctaagcgccttttccacctctttcctcccctcaagttcctctgctacactccctcattccactcgctgcaccacacccaattccggaccaactactccctcttcatgcccttgtatgactacatctacggcacaatggatgaaacctcggatacattgtatgaaaaatctctagaaagaggagaagatagagtggacgtcgtgcacttaactcacctgacgacgcccgagtccatataccatttacggattggcttggcttcatttgcctcccaccccttctcttatagatggttcatgcgccttttgtggcctttcacatctctctccatgctcttcactctcttctacgccagcctctttgtctctgagagaaactctttcgagaagctcaacttgcagtcttggatcatacccagatataatttgcagtacttgttaaaatggaggaaagacgcgatcaacaacatgattgagaaagcgatactggaggcaaataaaaaaggagtgaaggtgcttagcctgggtctcatgaaccaaggggaggagctaaacaggaatggagaggtgtatattcacaagcatccagaaatgaaagtaagagtggtggacggcagtagattaacagcagccgttgtgatcaatagtctacccaaatcaacgacaaaaatagtgatgacaggcaatctcacaaaggtggcatacaccatcgcctctgctctttgccagagaggtgttgaggttttgactctactaccagaagagtatgagaaactaagatcatttgttccacaagaatgcagagaccgtttggtccttttaacctctgaaacactcgcatcaaacaaggtatggctgatgggagaaggaacaacgagagaggagcaggaaatggccacaaaaggaacgttatttatcccattctcacagttccccctcaagcagttacgaagagattgtatctatcatactccaccggctttaataattccaaaatctctggtcaatatccactcctgtgagaactggttaccgagaaaggcgatgagtgcaactagagtggctggcatattgcacgccttagaaggatgggaaatgcatgagtgcggcacatccaatattcttctctcggatttggaccaagtgtgggaagcttgtctcacccacggcttccagcctctgctgcttccacatcacttccaatacccctgattccctactttcagatgatgaatattgtttccgtaattgatcatatatgatttacagtaagcctctagacaatggatccagaatttcacctctgtattcttagctgatggtttcactcgatctatggctgatacaactatatgtttttcaagaaaacctactattttattgcaatgcttgtgttatacattgctgaatatctattgctagtaataatgcttctgatttggcatttttcaaagcttttttggtctaaaacctgcaagataatccaaatatatttctgtttgtgaaagaaaacattgccggaagatgatggtcttctt

SEQ ID NO: 148 - DNA, 1029 bp, Brassica juncea
gacgtcactctttctcccttcccttcgataatgctatctctcgtcgcctctcctccggtaatctccgccgcgtctctctctaaacctctccagtctctctccaaagctgcactctctctatccaaaagagccaaacccacttcccctttccccaaaaccgctagatccatctccgtctataaatctccgatgaacaacctcttcaccaggctcggattcgggtctcgtccccaacccgacccggcttccgccgcaatcgcgcaaggacccgacgacgatgttccgtctccaggtcagcaattcgcgcaattcggcgccggttgtttctggggagcggaattggcgtaccagagggttccaggcgtgacgaagacggaggttgggtatagccatggattcgtcgataatccgagctacgaggatgtctgttcggagacgacgggacataacgagattgttcgggttcagtacgatccgcaagaggtcagcttcgagagcttactcgatgtcttctggaaacgtcatgatccgaccacgttgaatcgccaggggaatgatgtggggacgaggtacagatcaggcatatacttctacacagacgagcaagagaagttagctcgtgaagcaatggagaaacagcagaagaacttaaacaggaagattgtgactgagatacttcccgccacgaaattctacagagcagaaaactaccaccagcagtacctggcaaaaggtggtcgcatgggtctcagtcaatctgctgagaaaggttgcaacgatccaatccggtgctatggctaagtaactagtcagtctctctggagaagataaaaaagtgagttatctcatgagaatacaataatactctgtagatcacatgttgtgtcttgtctcgttcaggtggtatttataaatttatagtgatgatgcatcatatggagtgtaatttacgtcattgccacaacagtctcctgaatttcagtctgtaatattcagttttaccataataattgtttgttatgttataag

SEQ ID NO: 149 - DNA, 775 bp, Brassica juncea
ggagagagagagacaagccacagagaaaaatggcgagattcacggtgttgattgcggcagtgatactagcttttgtagtggcggtgccggaagtgacggcgaagaagtacactgtcggcgagaacaagttttggaatccaaacatcaactacactatctgggctcagggaaagcatttctacctcggtgactggctctatttcgtgttcgacaggaaccaacacaacattcttgaagtaaacaagaccgactacgagaactgtaacgccgaccatcctctcgtaaactggacacgtggagctgggagagacattgtcgctctcaacgtgaccaaacactactatctactcgacggaaagggtggctgttatggaggcatgaagctcgctgttaaagtagagaagcttcctcctccgccaaaagctgcacctgtcaagagcattggttcagtttccatggccactggtgttgctcagttcgtgattccgtttgctcttttctctgtttcgacggtgtgggatgccatcttaaggatgtggtagtgaccaccaatctcagaggtctttagttggaatccattttcgagtttaaagaaacatcaaattctttttcagggaaagcattttaagttagagagttcatcagttgagtttatgttttgtaatgttggattgttgggttttaatattttgttttgtttgtgtctttgaattaattgttgaaaaaaaagttgtatttgatttacttgagattaattaatggtttaaaactttcg

SEQ ID NO: 150 - DNA, 695 bp, Brassica juncea
gagagagagagaatggatcagatcttgaacaaagtgggatcgtactggctagggaagaaggcgaacaagcagctcgattccgtcggtgacgatatcaactctctgtctactagcatcgaaggaggaacaaaatggctggtgaacaaaatcaaagggaagatgcagaagccattacccgagttactaaaggagtttggtttacctgtggggatctttccacgcgacgcaactaactacgagttcaatgaacagactaggaaactcaccgtctttatcccaacgatctgcgaagtcggatacaaagactcatcggtcttgaggttcaccacgacggttacagggtttttggagaaaggaaagctagctgacgttgaagggatgaaaacgaaagtcatgatttgggttaaagtcacgagcatctctgctgactcttcgaaggtgcatttcacggcagggatgaagaaaagcagaagccgtgatgcttatgaggttttaagagacggcgttgagattgataagttctagcctctctgtttctgtgtcctgcttctatcttcccttgtgtttccagctttatatgtctttttttaatctgtctttgtatatgcaattaactctggtgttcatgaatctcatgaattgaattggtatcaataaataacgtgaacgtaactggtcttcatgcgaaaggaacc

SEQ ID NO: 151 - DNA, 1491 bp, Sorghum bicolor
gtccgcgtgcgccggccaccacggcgaacggccaccaaacgcacgggatccggccatcaccgagtcccggcccggccaccggtaacccaccaccaccaggccaccaaccaaacccaccgaccgcgtccgccccgctgacgcgccgggcccggaccccgtcgcgccgcgcgctcgcccgcccgcctacctggcaggcagccaagtcacatgcctcgccttgccggctcgccgcccgggcattatataagccgccccggcacggcacggcaggcaaggtcggtcaatctagcaacacccaaggacaaggagtagccgacgcgccagctagtgcccagtgccgcacccagatctccgggagggacttgttcagctactgcagcactgcccgcaatggccaccacggcgaccgaggcggccaaggccgcgccggcggagcaggccaacggcaacgccaacggcgagcagaagacgcgccactccgaggtcggacacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctcaacatgctcatcaagctcatcggcgccaagaagaccatggagatcggcgtctacaccggctactccctcctcgccaccgcgctcgctctcccggaggacggcacgatcttggccatggacatcaaccgcgagaactacgagctgggcctgccctgcatcgagaaggccggcgtcgcccacaagatcgacttccgcgagggccccgcgctccccgtcctcgacgacctcatcgccgacgagaagaaccacgggtcgttcgacttcgtcttcgtggacgccgacaaggacaactacctcaactaccacgaccggctgctcaagctggtgaagctggggggcctcatcggctacgacaacacgctgtggaacggctctgtcgtgctccccgacgacgcccccatgcgcaagtacatccgcttctaccgcgacttcgtgctcgtcctcaacaaggcgctcgccgccgacgagcgcgtcgagatctgccagctccccgtcggcgacggcgtcaccctctgccgccgcgtcaagtgaaaaaaaacatgcctggccaccgacggcgccgccgccgccgcatcccccatcccaatcatatcgtagacgacgcgcagcattaattattcaccggcttttttttttggctctttcttggccctgtaatcttttcttgtccttctgcttcttcttgggaattgtcgccatctccatacgtaaatctaaatctcgagatggataatactagtatcaatcaattttactactatatactgctcctaccgtggatgatttcgtcctccttgtgtgcctgtcataaatctgattttgggtgaatttgtgaaaacccaagct

SEQ ID NO: 152 - DNA, 1362 bp, Arabidopsis thaliana
tttgtaagtgaacccattccactcttcttgcatttgaatctgattgttttccgtttaaagatgagaactttgatgaattctgctgctacaatgagagctgtgaagaaggagtttattgtaatagacttagatgctgataaagatgaagatgttcgttgtggtaaagtgaaagaagagtatatgatggatgctggcaaaactaatccttccaacatccaacaggttgtttctgctgttgcttctgatgatgatggtgatgatgatgatgactggggtaccaaaatggattatcagtatataaagttgttggatagtttcagagaagatggaagtttaaatctgagtgacaatccactaaggtctattaggtatgaagtagataatggtggatatgacaagcgggagtttaaagcagtgtttacaaataagcggagtagagaagatcgaaacactattcgtgtaaccaagaagaatgttgagccaaagcctcctcatgttcaagcaagtacagagaaggtaacaaaagaagccggtttcaaattaaggcgaagagagagtcttgtgagtcagaagagtgttgaagcaatgcttattacaagtcatgtgagaagaaactcccaacacaataatggcgacgctagcgagaaggagaattttgaggatgacattgtattggatgaggtttacagatcttatctcaaacggttagtggaaaattcgaaaagttcaagaactaatcctgaaaaagagataaaagtaaagtgtgaggaggatcatacagtgtctttgtctgattctgattctgatattattgtggttggagattgtccgtttctggaagaagaggattctccatttgtgccatcaaaaagttataaagtgattgatttggatgaagagagcagtgatcaacgcaattcttggtttaggagggagataatgaatgttctgaagcagccatacactgtaacagagctcaaggaacttcacaaggaagcatcagtgcatggagtgtcatccagacatatagaactacgagatggaacagagtttagctttccaacgaacaaaaagaaaccttcatatctcgataggtatccagacttcaaaaagcagtaccttgactctttgcgtgaaaaggatgagcgtaaagctctgaacctgttgcgcgggtttatcttttatataacgaatgtggttcgtgatgatgcattcaaaccgtggctcgatcaagaatgtttgaagatcagatgtgtctgacaaaagagtatcagcacttggagttctgacagaagactactaattaggagatgtaagacctttgtttcatgaaataagtttggacaagatttgcatttgtgt

SEQ ID NO: 153 - DNA, 747 bp, Arabidopsis thaliana
gtcacgcgcattactcgcgcgtgtgaccaagtccctttctcttgcttcagcttctttctttccttcctcgttgactgcttcttctgcatttcccagtgagaaatggcgacgaaggaaccagaatctgtttacgagttaagcatcgaggatgcaaaagggaacaacttagcactcagtcaatacaaagacaaagttcttttaattgtcaatgttgcttccaaatgtgggatgacaaactcaaactacactgaattgaatgagctttacaacaggtataaagataaaggtctggagattctagcatttccttgtaaccagtttggtgacgaggaaccgggaactaatgaccaaattactgactttgtttgtactcgcttcaaatctgaattccccattttcaacaagattgaagtaaacggagagaatgcttctcctctgtataagttcctgaagaaaggcaaatggggaatcttcggcgatgacattcaatggaactttgctaagtttcttgttgacaaaaacggtcaagctgtacaacgttattatccaactacttcccctcttacacttgagcatgacataaagaatcttctgaatatctcctgaatgatgaagctttgttgctgaatcgtattgtatttgattatgaacctctctcattcaataaagagccatgacattgacttggattgattagttctgtttgagagccaaatcggttatttagataaaccagcattattatct

SEQ ID NO: 154 - DNA, 923 bp, Arabidopsis thaliana
ggtgcggaggttgacagagctttagttccgtacaaatggcgagtaagaaggttgacggagaaggaaaagggaaagctatagcgaatacgaggatgcttcgaagcatggatcgaaagactcgaagcgatactaagcgagatggttcttcttctaagctcatgaagatcgaatctccggagaagaagaaacggaagacgacgaaagcgaagaatgttggagctgcgaagaagaaggtaaagaaagaagaggtagctgtgaaaatcgagaaagaggaggaggaagatgatgatgctgcagagaaagaagaagatgacgactccgataagaagaagattgtgatcgagcattgcaaacaatgcaaatcattcaaggagagggctaatgaggtgaaggaaggtctagaggaagctgttcctggcatcattgtcactgtgaatcctgataagccaaggcgtggttgctttgagattcgagaggaaggcggcgagacattcatcagtcttttggctatgaagcgcccatttacaccgatgaaggaacttaacatggaagaggtcattgcggacatcgtagagaagattaagtaacacagctagtaggttctaccaatgccgagtctttcgtttcctccttggccctcggctaataggcttcaatatctgactatctagagcaactgcaggattttttaggcttaattttgatatattggtgaaaaccatttgagcacggtttcgtcgtttggtagtgcttgatcggctttgtgcagtttctttatgctaaaacttcctgatatatatgggattaagtctgtcttcgtaatgctagtttgaagcaattcgtttcgtttcatttattgttggattgtgtttggcgttcaattacgttacggattggatgaatgaagataaaacatttagtta

SEQ ID NO: 155 - DNA, 905 bp, Arabidopsis thaliana
tgacttctgagatcgtcttgttcaccaaagagaagaagactaactgtgttttttttttctttcctcgatgcctagatcaagcagatgggtcaatcagcgagctacctctaagattaaaaaatttatactctttttgggtgtagcctttgtcttctacctctacagatacccttcttcgccatcgacggtggaacaatcatccacttccatctacaacatttccgttaaggatattgaagggaaagatgtgagtttgagcaagtttaccgggaaagtgcttcttatagtcaatgtagcctctaagtgtggtctaacacatggaaactacaaagaaatgaacattctgtatgccaagtacaaaactcaggggtttgagatcttagcatttccttgcaaccaatttggtagtcaagagccaggcagcaacatggagatcaaggaaaccgtttgcaatatcttcaaagcagaattcccaatctttgacaagattgaagtaaatggaaagaacacttgtcccctttacaatttcttaaaagaacaaaaaggaggattgtttggggatgctattaagtggaatttcgcaaagtttctggtagacagacaaggaaatgtcgttgaccgatatgctccaactacatcacctcttgaaattgagaaggatatcgtcaagctattggcatctgcttgaacatatatgtcaaaggacaggagagcaaaaagcatcgcatcaaacatgtctgagactgagaatgaaaaccactttctatacttattctttacctttcatgtttatccaaaaccatccatggaaaagaagatgcttgtctgaatctgtgaacctcattttctgtaacaaaaccccaaaaatgcttatgaaacatcaataaagaacaaagttttattta

SEQ ID NO: 156 - DNA, 2111 bp, Arabidopsis thaliana
ttttaaaacctcgaaagttttctagggcaatctcggccacttttactcacagaaaaccttctctctaaacttcttcgaaaatctcacagagcttcttcttcttcgcttttagggtttttgctctattgtttcgagtgacccaacttcgaagcttatagatcgttaccttagaaaatggtgggtatgtcgatgcagccatatggtattcaatcgatgcttaaagaaggttacaggcatctctctggtctcgacgaagccgtcattaagaacattgaagcttgcaaggagctctccaccattactcgcacctctctcggtcccaatggaatgaataaaatggttatcaatcatttggacaaactgtttgtcacaaatgacgctgctactatagtgaatgagctcgagattcagcacccggctgctaaacttctggttttagctgctaaggctcagcaagaagaaatcggagatggagctaatctgacaatctcctttgctggtgaacttcttcaaaacgctgaggagcttatcaggatgggacttcatccgagtgagatcattagtggatatactaaagctgtcagcaaggctgttgaaatactggaacaactggttgagactggttctgagaccatggatgtacgtaacaaggatgaagttatttctcggatgagagcagctgttgcaagcaagcagtttgggcaagaggaaataatttgctctttagttactgacgcatgtattcaagtctgcccaaagaatccaacgaatttcaatgtggataatgttcgtgtttccaagcttttgggaggaggcttgcacaattcttgcatagtccgtggtatggtcttgaaaagtgatgctgttggtagcattaagcgaatggagaaagcgaaggttgctgtatttgctggtggcgttgataccactgcaacagagaccaaaggaactgtcctcattcatagtgctgagcagctagagaactatgcaaagacagaggaagctaaagttgaggagttgattaaagcagttgcggaatcaggagccaaagtcattgttagtggaggatcaattggagaaatggcattgcatttctgtgagcgctacaagataatggtattgaaaatcagctcaaagtttgaactgaggcgtttttgccgtacagcgggggctgtcgcccatttgaagcttagccggccaagccctgaagatcttggatatgttgattctatatcggttgaggaaattggtggtgtgacagtcacgattgcaagaaacgaggaaggtggtaactccatctccactgtggtcttgcgtggaagcacagatagcattttggacgaccttgagagagctgttgatgatggagttaacacatacaaggccatgtgcagagacagccgtattgttcccggggctgcagcgactgaaatagagttggctcaaaggttgaaggaatacgccaatgcagaaatagggttggacaaatatgccatcaccaaatacgctgagagttttgagtttgtacccaagacccttgcagataatgctggcctcaatgcgatggaaatcatagccgctctgtacactggacatggatctggaaacacaaaactaggcattgacttagaggaaggtgcttgtaaagatgtttcagagacaaaagtatgggatctttttgcaaccaagttatttgcccttaaatatgcttcagatgctgcatgcactgtacttcgtgtagaccagattataatggcgaaaccagcaggtggaccaaggagagatgcagctcaagctgcaggtgctggtgcggaggaagactaagccggagaacaaatacctcgtagtgaaactctcttcttttgtaaccttctgttcctgaaagtctgagaaaattttggtatgtctcagtttaagatttgtgatctttgtaacgcaccaccaacttaagtgttttgccttctttttctgttttgccttgttttggctcgtctcaacactcagattttccggtttagctagtgaaattattactaggatttttggcttaactctgtattaatgtcaatttggtttctatttgaatcgacttttgaacaagtgacaaaatc

SEQ ID NO: 157 - DNA, 782 bp, Arabidopsis thaliana
ctttatgagtaaaagcgaagtaaccatttctctcactctcctttctcaattaatataagccaatcaccatcaaaatatcatttgagaactctagaaacctgcttcaatggcgatcgacaagcttccacttcttctctttctctccatactcctctgcctcaatcgccctgttcttagcgacaccgatgaagaggacattcttctcacaggaatcaacagctacagaacaacacagaatctaacaatcttaagcaagaacgaaaacgcagaatgcctagctgacgaaatcgcagaccaattcaagaacaaaccttgtaccaacgacactggctcagccacagtacctggaactgagccacagttcgcaaactaccctcagattctagcaaaatgccacttgaacgtctcagacacgagagacggctcgattatgcctgcatgtgttcctcgtttagaatcaaacctcgtcctcacaaacttcaccaagtcacaatactcaatgagtttgaacgattccaagtttacagggattggtattggtaaagaagatgattggatcgttgtagtcctcactaccaacacaccagaaggaagctattctacagctactcctacaaaacaagagtctaatggcttcacctttggtattggtctcgttagttatttagtcattttcatgtactcttccttttgtttctttctcttttgagatatcaaatgttttgatgagttatcaaacactctttcctttagactatcaagaataaattttgttaaagatt

SEQ ID NO: 158 - DNA, 1710 bp, Arabidopsis thaliana
tactttgaaaaattgaaattcatcatttttcttcctccttaagatttttttttttcttttctaattaacgacaacacgacgaagatgaatccttctcacggtggcgacgacaagcaacgaccggcgatgtatccccaagttgatcaatccattcctgataatccttttgcttctacaaatccttacgtcgcttcttcaccttatctatatccttctctatcctctcataatctcggacctaatctcttcccagaccacggagatgcatccaacgaccaatcaccatctgctcctcctcaggcgacggaggaggttctcatccgtgttcccggcgctattctcaaccttatcgacaaatcctacagcgttgaactcgcgtgcggtgatttcaccatcgttcgaattatccaggggcaaaacattgtagcggttctagccaatgttggaaatgagattcaatggccgttgacgaagaacgaggttgcagctaaggttgatggatctcactatttcttttcgattcatccgccaaaggagaaaggtcaaggatctgggtctgattcagatgatgaacaagggcaaaagagtaaatcgaaatcggatgatgagattcttaattacggattgaccattgcttcgaaagggcaagagaatgtattacttgtgcttgatcaggttttacgagactacagttgtttcacagagcagagaatgtctgaaaaagccaaggagactggagaagaggtgctgggaaattcagtggtggcggacacttcgccggaggagcttaagggtgagagaaaggatgttgtggaaggtcaatgtgcggcgtattggacaacacttgcaccgaatgtcgaggattatactcacagtactgctaaaatgatagcttccgggtcaggtaagctgatcagagggatactgtggtgtggggatgtaactgtggagagactcaagaagggaaacgaggttatgaagaataggcttagtcgtgctgagaaggagaaagatgttagccctgagacactgaggagaatcaagagggttaagagagtgacacaaatgacagagaaagttgccactggtgttctttctggtgttgtcaaagtctcgggattcatcactggttcaatggcaaactcaaaagctggaaagaagctttttggtctcttgcctggagagattgttctcgcatccctcgatggatttagcaagatctgtgatgctgttgaagttgctgggaaaaacgtaatgtcgacttcatcaactgtcacaacagaattagtcaatcacaggtacggcacaaaagcagcagaggctactaacgaagggctagacgcagcgggacatgcatttggaacggcatgggttgctttcaagattcgaaaggcatttaaccccaaaaatgtcataaagccttcatcattggccaagtctgtttcggaactaaaggctaagaaaggctccaagtaaacactaaacagccttcaactgttctgtgttcatctaaacttgcatttagtttttcattttggaaaagtatatgaagattgattgatgtaactctatatttagttttctgtgtatattgtgattctatgtaaactatataaacagtttcttccaatcttctcccatttatgggtttgatttgtaacttcttaatgcatcgagaagcagtattagtactctttatctttcttttgt

SEQ ID NO: 159 - DNA, 762 bp, Arabidopsis thaliana
gaagcaacaagtgaagaaagaaagaaaaaaatggagaagagtggaggaagaattgtaatggatgagataagaagctttgagaaggcacacttgttcgatcttggtcatcctcttcttaaccgtatcgcagattccttcgttaaagccgccggagtgggagctttacaagccgtgtcaagggaagcttactttaccgtggttgacggggcaggttttgactcgaacaacgtgggtccaccgtcggagattacagggaacaagaaacataggttccctaatctcagaggggaaagcagcaaatctcttgatgcattggtgaagaacacaggaaaagaatctctccaatgggggctagcggcagggttatactcaggtatcacttacggtatgacagaggttcgtggaggagctcatgattggcggaacagcgcggtagctggagcattgacaggagcggcaatggctatgacgacgtctgagaggacaagccatgagcaagtggttcagtctgctctcactggagcagctatttccaccgctgctaatctcctttctagcgttttctagatgatttgtattagaagctttaatgcataagggttgtttcatgtatcagttatgtttctttttgtgaaaacgaattcgctaaaggtctactaagatcttttcctgaaactctcgaagctggagagagatcgttttgttatctgtttggaaaatatttgcactatatatatcttgagtagtacctattacgtaacc

SEQ ID NO: 160 - DNA, 1734 bp, Arabidopsis thaliana
ctcgattatacagttttcctctctctcactctctccgtagtctgagactcgccggaaaagcttgtattggcttctcttcgatttctggcggaagtaaggatatcacgtgagctatgaagttcctcatgcaatccatttctgggaggaatcgatctctggttcgagctctagttagtcggcgttacttcgcttcatcgccggaggaaatcgcaaagagaaattacgccaacgatctgtcggaatacaacaccgctgtcaactccgtcacagctcagcgcaggcactatttgctgagggatgtttatgatgatatgaagcttgatggtgtgcagcctacagctgatatcttccattcatttgtcgtgggaacgatgaagggtgctcggttaagcgatgcgttctttttccgggaagaaatgaaagccatggggattgctccagatgtgaacttgtacaactttttaatttccacatgtgggaaatgcaagaatggaaaggaggcaatccgagtctatgacgagatgaagagatatgatgtaaaaccaaatggacagacctttgtctgcctgctcaatgcctgcgctgtttctggccagttagatcttgtatatgcgatagttcgggatatgactgctgctggtgttggtttgaaccagttctgctatgcgggactcataactgcacacttaaacaagcagcccagaccagataatctttctactaagattctcgagtttgtggagcagtcaaaaggctggtcagcaattgattcatcaaggaagagtgcagaagatgtgatgtttagcatcagtgaagaagagctgtacaatattccaaccgctgattattcccacaggaccaggtttctgcagaggaatttgactgtgtatcacgtagcattcagtgctctcgctgatctgaaggatgtaaaagcaacggaagctcttcttgagatgcttaagaaagacggaaaagatactgacacttactgcatgctacaaatcatgaggtgctatctacattcgcaagactttgagaatggtctcaaactgtttcaagattacatgagcgcagacaaaatccctgccatggaactatacacgacgcttatagaaggagctatgacaggatacaccgataatggaatgaagattgctcaggacactctgatccaaatgaacgaacgcaatttcttcttagacccaagaactggaagcaatctgttactcaaagccgctggtgaaaagacgggagggtacacagttgcaaatatgatatgggatctgatgctagctcggaatattctaccaacactagctgctgttgaagcttactacaagggcttgaaagaacgcgaaataccagaggatgatccgagactgatgttagtgacgcgaacatacaataacttgcggcttagggaagggacattacctaataggcgttaaagcaaagggaccaagaggaagaaagatggtatcatggcttcttcgttttctacttctatttgcttattgggatctctgtgaaccatctgggtattttaaaaccagttcgtttagatgaataaggaaatttcacctagatgatgactggatattattctgatttgatttcaattacttaaccttgagagcttcatacaaagcgacaacgttttaaataagccaacgcctgtttggtttataaagatcagcctgttcactcttaaatgcacccgtttggttttttgat

SEQ ID NO: 161 - DNA, 1580 bp, Arabidopsis thaliana
atttctgccccaaatctttttcaaattcatataaataaccaaacacttgttcttcttcattcccccttcgtcttcctcctcctaaatcaccggcgataatggaatgctctgcaactcctcccaagctttatccaaccgtcgacacttcaaccaccgttgctcctctccctaagtcctcttcctcctcctcttctactaataataataatctctatccttcaatcaatgtcaatgatcttgtcaacaatatcttccccgatcccaccgcctctgactcagcttcagcgcctcctctcgcgacggaggaagtgattctcacaatccacggcgcgatggtccacctcattgacaaatcctacagcgtagagctcgcttgcggcgatctcgagattctccgtcttgttcaaggagatatcaccgtcgcggttttcgctcgcgtcggtgacgagatccaatggccgttgactaaagacgaacccgccgttaaagtcgatgagtctcattacttcttctcgctccgacccgttaaagaatccgagtcatcggatcattcagtcaacgaaacagagaacgagatgttgaactacggattaacaatggcttcgaaaggtcaagaaccgatgcttgagaagctagacaagatcttagctgattacagtagtttcacagcggaggagaaacagaaagaagagaacgttttggatttgacggcggcgaaggagacttcaccggaggagctgaagggaaagaggaaaaagatggtggagaagcagtgtacggcttattggacgactctggctccgaatgttgaggattacagtggcgttgcagcgaaactgatcgctgctggttctggtcaattgattaaagggatcttatggtgtggggatctcacaatggatagactcatgtggggaaatgatttcatgaagaagaagttgtccaaagcagagaaggagagacaagttagtcctggaactttgaaacgtctcaaaagagtaaagaagatgacaaaaatgacagagaaagtggcgaatggtgtgctctctggtgttgttaaagtttctggattcttctcgagttcagtgataaatagcaaagctgggcagaaactctttgggcttcttcctggagaaatggttcttgcaacactcgatggattcaacaaggtttgtgatgctgtcgaagtagcaggaagacacgttatgaaaacaacttcagatgtaactactgaaatcgtcgatcacaagtatggagcaaagacagcacaagcgacaaacgaagggcttagcgcagcagggcatgcttttggaacggcgtggactgttttcaagattagacaagctcttaaccccaagagtgccatgaagccatcatcactcgctaaaaccgtagttaaaacggcagctaaagagagaaagaaggggaaaaaaagttctaagtaggctaatggacgttgtgttgtttgtatatcaatatcattgtcttggtacataagcattaaacagaccatagaggtttgaaaatattagattttgttgtgttgtgttgttgttgatgcaaaagtgttttgcttcttc

SEQ ID NO: 162 - DNA, 1123 bp, Arabidopsis thaliana
aaaaaaccaagttcaacacaatccatcacatccatttcaatagaagacgaagaacgtttcagaatcatcaaccaaattcagaaaatttcagccatgacaggatcacaagaagaccaacctaagatcatcattgatcaagagcaacccaaaactctagaaacagagcaccaaccagaaccttcttcatcgtctccggatcagaagaaatggggtactcacgtgatgggagctccggcagctccagttgctcatcccgataaccaacaggcggcggcgtgggtcgctggagataaccagcagacgcagtaccaaccgtacgtcatctactctcctgtcgaacatccaacaactaacaaccctctcgagccagtcatcggaatgttccatacctggagtcgcaaggcagaaaccgtcgcacgtaacctctggcacaatctgaagacaggaccgtctatgtcggaaacggcgtgggggaaggttaatttgacggccaaagcgataacaaaaggaggattcgagtcgcttttcagacagattttcggaacagagccaaacgagacgctgaagaaaactttcgcttgttatctctcgacgacgacaggtcctgttgctggaactgtctatctttcgaatgctcgtgtcgctttttgtagcgatcgtcctctgtacttcacagcaccttctggtcaagaatcttggagctactacagggtggttgtacctttggcgaatgtagcgacggtgaatccggtggtggtgaaagagactccacctgagaagtatattcagttgacgacggtggatggtcatgacttctggttcatgggttttgtgaattatgagaaggctacgcatcatctgctgaccagtgtctccgattttcaaaccgcacacggctctgtgtctggttaaaactgttagagtaaaattcttttagaggtaatggagaaagtgtttaagtgttttgagagagttttttaggaaatagaacttttattactttgctttaaactttgaatacaacttcacaacattgcaacatttgagagggggaggaggtatttatagcctccaaactacaaaatatctaaaatattttaatcctaagtctagagagttctta

SEQ ID NO: 163 - DNA, 1124 bp, Arabidopsis thaliana
acctcaaagaaaacatcgaaatcttagagaagaagaaaagaaaaagaagagaaatgacagagaagaaagagatggaagtggtgaaagggctcaacgtggagagatacatgggccgttggtacgagattgcttctttcccatcaaggtttcagccaaagaacggcgtcgacactcgcgccacctacacccttaaccccgacggtaccatacacgtcttgaacgaaacgtggagcaacgggaagaggggttttatcgaaggcagcgcctataaggccgatcctaaaagcgacgaagccaagctcaaagtcaagttctatgtccctcctttcctcccaatcattcccgtcaccggagactactgggtgctctacatcgatcctgactaccagcacgctctcattggccagccttccaggagttatctctggatattgagcaggacggcgcaaatggaggaagagacgtataagcagctggtggagaaggcagtggaggaaggttatgacatcagcaagcttcacaagactcctcagagtgacacaccacctgagtccaacactgcccctgaagactccaagggcgtttggtggttcaaatctctcttcggcaaatagattacacggcacacaaagactttgtttcacctctttgatccttttgtctgtgtaatatactaccccctttgtctactctagttatcttccatcatctgcttttgtctatttacgacatcttcatctagttatgcaaagtcgtctcttttaccataaggaagcgcacacaaattcaatcagatcaaatctgggaaagacaattcaaatcttgcagaagttgacattatgtatttggataaacacaccacacgactcgagacttatggaatcaaaataatgcatgcaaactacagacggaattatatgtatagataagacgatagaaaaaacagtctccccccagcaaaagtttggttgactatatacccagcaggacttccagctcacagaatagtacagcatgaatttgttttcttcgcttgcttgtaaaacatctgttccaaccaatacaaccaaatcagattttcatgttggaagtaaacatggtttacctaatctaaataacgaaga

SEQ ID NO: 164 - DNA, 1122 bp, Hordeum vulgare
cggcacgaggcccactccccactcgccttccgtccttgagccacgcccgcgaaaaccctacctccggagccatcgccgtcgccgtcgccggtcgagatgaagggcggcgacatcgaggcgggctacgccgacgctgcggcgtcgaagggggcggcgctgtaccccggggcgacggagagccccgagctgcgatgggcgctcatccggaagatctacgtcatcctctccctgcagctgctcctcaccgccgtcgtcgcggtcgtcgtcgtcagggtccgggccatcccgcgcttcttcgtctcgtcctacgccggcctcgggctctacgtcttcctcctcatcctccccttcatcgtgttgtgcccgttgtccatctaccgccagaagcacccagtcaacctgctgctgcttggtgtcttcacagtggccatcagcttctctgtgggcttgacatgtgcctttaacagcggcaaggtcattttggaggctgggattcttacagtggttgttgtcttgagcctcactgtttacaccttctgggctgcgaagaggggcaaggacttcagcttccttggtcctttcctgtttgcttctctcagcatgttgctcgtctttgggctcattcagatcttcttcccgctgggcaagctgtctcacacgatctatggtgcgctggcggcgctcatcttcagtggctacattgtctatgacacggacaacatcatcaagcgttacacgtatgacgagtatgtctgggccgccgtctcgctctaccttgacgtcatcaacctgttcctggccctgctgaccctgtttagggcggctgacagctaggcgcgtcgccctgcccctgctctctcgtgcttcaaatcccgtggacgaatgtggtatcctgacgagtcccttgacatgaagaattgcataggctggtctatcttgctggcacggtggaggtgcttcttagtttagttgagttattaatccctattagtagagagcaaacataagaaaactgctgtgcgtgggttgtattatacggatggtggatgtgatgctgggtttagggggggcttgacatgctggactgctggtgctgcgtttctgatatcatttgtgtagccg

SEQ ID NO: 165 - DNA, 959 bp, Sorghum bicolor
gtccccattattgctggaaaaaaaagaacacgagaaaaatctaatccaagagacggggattccagagcgcccccgctcggctagggaagggaaggagaggcgaagcggagcggaggcgagatgggggcggccgagtccgtgccggagacctccatacacgaattcaccgtcaaggattgcaacggcaaggaagtgagcctggagacctacaaggggaaggtcctccttgttgttaacgtcgcctccaaatgtgggttcaccgaggttaattacacgcagctgacggagctttatcggaagtacagggacaaagactttgagatattggcattcccctgcaatcagttcttgcgacaagagccaggttctaatcagcagataaaagactttgcttgcaccagatttaaagctgaatacccagtttttcagaaggtgcgtgtaaatggcccggacgccgcgccggtttacaagtttctgaaagctagcaagcctggtttgtttggatcagcaagagtcaaatggaattttaccaagtttctcgtggataaaaatgggaaggtcgttgagagatacggaacatcgacggctccaatgtcaattgagaaggacatccagaaggcccttgatgaggaataaagatcccatgtcctcttgtctcgtctcatccatcacccacactggcagaaataggcactcgcagaagtattccgtcgtagcaacatttgcttgtttgtagtaaatctgtataatgccctccttttcgccttcatgctcattgcgctcgtgtaagtattggttgtattaactagccattaatcttctccgtctttttttttctttttgccctttttggactgaagagttaagtcatgctatatcgatgcaaaactatgtaacattggtgaagtattatactcctactagtttataaggtttgtgtttacgctcattccattcct

SEQ ID NO: 166 - DNA, 1314 bp, Sorghum bicolor
aattccacctcgccatcgtcctcccctcgtctccaaaaggaggcgccgctcctcgtctacgccgtccacttccctctctagcctcaacgcctccgccccccccactcgcgagaccctagctagccctagcgccacccgccgactcacccggagagaggaggaggaggaggaggccttcgccgtggtcgtcggccgaggagcaggcgccaggatgttcgggtaccagaagggcgtcgacgtcgaggcggggacctccgccgccacgggcggcggcgcgcgccagctctacccggggatgcaggagagccccgagctgcgctgggcgctcatccgcaagatctacgtcatcctctccctccagctgctcctcaccgccgtcgtcgccgccgtcgtcgtcaaggtccgcgccatcccgcacttcttcaccaccaccaacgccgggctcggactctacatcttcctcatcatcctccccttcatcgtgctgtgcccgttgtacttctaccatgagaagcacccagtcaacctgatcctgctcggcctcttcaccgtcgccatcagcttctctgtgggcttgacatgtgccttcaccagtggcaaggtcattctggaatctgcaattctgacaacagtggttgtgctcagcctgactgcatacactttctgggccgtgaataggggcaaagacttcagcttcctgggtcctttcctgttcgcctccctcatagtgctgcttgtgttcgcactcatccagatactgttcccactgggcaagctctcccagatgatctacggtgggctggcatcactcatcttcagtgggtacatcgtctacgacacgaacaacatcatcaggcgcttcacgtacgaccagtacgtctgggccgccgtctccctctacctggacgtcatcaacctcttcctgtccctgatgaccctcttcagggcagccgactaggcgctctgctcccatcctgtcctatctacgcaagctgtgaataccttacgttggtccctgaatgcttgtctcgtgggttaagctcgggtgcccagaattccagttttaagagttgtgtatagctgcgttgcctttttacttactagtatggtcttattcggcttggctcggtcagagtcatgatatcattaggtagttggaaagcgaacaaatgtactcctaccttgattatgtgcgtggagatctggtactggatttgggttgcctaaccttgaatgagagtttggagagccatcagctttatgatctttgtttgctgctttacggtgaatctatcatggagttctcatttatcg

SEQ ID NO: 167 - DNA, 1086 bp, Sorghum bicolor
ggaaaacgaccaagaagccgttcccgtgagagctccgagtgccggccgcgtgtccgcacccgagcagtgagaggagatcgatcgagggcggtgaggtgacagaggaacagaggaggagaagcagaagatgtacttccggccgccgcccaagggcccggagtggtacgccggcgatgcggagacggggcaggcggcgcggccgctgtacccaatgatgctggaggacccgcgcctgcggtggtccttcatccgcaaggtctacagcatcctgtccatccagatgctgctcaccgtcgccgtcgccgccgtcgtcgtgtacgtccgccccatcgcgctcttcttcgtctccacgcccggcggattcggcctctacatcttcctcatcatcctcccgttcatagtgctgtgccctctgtactactactaccagcaccacccggtgaacctgctgctgctgggcctcttcaccgtcgccatcagcttcgccgtcggcctcacctgcgccttcaccaaaggggaggtaatcctggagtcggcgatcctgacggcggtggtggtgctgagcctcacggcgtacaccttctgggcggcgaagcgcggccacgacttcaacttcctgggcccgttcctgttcgccgccgtcatgatcctcatgctcttcgcgctcatccagctcttcttcccgctgggacgcatctcgctgatgatctacggcgggctggcggcgctcgtcttctgcggctacatcatctacgacaccgacaacctcatcaagcgctactcctacgacgagtacgtctgggccgccgtcgcgctctacctcgacgtcatcaacctcttcctctccctcctcacgctcttccgggcggcggattcgtgagcacggctctactcctacctgcctgcctgcgcagccagagaataatgatgttggatttggaatgtgccttgccttgccccgcctctgttaattggtatctgctggaattcagttcctctgtaaagtgaaataattgttttggctacgtgctttgcttcgcttcgaagattgtttattaatttaatggaacttagtagtactaactt

SEQ ID NO: 168 - DNA, 1182 bp, Sorghum bicolor
cttcttcagtcgtctcgcgccttcaacttccaccgaggtccatctacatcgttccaccacctacccctgtaatctcccggccggcgacgtcatcctcatcatcatcatcatccatggagggcaaggacggcaagcacgacgtacccgccaccacggccgcgccaccaccggccggcgcgccgcagcccgcggcgcctgcgcctcccgcggagtcggcgcggtggggcacgcggcagatgggcccgccagcggcccccggggcgcacccggagaaccaggaggcggcgcggtggacggcggcgcgcggggaccaggagctgccgccgtacgtcgtcatgggggagcccgtggcggtgcagaggggcaagggggatagccccatggaacacatcctcgacttcttcaacacctggagccgcaaggccgaggagctggcatccaacatctggttcaatctgaagactgcgccatccatgtctgacgcggcgatggggaagctaagcctgggcgccaaggccctgtccgagggcggcttcgacaagctgtacaagcagaccttctcctccagccccgaggagcacctgaagaagacgttcgcttgctacctgtcgacggccaccggccccgtcgccggcacgctctacctgaccaacatgaacgtcgccttctgcagcgaccgcccgctctccttcaccgcgccgtctggccagaccgcttggagctactacaaggttattatccctcttggcaagatcgcgacggtggagccggtgacgatgaaggagaacccgccggagaagtacgtgcacatcgtcaccgtggactcccacgacttctggttcatgggcttcgtcagctacgacaaggccgtgcacaacctcgtcgaggccgtctcccagcgctcccagtcccagcacggcgccggcgtcaccgctgccggcaccaagtgatgagccaccaccgctcgtgagtcttgggcgttttgcacccgcgtcgtgtatagctccgcctgtgcattacttgtgtgacagggacgaagcctgaaaaaaatttagagaaggctgaacaaaaattctacatcgacctagctctactattatccctcgtaataaaaaaatatattagtttaaagtagtcttagattaaaaatatagaccaataataaaattcacaaaatatatt

SEQ ID NO: 169 - DNA, 1779 bp, Sorghum bicolor
acttcccctcgctcgattcgatccccccgccccgagaagagcaggagcaagctaggcgcaaccgaccagctacgcaacgcaacaatggcttccgcttcctcgaatgccaagcagagcctctacccggatgttgaccagtcccaccctgatctcaacacccccttcttcgcgcccaccacctccaccggcgccggcaccaccgccgtgggcagctccctctaccccaccgtcgacccaaacgagctcgccgagaacctcttccccgagacggccgaggaggacgccgcgccgccgccgcccaccaccgaggagaccgtcgtcgccgtcccgggcgcgcagctccacctcgtcgaccccgaccgcagcctcgacctcggcgctggcacgctctccatcgtgcgcctccgccagggggaccactccgtcgccgtcctcgcgcgcttgatccccgagaagccccaccaacgccgcggcctcttccgcctgtttagcagcgggcggtctgacggtggcgccgagcaggagcccgtccagtggccgctcacccgcgatgtcgccgcggtcaagctcgaccccgcgcactacttcttctcgctccatgtcccgcacacggaccacccggacgacaaggatgacgccgaggatgccgaggcggacgcggaggcggcgctgagctacggcctcacggtcgttgggaaggggcaggacaaagtattggaggagctggacagggtcctcgaggagtacactaccttctcggtgaagcaggtggaggcggcggcgaaggagaagtcggaggtcatggacgcgagggcggtggccgagatcactccggaggaagctgtcggagataagaaggaggtcgtcgaggagaagtcggcggcgttctggacgacaatcgcgccgaacgtcgacgattacagctcgtcggtggcgcggctgatcgcgcggggctcggggcagctagtgaggggcatcatctggtgcggcgacatcacggcggagggcctgcggcgtggggaagaggtggtgaagaagagcgtggggcccagcgcgaagccgacgcaggtgaagcccagcactctcagaaggatgaagagggctaggagggttacaaagatgtccaacagggtggcaaactcaatcctgtctggtgttctgaaggtcactggctttgtcacaagcaccgtgttgaactccaaaccagcacaaaagtttttcaagttaatgcctggcgaagttattcttgcttcacttgatggatttgggaaagtatgggatgctgtagaagtgtctggcaagaacgtgatgcagacatcatcagttgtcacaacttctgttgtaacacacagatacggtgaacaagcaggggaagccacacacaattacctccacgctacaggaaatgctctcggagctgcgtgggctgtattcaagattaggaaagcactcgaccctaagggtaatttgaagaagtcatcttttgtaagccaagcagcgcacactgtagctaaagaatcaattgcgaggcaaaagaagaagtgagctggcctggtcgacagttcgactatgcccgtaatttaatctgttgctcttgtagtatgttagcaataggaactaggaagctagatcttgtgagtttgtgactgttgtcatgaggttttgatctcttctttccttctttttttgggctgtgttcattttgttgtacactgatgttctacatacgtttggtttgtggcacgacagtttcttaaggccttgtttagttcctgtgtg

SEQ ID NO: 170 - DNA, 1755 bp, Solanum lycopersicum
gtacttttctgtttacctattttttctcgaaaaatttcatcttcaacttcactttgatcacttcaatggcttccaaaaaccctaattcctcttcaatgtatccacaagtagcagtagttgaccaaaatgtccctttcccttcatctacttctcgccaaaacctttacccaaccattgacatgaacgaccttgtagaaaatctcttccctcaaaatgaccaaactgcccctgagcgacaacattattcaccatctgcccctcctgaaatccttgaagaaacccttctcgttatccccggttccattcttcatttgattgacaagcactattccgttgaactcgccatcggcgatttattcctacatcgtctccgacaagggaacaatatcgtcgcagtacttgttcgtgttggaaatgaaatccagtggccgttgaccaaggaccttgccgcggtaaaactcgatgattcacattactttttctcatttcaagctcctaaagacgatgaatcggataaagaatcatcagtcagtgacttggcaaatgactcgttgaattatggtttgacgattgcttccaaaggacaggagaaattattgaaggagctggatgacattttggaaaattacagtaactttgccgtgcagaaagtggaggaaaaggccgcggtagcattaggtggaccggtggcgaaggaattgtcaccggcggatttaaagtcggagaagaagaaggaggtgttggaagagagatgtgcggcttattggaccacattggcgcccaatgtggaggagtacaatgcaacagcggcaaagttagttgcttcgggctcaggacacttgataaaggggattttgtggtgtggagatgttactgcagatagattgaagtgggggaatgaggttctgaagaataggtttaagacaggttcgaagactgaggtcagtcctgagacgttgaagaggatcaaaagggttaagagagtgacaaaaatgacagagaaagtggcagttggagtcctatctggagctgtgaaggtttcaggattctttactaggtcccttgcaaataccaaagcaggaaaaaagttctttagcctccttccaggggaaatggttcttgccactcttgatggatttagcagaatatgtgatgctgttgaagtagctggaaagaatgtgatgtctacatcaggcactgtgacgactgaatttgtttctcacaggtatggagaagaagcagctaatgcaaccagtgaagggcttgatgctgcagggcatgcttttgggactgcctgggctgcttttaagatcagaaaggcactgaaccctaaaagtgccttgaagcccactgccctggccaaatctgctgctaaagctgctgctacggctgctgcagctgataagaaggctaagagttccaagtagtcacttattagtctgacctaaccattgaaggtgactcaagataacatgcattgcctctgacctcttcatattttcatgcgtgtatatatactagtgagagcatcaaccacctgctgttaactgtaggcttcctttcttttttaagattaagatttggttatttgttatagtgaatttgatgaatcactggactcgtaaactgtaggtttccattcttttttaacattaagatttggttatttgttatagtgaattagatgaattgctggacttggtgcaagtaacaacaattcacatcagtcatagtttaacaagacttccatctcct

SEQ ID NO: 171 - DNA, 1721 bp, Solanum lycopersicum
tttacatatcaagccacgtggcagccacgtgaactcgtcttcaaccttagaaccgactttttccattttcttataccctaagctaaaacgtacataaatcttgaaaccccatctacacatcttcacaaagttctttcctttttgtgtgtaaatccaaactgggtaatcaagaatccaaaaaaaaaactatggcttctcaaaatccatctcctcccaaattatacccagaagttattgattcaaacccagaatcatcttctccatttattacaaatacccaaaagaacaaatcatcttcttctatgtacccaactattgatatgaaagatctagcagagaatctattcccagaaactgaaaacagtcagcctaatcaaaattccaactttgtatcactggaagaagtgattgtccaaatcccaggtgcgattgtccatctgatcgacaaagaacgtagcatcgaactcgctagtggtgaattcgagattgttcaactaaaacagggcgacaacgttgttgctgttcttgcacgtgtcggagatcagattcaatggcctttagcgagagatgaagctgctgttaagcttgatgaatctcactatttcttcactcttcgtgtaccttctgaagcaaatgatgaagatggatacgcagagaatttactcaactatggtttgacaatagcttcgaaagggcaagaaagactgttaaaggagttagatttagtattggagaagtacagtgcgtttagagtggagaaagtgaagaaggataaaggggttgcagaaaaatggtggatggcgccaaaagatgtttcaccagaagagatggagaagaaaaaggaggatgtggagaggagttctgcggcatactggacaactttggctccgaatgttgaggattatagtagcagtattgcaagaatgattgcagccgggtcgggtcagttgataaaggggatattgtggtgtggggatattactgtggataggttgaagtgggggaatgatgtgttgatgaagaggatgggaaaaggaagtaactctgagattagccctgaggctatgagaaggatgagaagggtgaagaagatgacaaaaatgtcagagaaagtggcaactggtatactctcaggagtagtgaaggtctctggattcttcacaagttctattgcaaactcaaaagctggtcagagattctttagccttcttccgggagaaattgttcttgcttccttggatggattcaataaggtttgtgatgccgttgaagtggccggaaagaatgtgatgtcaacgacctcagtagtgacaactggtcttgttcaacagaggcatggtgaccaggcggcacagatgacacgtgaaggattcgatgctgcagggcatgctttagggactgcatgggcagtgtttaagataagaaaagctctgaatccaaagggtgctatcaagcctactacagttgcaaaagctgctgctcaagctaaccttgctaaactgaagagcaagcagaagtagatccggatgttccacttgccatcatctcttaacttccattgatcacttagttttatttattgcttaattagagagtttgtctttgctttgacagaatgtatgtcaaactttgaatttacaggaatcatagtgtatgtattggctttattactctagtgtggttgcttgaaaattagaaatggaaaaagtagtagtaacttg

SEQ ID NO: 172 - DNA, 831 bp, Solanum lycopersicum
taaagagtaccacattccgaccacgacgacgatggccggtcaaccggagaagaagccagaatctgtctatgactttactctaaaggatgcaaagggaaatgatgttgatcttagtacctacaagggaaaggtcctactgatcgtgaatgttgcgtccaaatgcggtttgactgattcaaactacaaagatctcaaccacttacatgagaagtacaaagatcaaggcctggaaattttggcatttccttgcaatcaatttggtgcacaagaaccagggagcaacgatgagatcgtagaatttgcttgtacacgtttcaagtcagagttccccatctttgacaagattgaagtgaacggcgaaaacacatctcctctttataagttcttgaaatcagccaagtggggattacttggagataatattcagtggaatttcgctaagttcctcgttgataagaatggccaagtttctgatcgctattatcctaccacatctcctctctcaatggagagggacataaaagtgctgttggaaatcgagtagttgccaaggttgagccctcaacaatgtggatggatttcgaacttgttaatgctggcttcgttttattgtagtttgtcccattattaataaattactacatgtttctgaaactgatatccagttatttgatattcctgtcagtttgttttgtttgatgaaagaattataagttcttgatgtttatttgtttcccattgaagctctctatctattgaaggtaggggtaaggtcggcggtatacactatatttcttagacctcacttgttcagcttatctgtttaatata

SEQ ID NO: 173 - DNA, 929 bp, Solanum lycopersicum
gatattattgaccttcttaaaaaaaaatcagctataaatgctttgttctacagctcgcgttcttctcatcccaaagcaaaatctcagtattttaaggcgattttcttcgattctaagacaaacccagttcaattctgtgtttaatcttcctgtttcgtctttctctaagccgatccgaacagttttacccaattctttggttacctctaagggttttgagttgtggggtttaagatcagatcataccatggctagtcaatcaagcaaccctcaatctgtttatgatttcactgtcaaggatgctaagggcaaggacgttgatctcagtatttacaagggaaaagtccttatcattgtcaatgttgcatcacagtgtggcctgactaattcgaactacactgacatgacggagttatacaagaagtacaaggatcaaggtttggagattctggccttcccttgcaaccagtttggtggacaggagcctggaaacattgaagatatccagcaaatggtctgcactcgcttcaaggctgagtaccccatatttgacaaggttgacgtgaatggtgataatgctgctccattatataggtttctgaaatcaagcaaaggtgggttctttggagatggtatcaagtggaacttctccaaattcctcattgacaaagaaggacatgtcgttgatcgctactctccaaccacttctccagctagcatggagaaggatatcaagaaactcttgggtgttgcttaagctctagagtctggactcggcggtgctgtctctgcattttgtgctagaaataatgaacatatcattgcgaataagctatgtttgatgtaattttcttcttgttttagttcctacagatgtttgctactttgtacaatttcaatatactgatcaatatttctatttacaagta

SEQ ID NO: 174 - DNA, 1365 bp, Solanum lycopersicum
gacgcgcaagtaaaccttacaaacgtacaatcagtgtgagaaatagtttgttcaagttcttcgataatttgagagatgtggaacgaggcttaccggaaagatgacgtggagttcggcactgcgcctttgtatccggcgatgttggaaagtcctgaactccggtggtcttttattcgaaaagtatactcgattatttctatacagttgcttctgactattgcggtcgcctctgtcgtcgtcaccgttcatccaatttcacacttctttgcagccacaaatgcaggcttagcactttatattgtactcatcatcactccatttatcacgttgtgcccgttgtattactatcaccagaaacatccggttaactacttgcttcttggattgttcacggtttctcttgcctttactatcggattgacttgcgcattcaccagcggcaaagtaattctggaggcagtcatactgacaacagcggtagtgattagtctgacattatacaccttctgggcggctaaaagaggccaagatttcaacttcctgggaccttttttgtttggtgctcttattgttcttctgttgttttccttcatccagattcttttccctctgggtaagatctcagtgatgatctatgggtgtcttgcgtcgatcatattctgtgggtacattgtctatgatacagacaatctaatcaagcggtacacttatgatgagtacatctgggctgctatatgcttgtatctagacgttatcaatttgttcctctctttgttgtccatcttcagggctgctgacaattaaagagttaaagagaggaatacctaataataatttctctctgcatgtgtgtgaaagttctattatttgtttcctttctcctagttttccccctctcttttgttgtggatggtttgcttattgataattgtatagaaccgttttcttagttggaagaagtagaactgtatcgattttaccaaagatgacatccattgattggggttcctctaattctcctcttctgttgtttgagtcgttggaaaaggtcattaactcaataatcatacacgtccattggtcaggatcaatcactccggtggggttcgttttcaatctatgcccaatttctaactaactaattacttaaattagtggttcgtctttgacatatgcccaacttattatactaatcaaacagttatttggtcaaacgcttgttttttgtccatgcccaatttctaataagctaactgcttatttgcttaaacaaatgacgattatttctcatcaatcatatagttaatgagtggtccattcttgttatatgtccaatttcttaccaattaagtaattattttgtca

SEQ ID NO: 175 - DNA, 901 bp, Hordeum vulgare
caaaaaccaaagctcccatcttttccccttccgtctccgtctccgtctccgtcgcctcgtcttctccgcgatccccaatccctcgatccccgatccgcccgcccccagcccggatccaggcgatggcggccgcgggagacgccggcgagaagaggatggtcacgctcaagagctcggacggggaggaattcgaggtggaggaggcggtcgccgtcgagtcgcagaccatccgccacctgatcgaggacgactgcgccgacaacggcatcccgctccccaacgtcaactccaagatcctctccaaggtcatcgagtactgcaacaagcacgtccaggccaagcccgccgacgccgccggagctggtgcgtccgatgcgccgccccccgccgatgacctcaagaactgggacgccgagttcgtcaaggtcgaccaagccaccctcttcgacctcatcctggccgcaaacttcctcaacatcaagggcctactggacctgacctgccagactgttgccgacatgatcaagggcaagacccctgaggagatccgcaagaccttcaacatcaagaatgacttcacacccgatgaggaggaggagatccgcagggagaaccagtgggcctttgagtagaggagcatgtaggcgatgccatccgcactggatgaacaatgcttagtattagtcatgtctgcattttatcgcccttttttatggttgtttttgtctatcctacagtcggatgaaaaacaaatgggtttcagtcatagactgaaccaaatcatgcataaattggagtcagcctttcaaacagtcagctactttattttgatcatttacagaaacttctactgatctgcagattgcttctttgaatagtattcaactttgaatgaggatcc

SEQ ID NO: 176 - DNA, 813 bp, Hordeum vulgare
gcgtccgatcccccaaagcccccaaccatggattccaccgccgacagcaagggcaagcgtcctctcttccagcccgatgacgtgtctgctgccgcatcggtgccggatgaggcggaggcggagccctcgtcttcttcggaggaggtgaaggagacggagccgggggcacagaagcagcaggaggagaagcccgccctggttctggtggcggaggatggcgtggaggtgcgcatctcggagcccgcggcgcggatgtcgcagatgctccgccacatgatggaggacggctgcgccgacggccgcatcccgaccgccaacatccactccgacatcctcgagatggtcgttgagtactgcgagaagcacgggccctactacgaccccgaggcctctgagcgcgaccggtaccccttcccgcccttcccagtcgagctcacccctaccgtctcctccatcaagcccgtcacctacgtcgacccggacccccacggtctcaaggactgggacagcgatttcatctccctcgacaactccaccctcttcgagatcatcctggccgcaaactacctgaacattgaggatctgctggacctgggcacctcggctgtggctgacaagatgagggggagaaagccagaggagatccgtgaaatctttgagattgagaacgactacacaccagagcaggaggctgaagtcaggaaggagaatgcatgggccttcgaggactaaaatatgacagttgatcttgcttttgtttatgctgctattcttggtttcaagtacaagtccttaccttcagttctgttcgaa

SEQ ID NO: 177 - DNA, 720 bp, Arabidopsis thaliana
aaaagagtcagagccgcctagagaaatcgatcacaaattcagaagaaaagaacagagaaaacagaggaagaggtgagatggaggaacttgtagggcttctgagaatccgagtgaagagagggatcaatcttgctcagcgagacactctaagcagcgacccttttgttgtcataaccatgggatcacagaagctgaagactcgtgttgtggaaaataactgcaaccctgagtggaacgaggaattaacccttgcgttaagacatcccgatgaacctgtgaatctgatagtgtatgataaagatacattcacatcgcacgacaagatgggagatgcaaagatagatattaaaccatttctggaggttcacaaaatgggtttgcaagaacttccagatggaacagagatcaagagagttgtgcccaacagagaaaactgtttggctgaagcgagcagtatcgtctccaataatggcaaaatcgttcagaacatgattcttctgttgaggaatgtcgaatgcggtgaggtcgagattcagcttgaatggattgatattccaggttctagagggctttgaacatatctctttctgtgtgtaataaaaaaaaaactcagttcgttttgggtttttagacaaaagtcacaataagtagaacagagtactactctgttttgtaattgaaatatttggttttagcacctaacctaaatcgttttggttt

SEQ ID NO: 178 - DNA, 1269 bp, Arabidopsis thaliana
tgggaataatataattattatttaaatacagaaacagagcttgctttaccaaataccaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaagatgactcagagtcaaaccaacgacggagctggagctggagctgttacgacggtagaatctgttcctcctcagcctcaatctcagcctcagcctcagccgcagcagcagagcaacgagatggttctgcatacgggaagcttgagttttagtagtcatatgtcgagagaagacgaagagatgactcgttctgctctttcggcgtttagagctaaagaagatgagattgagaagaggaggatggaagttcgtgaacggatccaagctcaattgggtcgggtcgaacaagaaaccaaacgtctctctactattcgtgaggagcttgagtctatggcagatcctatgaggaaggaagtttctgtggttcgtaagaagattgatagtgttaacaaagaactcaaacctctaggttccactgttcaaaagaaggaaagggaatacaaagaagcacttgatacattcaacgagaagaacagggagaaagtacagctgatcacaaaactcatggagttggttggagaaagcgagaagttgaggatgattaagctggaggagctgagcaagagcatagaaaccgtgtgaaaaaggttgttcaagaagaactaattgggttcttttgtgtgatgtacctacctagtttaaaattttcatcatgtaagatgtgtgggttgcttttttttttattgttatagtttttttaaagtctttgggggtttgatttgtaaaatttgtgggttctctcttatttttgattaaccaaatttagggatatgggaaaatgggagattcttaggatactgaaactcatcacagtgattattctttctttctctgtattatgttttgtatctgtcttttgaagaatttattatttttttttggctttttagtaaagtttcttctcgttggcaaagaagaaaagtgactctcgcgtgcgttttttgaaatctaaaagctgtcggaacggcagaatcttttcacttgtttatttgcataaatc

SEQ ID NO: 179 - DNA, 1686 bp, Arabidopsis thaliana
ttgagttataacgtttcggcttcccgacctcaaccgtcttctgctcctccgccccgccacagtttcttagggttcttccgcattgtttctccgaattgcaatcccctcattctccacaataaacagatagctaatataattgagtttggatactcgcaagtgaaaatatgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtggacttccaatgatcctctacgtgaaaaatacaacaagaaaatggcaggcatggatgctcctatcgcaaaaccaaaagggagcaagaagatgaaagattgggagtcttaaaccgcaccaacatttagtttgctttttaaaaaaaatccaaaacgatacagaagtgttatgtggtagtaaaaaacatcgtaacatcttactcagttatgtcttgagtcctctaaatcgtagtaattaaaaatattgctttgtggaagacatctagtcttttgtatcgggatcaattatgcatcaatcaaagctgtctgcttgtattacgaaa

SEQ ID NO: 180 - DNA, 1628 bp, Brassica juncea
actttaactcattacttcgccggaaacaatggctttcactccattgttctctctcctctccgtcatcactctctctctcctcatcaccaccgatgcttcctctcgctctctactaccttcacacgaaaccaccgtcctcgacgttgtctcatctctccagcaaacccaacacatcctctcactcgacccgacccttacctcactcaccaccaccacctccatacccggatccgacccggttttcctcaactcatcttccccactatctctcgagcttcactcccgcgacactctcgtcgcatcacagcacaaggactacaaaagcctagtactgagccgactcgagcgagactcatcccgagtcgccggaatcaccgccaagatccgattcgccgtcgagggcatcgacagatccgatctcaaacccgtttacaacgacgagacctcataccaacccgaggatctaacgacccccgtcgtctccggagctagccaaggaagcggcgagtatttctcccgcatcggagtcggaactccggcgaaggagatgttcatggtgctcgacaccggaagcgacataaactggatccagtgccagccttgctccgactgctaccaacaatccgacccggttttcgacccggcttcgtcctccacgttcaagtctctctcctgctcggccccacagtgcggttctctagaagtctccgcttgtcgctcggacaagtgtctctaccaagttagttacggagacggatctttcaccgttggagattacgctaccgatacggtgacgtttggaaccaacggtaaagtaaacgacgtcgctttggggtgtgggcacgataacgaaggtcttttcacaggagcagccggtttactcggtttaggaggtggagctttgtctatgactaatcagatcaaagcgacgtcgttctcgtactgcctcgttgatcgtgactcgggcaagtcctcgagtctcgacttcaactcggtccaagccggaaccggagacgccacagctccgcttctccgtaacagcaagatcgacactttctactacgtcggactcagcgggttcagcgtcggcggtcaacaagtctccatcccttcgtcggtgttcgccgtcgacgcttcgggagccggaggagtgatcttggactgtggaaccgccgtgactcgtctccagactcaggcctataactcgctgcgcgacgcgtttgttaaactcacggcgaatctcaaaaaggggacgtcgagcatctcactcttcgacacttgctacgacttctcgtctctctccaccgtgaaagtcccgacggtggcgtttcatttcaccggtgggaagacgcttaatctgccggcgaagaattacttgatacctattgatgatgccgggacgttctgcttcgcttttgctccgacgtcgtcgccgttgtcgatcatcgggaacgtgcagcagcaggggacacgtatcacttacgatctagcgaatcatcttatcgggctgtcagctaataaatgctaaaaaggttgaagattagtagttttacagatgtgaagtaaaactctttagttctcggttgtttaatgaaaaaaataaaatatgaagtgtgaatttacttttt

SEQ ID NO: 181 - DNA, 869 bp, Brassica juncea
ctctcttaagaactaagcaaagatcccatctttatccttctcctctatatataagcttctctctgagctctgcttttaccagaaaacatggcatcttattacagattccaatctgggttttgtcctctctcgccttgtccctctcttcttcttggaaacttcgtcgaacggatcaaagacgcttgtcatttcctcgtctccgctgttcttggcaccatcatatccgccgtcttgaccttcttcttctccctagtgggcacattgttaggggcgcttacaggagctttgataggccaagaaacagagagcgggttcatcagaggagcagccattggagccatcacaggagctgtgttctccatagaggtctttgaatcgtcccttgatctttggaaatctgatgagtcttgtttcggatgccttctctacttgattgatgttattgttagtcttctaagcgggagactcgtaagggagcgaataggtcctgcaatgctaagtgcagtgcaaagtcaaatgggagctttggatgcaccctatgacgatctctcgagcctatttgagacaggaggcgcaaagggtttaacaggagaccttgttgagaagatcccaaagttgacaatcactgacaacaataacacagatgcatctgagaacagagagtcctgttctgtttgtcttcaggatttccagctcggtgagacagtaagaagcttgcctcattgtcatcacatgttccacttaccttgcatagacaaatggctcctcaggcacggttcttgtcctatgtgtagacatgacctttaatgtaaaccgtgcagctcagatacgtctacacacagctccttacctctcaagaatctggtctt

SEQ ID NO: 182 - DNA, 489 bp, Brassica juncea
gaaacaaagcgaaaatggcaggaagactgagcggtgtggcctcacgaatcatggggggaaacggcgtcgttgcccgatccgccgcctcttccctccgccaacgcgctggcatgggtctccccgtcggcaaacacatcgtccccgataagccgctttcggttaacgacgagctgatgtgggacaacgggactgcgtttccagagccttgcatagatcggattgctgacaccgtcggaaagtatgaagcattgggatggttgtgtggcggtctagggttctttgctactctgggtatgctcgctgttgtgaacgataaagcttctaaggttccatttacaccacgagtttatccctatgacaacctgagagtggagcttggaggagagccatagagacctgtcaagtgatctagactagatcatctagtcgagcgtgttttcattcacgcttttgttcttcaaaatgttttcatttcgtgctcagaacctg

SEQ ID NO: 183 - DNA, 1582 bp, Brassica juncea
gctcctctctcccctcataaatatctccaccgtcaccactctctctctctctactctttacagccaatcgttatctcgtagagagagaaagcgcgggattctcgttttctgatctcacacttacaaatggcgaacggaggtggtagagtggatctggacggcaaaccgataaagccgatcacgatatgcatgatcggcgccggtggattcatcggttctcatctctgcgagaagctgatgacggagactccacacaaggtgctcgcgctcgacgtgtacaacgacaagatcaagcatttgctcgagccggatactgtcgagtggaaagatcggatccagtttcatcgcatcaacatcaagcatgattccaggctcgaaggactcgtcaagatggcggatctgactattaatctcgctgcgatttgtactccggctgattacaatacgcgtccgcttgatactatctacagcaacttcattgacgcgcttccagttgttaagtactgctctgagaacaacaagcgtctcattcacttttctacctgtgaaatttatggtaaaaccattggaagcttccttcccaaggatcatcctctacgcgaggatccttctttctatgttcttaaagaagatgtttccccttgcatatttggttcaattgagaagcaaaggtggtcatacgcttgtgcaaagcagttgattgagagactcgtttacgctgagggtgctgagaatggacttgagttcaccattgtgagaccttttaactggattggacctaggatggatttcatccccggcattgatggtcctagcgaaggtgtccctcgtgttctcgcctgctttagtaataatcttcttcgccgtgagcctctgaagcttgtggacggtggagaatcacagagaacttttatctacatcaaggatgctatcgaagctgttcttttgatgatcgaaaacccggagagggccaatgggcatatattcaacgtaggcaacccgaacaacgaagtcacagtacgacagcttgctgaaatgatgaccgaggtatacgcaaaagtgagtggagagggggctatagagaccccgacggtcgatgtaagctcaaaagagttttacggggaaggttatgatgacagtgacaagagaatcccagacatgaccatcatcaaccggcaacttggatggaacccgaagacatctctgtgggacttgctggaatcgaccttaacgtatcagcacaggacttatgcagaagctgtgaagaaggcaacatccaaaccagtagcttcctaaaatgttacaagtcccccagttatcaacacagacgccctgatttggcatttttaagaactctattcgattctttgttttttttcacatctcattgactctttttttttttacatttcttgttaagaaaacaatattattacattacgctagttcgccgtttcaagtataccgtctattttttgttctcctctcagctggtgtctttggccatgtatgttgcgtctgtcggaaagcacattgttaatcatttgtggcgaatgaattagacagaaatgttgtgttagta

SEQ ID NO: 184 - DNA, 1574 bp, Brassica juncea
aatcaaactcactcattccatctccatcgtcgttcgattcaaagatcagttccaatggcggataacaccgataaccggagagcgatatggggagttccggagaagcttcagcttcacatagccatgctcacgttacaattcggctacgctggattccacgtggtctcgagagctgctcttaacatgggaatcagcaaactcgtcttccctgtttatcgtaacatcatcgccttgcttcttctccttcccttcgcttacttcctcgaaaagaaggagagaccggcgattactctcaactttctcatccagttcttctttttggcactcatcggaataacagcgaaccaagggttttacttgttgggactggactacacttcaccaacgtttgcttcttccatgcaaaactctgtcccagccattacctttctcatggctgctcttctcaggattgagaaagttagactaaacagaagagatggtatctccaaagtcttaggaacagctctttgcgtcgccggagcttctgtcatcactctctacaagggtcccaccatctacacaccaactagccacctccacgctcacctcctcaccaccaactccgccgtctccgccgtcttagcgccgcttggagacgccgcgccgaaaaactggactcttggctgcatctacctgattggtcactgtctctcctggtccggttggctcgtgtttcaagctccggttcttaaatcttatccggcgaggctctcggttacgtcttacacttgtttcttcggaatcattcagttcttgatcattgctgctttctgcgaaagagattctcaggcttgggtttttcactccggttgggagcttttcaccatcctctacgcaggaatagtggcgtctggaatcgcgtttgcggttcagatttggtgtattgacagagggggtccagtcttcgttgctgtttaccaacctgttcagactttggtcgttgccattatggcttcgattgctttaggcgaggagttttacttgggcggtattattggagctgtgctgatcatagcgggactttactttgtgttgtacggtaagagcgaagagaggaagtttgcagctcttgagaaggcagcgatccagtcctccgcggagcatggtatagagcgtgcacccgtttctcgcggctccatcacaactccactgctccatcagtcaacgaacaacgtttgactaatggagtattcctcaataattacaaatgccattacccaattaaaagggggaacaatggtgtgccgttgtgttttatgacttttgtgtctgcttttttctttattttagtttttttttcttgatatttaattacctacgaaaggtttttgagagggaaaatggtggatgagacatcattgttcatgaggatggtggtgatgatgatgttgatgatagtgatgatgaagactatgggaactttggactgggacttctcaatattattatatttggctgaaatatttatgccttttattacatttcttgtggtttttcttggcttttctatcatcaatagaacgttataattt

SEQ ID NO: 185 - DNA, 1661 bp, Brassica juncea
ataaatacatttgtttaaaaatggcgatgataggcttacttgaagtcttcgcagcattcctttttttcctagtattcaaacatttcttcctccacaagaaatctcccggccagcctattatcaaaagctggcctgtcctcgggatgcttccaggaatgctcccccatatccctcgtatctttgagtggacgttcgaagttcttgaggccaccaacttaacttttttcttcaaaggcccgtggcttagtggaacggacatgctattcactgccgacccaaggaatatccatcacatactaagcttaatctctgggaattaccccaaaggacctgagttcaagaagatcttcgatgttttgggagacgggatcttaagtgttgatctggagctgtgggaggatctgaggaagtcaaatcacgccatctctcatcatccagatttcttgaaactctcagcaagtagcaatacactcaagttaaaggaaggtcttgttccttttcttgataatgctgctcatgaaaacattgtcatagacttacaagatgtattcaagagattcatgtttgatacttcttcgatttcgttgactggtttcgacccaatgtcactatccaccgagatgcccgaagttgagtacggtgaagctgctgaaaccggtgaagaagcgatctattatagacatttcaaaccggtcatcttgtggaggcttcaaaactggttgggtattggactcgagaggaagatgaggtcttccttagtgactgtcaaccgtatgtttgcgaagatcatatctacaagaagagaggagatacgtcgcggggaaggcgtgcaatcaatggacgcgttaacgtactatatgcacgtggacacgaccaaatataagctcttgaaaccaagtgatgatacgtttattagagacgttgctttcagtctagtgttggctggaagggacaccacaagctcagttctcacttggttcttctggcttctttctaagcatcctcatgtaatgaccaaaatccgacaagagatcaacacaaagtttgatccgacagatctagagaagctcgtgtatctacatgctacgttgaacgaaacaatgagactttacccaccggttcccttcaaccacaagtctcctttaaagtcagatgtgcttccaagcggacacaaagttaaagcagaatcaaagattgtgatctgtatctacgcattgggtagaatgagatctatatggggagaagacgcattggattttaaaccagagagatggatttcaaaaggtggagagctaaaacatgaaccttcatacaagttcatggcttttaatgctggtccgagggcttgcttgggtaaacatttggctctctcgcagatgaagatggtagctgtggagctcatacaaaactatgactttaaggtcactgaaggtcacaagattgaagcagtgccttctatcgttctccgtatgaaaaatggtcttagtgtcacagtcactaagaagatgtgattcttattgataattggattactagtatttatgtgtttgttcggcgcaaatgtcatctaaagtattatttgtagttgtgttatttgtattatttataagtgtgtctctatttctattactatgtttgttccccgcaaatgtcatctaaag

SEQ ID NO: 186 - DNA, 1315 bp, Brassica juncea
ggatcactaaaaccatatagtataagcttttttgatatatatttatattcttgaagcttttgtcatgtcgtacgagaaagagctagccgctgcaaagaaagctgtttctttagcttctcatctcagccaaggagtacagaggactctgttacaatccgaagtatggacaaaatccaacaaaactccggtcactgcagctgattatgggtcacaagccgtggttagtattgtgttagagagggagctcaaacctgtaaccctctcgttagtagctgaagaggtggatactggagatctgaggaagaaaggaagcgaggtgtttctagaaggtataacaaagcttgtgagagatgctctagcttctgatgaatcgtacgcagactctactataaccacagaggacgtgttgaatgctatagactgtggtcaatcacaaggaggtagcaatggttgtcactgggttcttgatcctatagatggaaccagaggatttgtaagaggagagcaatacgctgtgggattagccttgcttgtggaaggtaaagtggtggtcggtgtcatggcttgtcctaatcttcctctgtcttctgcggttgttgagagagacgacaagtcttgtcaggacaacgttggatgtctcttctttgccacaactggttcaggagcttacgtgcaaccgctcaatggcaattctccaccacatgaggtgagagtgagtagcaatgagaatcttgaagaagcaaagtttttagaatcataccacatgccaattcccctacatagttccattgccaagaaacttgggatcacagcgttacctgtgaggatagatagccaagcaaagtatgcagctgtgtccagaggagatgcagagatgtacttgcgtttcactcttgttggataccgtgagtggatatgggaccacgccgctggttccatcatcacaacagaagctggaggtgttgtttgcgatgctgaagggacacctctggacttctcaaaaggaaagcgtcttgatcacaacagagggatcatagttaccaccaagaaactcaagccattgattctgaaagctgttagagaatccatggaagaagagaatcttcgtgtctgagacacaactgaaactctacttgtatttgtatttgtattttgtctgaactgataaattgtgtgtgtattgcctagttctttgtattgtctacgtgttagatgtgtaatatatgtgtgcttggaggtcaagattctactttgtttctttgagaaagcgattgatgatcacttttgtcttcttgcgaatattactagaaggtga

SEQ ID NO: 187 - DNA, 3420 bp, Brassica juncea
gcctccgacagtagctctccgccgggtaatatttttcccggtagccatgcttcgaactgcctcttgctcagcttctctcacctccgcctctcccttctttcgccacttccctctctcttactcgtccctgtcatcgtctacaggcgctctccgagcccccggtcgcaaccttcgccgggttgcctctcctgcatccaccggaagacgtgtctttctccgacgtgggttgagggttccctccaccgcaggtcgcggagtcaataggcaactctctcgcctctctgttcgggccgttgccacacaacccgcaccatcttatcctgatgtaggccaagatgaggctgagaagctcggatttgagaaagtatctgaagagtttatctcagagtgtaaatcaaaggctactctcttcaaacacaagaaaactggttgtgaggtgatgtctgtgtctaatgaagacgagaacaaggtgttcggtattgttttaaggactcctccgaaggattcaactggcattcctcacatattggaacacagcgttctgtgtgggtctagaaagtaccctctcaaagagccatttgttgaactgcttaagggaagtttgcatacttttctaaatgcattcacatatcctgatagaacctgttaccctgttgcttccacaaatacaaaggatttttacaatcttgtggatgtatatttggatgctgtcttcttccccaagtgtgtggacgacgtccacacttttcagcaggagggatggcactatgagcttaatgatccctcagaagacatctcttacaaaggtgttgtctttaatgagatgagaggtgtctattcacagcctgatattattctaggccgaattgctcaacaggccatatctccagataatacatacggtgtcgacagtggaggtgatccaaaagatatccctaatctgacgttcgaggaattcaaggagttccaccgtaaatattatcacccaagcaatgccagaatctggttctatggagatgatgatccactccaacgccttcgtatcttgagtgaatacttggacatgttcgaagcaagtccatctcgagacacttcaaagatcgaaactcaaaagctattctctgagcctatcaggatagttgagaaatatcctgctggtagagatggtgaccttaagaagaagaacatggtgtgcatcaactggctgttgtctgagaagcccttggatttggagactcagctcgcgcttgggttcttggatcacctcatgcttggaactcctgcttccccgctgagaaaaatcttgttggaaagcggtttaggagaggctcttgttagtagtgggatgtcagacgagcttctgcagccccagttcagcgttggtatgaaaggtgtgtctgaagataatgttcagaaggttgaagagttgataatgagtacactgaagaagttggcagaagaagggtttgagagtgatgctgtggaggcgtctatgaatactattgaattctctctgagggaaaacaatacaggatctttccctcgtggtttatctcttatgcttcagtctattgcaaagtggatatacgatatggatccttttgagccattgaagtatacagaaccattgaaagcgctgaaagccagaattgctgaagagggttccaaggctgtcttctccccactgatagagcagtttattttgaacaactcgcatcgtgtgaccattgagatgcagcctgatcctgagaaagcttctcaagaggaagcggaagagaaaagtatcctggaaaaggttaaagccggtatgacagaagaagatcttgcggagctagcgcgtgctacagaggagctgagattgaaacaagagactcctgaccctcctgaagcactgagatgtgtcccaaatttgaacttgagtgacatcccaaaagaacctacttatgttcccactgaggttggagatattaatggtgtgaaggttttgaggcatgaccttttcacaaatgatattgtctacgctgaagtagtctttgatatgggttcgccgaaacatgagcttcttccacttgtaccacttttctgtcaatcactactggagatgggcacaaaagatttgagttttgtgcaactgaatcagttgattggaaggaaaacgggaggtatatcagtttatccccttacctcatctgtgaggggcaaggatgaaccgtgcagcaaaattattgttcgcggaaaatcgatggctggacgtgctgatgacctttttaacctgatgaattgcttgttgcaagaggttcaattcacagatcatcagcggtttaaacagtttgtctctcaaagcatagcaaggatggagaaccggttgagaggaagtggtcatggagttgctgcggcaaggatggatgcaatgttgaacattgctggatggatgtctgaacagatgggtggtctcagctatcttgagttcttacgcacgcttgaaaagaaagtggatgaagactgggaagggatatcatcctcacttgaggagataaggagatctctcctcgccaagaatggctgcatagttaacatgactgcagatggcaagtctctcaccaacatcgaaaaatctcttgagaagtttctagatttactccctgaaaacccctctggtgggctagtcacttgggatggtagactacctctgagaaacgaagccattgtcataccaactcaggtaaactatgttggcaaagcaggtaacatatacagcacagggtatgagcttgatggaagtgcatatgttatatcaaagcatattagcaacacttggttatgggaccgtgttcgtgtaagtggtggtgcatatggaggtttctgtgatttcgattcgcattcaggagtgttctcgttcttatcgtaccgtgatccaaatttgttgaagacacttgacatatatgatggaactggagatttcttgcgtggtcttgatgtggatcaagagacgcttaccaaagctattattggaaccattggtgatgttgattcgtaccagttacctgatgccaaaggttatagcagtttgatgaggcatttacttggagtaactgatgaagaacggctaagaaagcgtgaagagatattgacaacaagtttgaaggacttcaaggatttcgccgaggcaatagatgtggttagagacaatggtgtagcggtggctgtggcatccgcagaagacattgatgcggctaacaatgcacgctccaacttttttgaggttaagaaagctctctaagctgagaactcctacactttatatgatttagaatctcattagatttgatctttgctttagcctttctctactggagtgtccttgctatgtgaaaattattacagtatgtgaaattcaaagcattttataaagatacagta

SEQ ID NO: 188 - DNA, 3366 bp, Brassica juncea
atcgcgaaaggtaaaactgtgagagtgttcttacgtcttacggcggaggacggcaaagattcttcggcgtgcgacggttgtgacggcagaaaatgaaagagacgaggatttcctcgcgaaaaaggcgtgctgacaggggagaagacaggagaaaagacaaagagaaggagcaagcaggggggggagtggtgaatgagagattaccgctgcgtttgtttgcaacagaccgttatccgagcaaacgacacaactgtaactcttcgctagagtatctccttctggtgagggatgtgcttgagggaactgacgagatggagcagatgatggtttcgcgtttcggccacctattcaggttgcctttgcggaggtgtgctttttcggggaagctagtgcatgggatgcttacaaggcagctggtgacgaagaagaggtttgagttgtggccggtgttcggaggtatgccgacaaggttttcactggctgaatttggtcacgttacgggactgccttgtggagagtttgaagctgggtacgtagttgatgaccagacccgacctaagaagagcgactatgcgtattgggacatcctctttggtggcaaacgagatgtaacaattgcagatgtggcggctatggttgcaagtgataaggagatgcctgcatctaggaagttgaagctgtgtcttataataattgtcgatggtgtgttgcttgcgaccacccagtatccgaagccaacggtaaagcatgttaagcgtttggcgaacctgagaagttttttgtcatttccgtgggggcgcgagtccttctggtggacaataagcagcatgctaccgccgccgagggtgatgggtagatgcgatgatcctgagggagagttttgccggaagctgcggcagaaaacgttaagtttggctggtttcccgctagcattgcagctatgggcatttgaagcgattccagggttagtaaagcgtttggggggaacgatcagcaggattttgttgagttatgcaggggaaaagctcccacaacacactggattgtcgttgagtgcggtcctagatgccgagtttgatccagagctaagcgtgcagccgatggtggaagtagctgaggataaggaggaaggatggggagagtttgactgcgagattaacgataggaaagttgtctatatggttgagcaattaaagaccgggcatagatttgagaaatgggcttggggcggtggtgattcaggcgagccagagtatgtgcatgaagtagttgagaaggagaaggagaagaaaaggaagacaaggcatcctggcaacaaggaagttgaagcgccggttcttaagcaaagaaggttgagcaggtattttaaccggaaaggagacggtgatgggggcaggttagccgctctggaggtcaaaatggaggagatgagtggagtggttgctgatctgaaaaagattgtggcaagacagggtaggatgttgcgtaagaggaggacactagatcgcaagacggggaagttctcgcgcagcatgttatctaggcagagaaagagtcaaaggaatgttgcgacaggacagaggaggctgtttgatgaaagtgatgcaaaagattctgaggaagagggagctctggataaggaaacagattttggggggaatgacagtgagccggaggggatgaaagaaagcgcaatagtaccgctgaaggtggctaagaggggggatgcgacaaaagatgggcatcaggtatacttcggcagcagcagcaacacattttacgttacggaggataaggatggtgatgtgagtggagacataggaattgaaggggcagcggcagcatgtggaacttatgtggatcttgggggattggatcaactagtgggggcaattgtacatggagcagaggctgagggaaagggtggtgagagcaaaggggcggatgttgaagacaaatgcaggggtcagaatgtaccagaggtggaaaaagaaaaggatggtaagaggcaaacggtaggagatggcgcggctaaagaggatgcagtgaatagagaagagggtgagcgggaacgtaagattggggaagttgaggagaaggaaatggtggcagggaaaaaggatggaagtgttgataagaagggtgaggatgatgagggtgaggccggtagggaagatgttgcggcgaagggagaacgtggaagcccagaacaacaggtgcccgcaactgaagctgatgattacagtagagacgatgagcatggcttagatgcagctgatgaagtgatggaattgagtgattcatcaccatgcaagagatcagcgaagcatgagccggctgagagggagggagacttagcatccctattgttggctaaggagtcgtttactttggacaaaatagtaccagagaccgaagatggtgattttccatttttcgaacgtgtactgcttgcaaacccgaaagtgttgcatctcaatgctggagaatatgatctggaaaatcacttttttttggatcttgcaacggcagagaaatgggtgtcaacaaagcacatggaagttttggttgattatgtggccagcagacatgaagaaaggctgaaagaaaggcgaagtcttttcctgccgccttggtttgcagcccatttgcaagggaaaagtaggcgtttcaacgctgcgagggccaacaaaggaaaggtgttggttgatggtaggctgacgggattattaactaaggaagggaagagatggggtcacgaagtggataggttgtacgctccgatgatttgggatgaaaaccactgggttggactctgtataagtttggttgattggcgtgtgcttgtactggatcctaacccagggctaagggatatgtcagcggtgggaattttgatggatccagtgttgaagatgctgccatatctggtggagaaggtatgtccaccacctgctgaaggggcatacaagttggatccatttaactgtgaaagaatgggtggtgtgtacgagaacacccgaagtggcgattgtgggccagtttccataaagtttatggaattgcatgctgtagggaacccacatcctggaatggaaggcttgagcgatgcgctggtggacatcatgaggaagcagttcgcaatggatgtgtacaaggattgggtagtaccactgtacattgggggatgatagagttttctctatatgtatttgttgtatggtaattggaaggttttagtttgtggtagattttgtatgatatggacgaaaatggtttgtaaggatgatgctttaatttctgatttggtttgaacttctattaaaaatgtcactatttgctaaaaaaaaaaaagaagtactctgc

SEQ ID NO: 189 - DNA, 1832 bp, Brassica juncea
gtccttcatcgtctctctctgcgcctctctctgaaactctcagtttgtagctcacagctcacagacaatcatggggaagaagaagttcatcgacaagaaaaaggcggcgactttcgagctctgccctcgcgacacctcagacccattatacagcgacgcaccgggaggtgataagatcttcttacgagtcgatcagaaccctgtgaacatcaacggtttcactgaagaaggagacaactcacagttcgatgacgcccctgaagaagaagaagatttggcttatgggtactccagtttcgtgggttcgagtagcaacaaccctttacccgctgatgtgaggaaggagattctcgagctgggttatcctgatgacgggtacaactacttggaccatttgagagagattaagaacactggcggcggttctaacttctacgctaaccctaagttcgaaggtgagtatcttcctcgtgacgtcaaggcttatgatgcgtctcgtgttaaggtatctggcgtggtggtggatggagatggtggtgaggatgataagttgatgtatagcgtggcgtccaagactgttaatgttaaggtgaagaaggctattgatcctgaagttgctgctttgcttgaggacagtgatgggtctgagtttggttctgatgttgaggatttggaggaggattttgttgtccgagctaatcttgctgaagagggagagggttgttctggtgtgagccatgaggaggagtttgctagacctcctgtggcggctgagaacaacccgagagttcctcgtcagattgatgagttgtttgatcagcttgagcttaatgagtatggaagtgagagtgactatgatggagaagaaggagaagagttcaaggcgcagagcgttggtgatcttatttacgagaagccgaaagattacgagctcgatgagaagtatatgaaccctgcggatctgttgaagaacagtgactctgtgaaagataaagaggagcttgagtacatcatccgcaggtctgtacaatacggtgagaatttggtaaacagcaacgaagatgagtttgtggaggtggttgaagaaagcagcgacgaaagcgagaagtgggattgcgagaccatagtcacaacgtactcgaatctcgataaccaccctggtttaatctgtgatccagatagagctaggaagaagctgagcgaagcgctagctaaagcaaagagtttgaatggtggtgggagtagaatcattaccctccaagggaaagagaagcttccggttgagtttttacccggtaggagagctgagcaaaccagtgtcaaaccgaaagctgaaccggtcaagaggaagactcatgggcaagagacgaaagaggagaagaaagagaggaaagctgctgtgaaaacagagaagagggaagcgaggaagatgaagaaagagacaaaggagctttatcggtatgaaacgcagcgtgctcagaaagctgttgctgtttctggtccatcttctattcctctttaaggtaataatactaaacgtttcccagagtctcttctgttaaacaaccagtttttttttaatatcatttcacaaactggtttcacaaaaaaaaaacaaccagttttttttatatcgtttcatgtaatattttgtgttttgttctaaagattttgaatctctttttgtatgcggaaaggtttagttgtgtttcaattaacgatttatgttctggctttatttgttatacaccctttattttcgtaattagtggccatgaacaataaaatcttggaactattgatgatcaagcaataatgttggtttataaaga

SEQ ID NO: 190 - DNA, 1361 bp, Brassica juncea
ttatttcgggtttatgccttcctaaatcccttaagccattacttccagtatttttacagggtctaattagtggatcagccgagttaagagagcaagctgcacttggtcttggtgaacttattgaagttactagcgaggaagcattgaaggagttcgtcataccgataacagggcctcttattcggatcataggagatcggtttccatggcaggtcaaaagcgctatcttggctacattaatcattctaatacaaaggggtgggatggcacttaagccgttccttcctcaacttcaaacaacatttgtcaagtgtctacaagactctacaaggaccatccgttctagtgctgcgcttgccttggggaagcttagtgcattaagcacgaggattgacccattagttggtgacttgacgactagtttcgtggctgcagattctggggtacgtgaggccattctatctgctatgagaggtgtaataaaacatgctgggaagagcattgggcctgctgttagaatacgcatttttgatctcattaaggaactaatgcacaatgatgatgaccaagttcgaatttttgccactagcatgctgggtgtcttatcacagtacctagaagctgcacaagtcagtgttctgcttcaggaaatcatttctttatctacttcaccaaaatggagctctaggcatggctcagttctctgtattgcttccttgctgaagcacaacccttcgaccattatgacatctccactcttttccgcagtgttaaattctcttaagagctctttgaaagacgagaagtttccattacgtgaaacctcgacaaaggccttgggaaggcttttactacatcaacttgagatggagccttccagcacagcaagagtggttatcgatatcctttcatcgatagtctcagctttgcatgatgattcgagtgaggtccgaaggagagctctctcttcacttaaagcttttgcaaaaaataacccggcagcaaccattgccaatgtcagtgttatagggcctccgcttgctgaatgtttgaaagatggaagcacaccagtgagacttgctgcagaaagatgtgctatgcacgtgttccaattaacaaagggcgcagaaaatgttcaagcagctcaaaaatatatcacaggattggatgcccgacggttatccaagttgcctgaacagagcgatgacagcgacgatagtgaagatgataatgggcgtgggtaggaggaaactgttctctccacttcgtagaagaggttcattggttttccctatacgcatttctgcaaaagcattatcccgtgagttgcggatgatacttgatctggattcattggcatg

SEQ ID NO: 191 - DNA, 1227 bp, Brassica juncea
attgcaactgaattagcagaggaggaggggaggggaagggagattcatggctgaacatcatcatcgcatcagagtctacttagcctctgctatcttacttttagcggttattaatacgggaattgcagcagagaatctttcccagcagaagctaacttcacgaattcttcagaatgagattgtgaaagaagtcaatgagaatccaaacgctggatggatagctgctttcaatgatcgctttgctaactccaccgttgcagagtttaagcgcctcctcggtgttaaaccaacacctaagaacgagttcttaggcgtacctgttgtaagccatgacattgacatctctctcaagcttcctaaagaatttgacgctagaactgcttggtctcagtgctccagtattggaaggatcctagatcagggtcactgcggttcttgctgggcatttggggcggtagagtcactgtctgacaggttctgcatcaaatataacatgaatatatctttatcagtcaatgatctcttagcatgttgtggattcctttgcggtcaaggctgtaatggtggctaccctatttccgcgtggcgatactttaagcaccacggtgtagtcaccgaagagtgtgatccatactttgacaatactggatgctcacacccgggatgtgaacccgcttaccctacaccaaaatgtgtgaggaaatgtgttagtggaaaccagctttggcgtgaatcagaacactatggtgttagcgcctacaaagtcagacatggccctcaagacattatggctgaagtttacaaaaacggacctgttgaggttgcctttaccgtttatgaggactttgcgcattacaaatctggagtgtacaagcacataacaggtgcaaacattggaggtcatgctgtcaagcttattggctggggaacttctgatgatggcgaagattattggttgcttgcaaatcaatggaaccgaagctggggtgatgatggttacttcaagatcaagagaggaacgaacgaatgtggaatcgaacacggtgttgtcgccggtttgccttcagacaggaacgtctttaatggtattaatacatcagatgatgttctagtttcctcattttaaaactaaaaatcagaaaacaaaagacgtgtttccgtcacgacactctccgtaatatatgtaatttgcttcctgtttccaatgaaaagaatcaaacgacttca

SEQ ID NO: 192 - DNA, 2822 bp, Brassica juncea
aaaaaaaaataatccgacatgatctaaagatcttctgcaaactactacaatcctttcttataccaactgagctaaaaggtcggttgctttttttttttttttttgaacacaaacttactttcattcataatcaaactttttcactacaataacaagagggaattatacatcctctttggccataaagataacatacaccacataaatagtctaagaaagataagtcttcaaccgaagatgacagcgaattcgagacgaaacttgaatgcgtcgagtgagccttcacgacaaagtcggacagttggaaaatagtcacagaatgtgacgttgaggtccagacctcatctacgagaactaccgaagtagtctcggttgcatcttcagatcccgtggagatcgctacgcaagatgacaaaccgatgagagaactgaagcaaacactcggcaacgacaatgaaaccgaggaggaggaacgaaggataaccaatcccggtgaacccaccggtaagacccagatatgtagaaaaattagatttagagcttctcttgaaagaacgaaaaacaaaagaaagaatgaagtctttcgcggcgaaggtggaagatggagtgagaggggaaaacgggaagccgtcggtaggtccggtgtaccggaatcttttgtcggaaaaaggttttcctccaatagattctgatataaccactgcttgggacattttcagtaaatcagtcaagaaattccctgacaacaagatgcttggatggcgtcgaatcgtcgatgagaaggttggaccgtatatgtggaaaacttacaaggaagcatacgaagaagttctacagattggctctgcattacgtactcttggagctgagcctgggtgtcgagtggggatctatggagttaattgtcctcagtggatcatagcaatggaggcatgtgcggctcacactctaatctgtgtacctctatatgataccttgggttctggagcagtggattatatcgttgatcacgcggaaatcgattttgtattcgtccaagagaccaagattaaagggactgcaaaatgtgctagacggctaaaagctatagtttccttcactaatgtgagcgaagaacataacctcaaggcttcagaagtcggagtcaaaacgtactcttccttcgattttctccaaatgggatgtgagaaactggaagagactaccccgcctaagccgtttaatatatgcaccataatgtacacgagcggcacgagtggtgaccctaaaggtgtggttttgactcatgaagctgtggccacttacattgttggcatggatcttttcatggaccagttcgaagacaagatgacagatgaggatgtgtatctctccttcttgccgttggctcacattcttgaccgtatgaatgaagaatacttcttccgcaaaggggcttccattggctattaccatggagatttgaatgtgttacgcgatgacattcaagaattgaaaccaacttatctagctggagttccaagagtgtttgagagaatccacgagggtattcaaaaggctcttcaggaacttaacccgagaaggagatttatcttcaatgctctctacaagcataagcttgcatggttaaatcgtggatactctcatagcaaagcttcacccatggctgacttcatagccttcagaaagattagagataaattgggaggtcgaatccggttgcttgtatctggaggagcacctttgagcacagagattgaagagttcttgagagttacttgttgttgctttgtcgtccaaggctacggtctgacggagacgcttggaggaacggctatgggcttcccggacgagatgtgtatgctagggacagtcggtataccggcggtttacaacgagatacggcttgaggaggtggctgaaatgggctacgacccacttggtgaaaatcctgcaggcgagatctgtataagaggaaaatgtttgttttctggttattacaagaaccctgaacttacccaagaagtcatgaaagacggatggttccatacaggagatattggtgagattcaatcaaatggagtacttaagataattgatcgtaagaagaatttgatcaaactctctcaaggggagtacgttgctcttgagaacttggaaaacatctacggtcaaaactctcttgtccaagatatgtgggtttatggagacagcttcaaatcaatgcttgtcgcggtgattgttccaaaccaagaaaccgtaaaacggtgggctaaagaacttggttttactaaaccattcgaagaactatgttctctctcggagttacaagagcacatcatttcagaactgaagtccacggcagagaaaaacaagctaagaaagtttgagtacatcaaagcagtgacagtggagacaaaacctttcgacgtagcgagagacttagtgactgcaacgctcaagaaccggaggaacaacctgctcaagtattatcaggtacaaatcgacgagatgtacaaaaaattggcgtcaaagaaaatctgaaagtgttgcgctgatgtgtgtgctactattgataattatgttatatataatgccaataattgatagacatgagccttatgctttctgtaatgaagataaagatgaggaaactcatatcttcgtttgatacagtttagtacgtcatgcatgtgagttgtaacaaagatagttgatgaagcaacttatattcataaaagtctctggtagtaaacacttgactctctttgttaaggaaccagtgggtctctctaagtttgccttttggtcatatacttttt

SEQ ID NO: 193 - DNA, 2431 bp, Brassica juncea
acactctcagacgaccacggtggctcttggtttatccgagaaattagggtttaccatcggcgtgggtttacttccggcgaagaatgggtacttcggtgcaggtttctccactgtgcggagtttacaacgagaatccactcgcatacttggtctccatcgatggcttcaacttcctcctcgactgtggttggaacgacctcttcgacccttccctcctcgagcctctctccagggttgcttctaccgtagatgcggttttactttctcatccagatacgcttcacctcggtgctcttccttatgctatgaagcagcttggactctcggctcccgtttacgccactgagcctgttcacagactaggtctcctcactatgtacgatcagtatctatccagaaagcaagtctccgactttgatctgttcacgctggatgacattgattcagctttccagaatgtcatcagattgacttactctcagaacttccatctttctggcaagggagagggtattgtaattgctcctcatgttgctggacatatgctgggaggtagcatttggaagataacaaaggatggggaggaggttgtgtatgctgttgactacaatcatcggaaagaaaggcatttaaacggaactgttttacagtcttttgtacgacctgctgttctgattaccgatgcgtacaatgctctttataccaatcaaacccaaagccatcacagggacacagaatttctagataccatttcaaaacatttggaagttgggggcaatgttttattgccagtagacactgccggtcgagtcctggaacttctcttgatacttgaacagcattggtcacagagagcttttagctttcccatttactttctcacatatgtgtcgtctagcacaattgactatgttaagagcttcctcgagtggatgagtgactccatttcaaagtcctttgagacttcacgtgataatgcctttctattgaggcatgtcactctcttgataaacaagacggatctggataatgctccacctggtccaaaggttgttcttgcgtctatggctagtcttgaagctggttttgctcgagatatattcgtggagtgggccaatgatcccagaaatttagtcctctttactgaaacaggccagtttggcactttagctcgtatgcttcaggcagccccacctcccaaatttgttaaagtcaccatgtctaagagggttcctttggccggggaagagttgattgcatatgaagaggagcaaaacagacttaagagagaggaagccttgcgagctagcctcgtcaaagaggacgagacaaaagcttcccacggacctgatgataattcaagtgaaccaatggtcatagataccaagactactcacgatgttgttgggtctcacggacctgcatataaagatatattgatagatggatttgttcccccatccagcagcattgccccaatgttcccattctatgatagcacagctgactgggacgagtatggggaggtcattaatccagatgactacgtgatcaaggatgaggacatggaccgaggagcaatgcatgcaggaggtgatgtggatggaaggcttgatgaggcaactgctagtctcatgctagatactagaccttcgaaagtcatatccaatgagctcattgtgactgttagttgttcactggttaaaatagactacgaaggtcgttcggatggtcgctcaatcaagtcaacgattgcacatgtttctcctctgaaacttgttctggtgcacgcaacagcagaggctacggagcatttgaagcaacactgcttgaacagcatctgtccgcacgtgtacgctccgaaaatagaggaaaccattgatgtgacttctgatctatgtgcctataaggtccaactctctgagaagctgatgagcaatgtgatcttcaagaagctgggagattcagaagtagcatgggtggattcagaggtagggaagacagagagcgagaagcggtgtctgcaaccaatggcaagtgcagctgctcctcacaaacctgtgctagtgggagatctgaaaatgcaggacttcaagcagtttctgtcaagcaaaggagttcaggtagagtttgcaggtggaggagctttacgatgtggtgaatatgtcactctaaggaaggtcggtccaactggtcagaaggggggagcatcagggccacagcaaatcctgatagaaggaccgttgtgtgaagattattataaaataagggactatctctattctcagttttacctcctctgatggtataagagagaagatacaatttcttcttctgttgtttccctttcgtttccaacacttttcaactacttcagtgtaatcttctttgttttgaataacttaagtgtaatctttacaatagtcgatga

SEQ ID NO: 194 - DNA, 531 bp, Brassica juncea
ggcgtttggaacctttaaaatctaatgcacaccatcaatcttcttcattgtctcttggcctttggcttctgtaagggagagatctctctccagctctcttgtttcgctacgcgggttttctctgcctaagctcaccatcatgactcgaggaagccagagagagcgagaccgtgaaagggctcaagctcgtgccggaggcaagggaaagaccaaagacgatggtctaactccagagcaacgccgtgaaagggatgcaaaagcattgcaagagaaggcggcgaagaaagctgctcaagctgcaggagcagctacttccggaggaggaggcaaaggaaacaataataagaaatgatttgtgtttttgtaactttctttcttttgaaatcgggtattgtttgtatgttgagctgtgctttttaatgacttgattgtttgtggtgtgaggtgttttgctctcttttaatggaatctattttcgatttgaacatgacactttgagaatactaagacagtatatttttctaaacctca

SEQ ID NO: 195 - DNA, 2504 bp, Brassica juncea
ctagtcctgcaggtttaaacgaattcgcccttggacactgacatggactgaaggagtagaaaagtttttttttttggttagtttaaaagattcattttctttgaacaaatcgagattcttccttgtctgaagattctttctataaacaagtgatcgaagaatctttcaactaccactccctacatatttccgaagaaacatatccacttttccatttacaacaatataaagtgcgaggaagaagaaagaagatatggccacgtgtcctcctttcgacttctcggcgaaatattacaacggtggcggaagcggatgcgagaggcggagcagcttcttcggagatactacggtgctcgaccaaggcgttgggtacgccgttattctcgggtttggtgctttctttgccgtcttcacatctgtgttggtttggttagagaaacgatatgtgggggctcaacatacctctgaatggttcaatacagctggaagaaacgtcaagacaggactcattgcgagtgtcattgtgtcacagtggacatgggctgcgacaatactccaaagttcaaacgtcgcatggcagtatggtgttggcggaccgttttggtacgctagtggggccaccatacaggtactcttgtttggtgtgatggcgattgaaataaaaagaaaagctcctaatgctcacacggtctgcgaaatagtgaaggctcggtggggaaccgcaacacatatagtgttcttggtgttttgtctggcgacaaacgtggtagtgacggctatgctattgctcggtggctcggccgtggtgaatgctctcaccggagtgaatatatacgctgcaagctttctgattcctctcggtgtcattgtttatactttggcaggaggacttaaagctactttcctcgcaagctatgttcactctgtcatagttcacgtggttttagtcgtctttgtgtttctggtctacacttcgagtagtgagcttgggagtccctctgtggtctatgaccggctaagagatatggccgctaagtcaaggatatgcactgagccactctcacaccacgaccaagctttcggtccggtcgacggcaactacaaaggctcttatctcaccatgttgagctctggtggtgctgtcttcgatatcatcaacattgtcggaaacttcggcactgtcttcgtcgacaatggttactgggtgagtgcaatagctgctcgaccttcatcaacccacgaggggtatttgcttggtggactcgtgtggttcgctgtgcttttctctctagccacctccttaggcctcggcgcacttgccctagacttgcctataagcgcagatgaggctaatcgaggtctagtcccgcctgctactgccattgctctcatgggtaaatcaggatccttgcttcttctcactatgcttttcatggctgtaacatcagctggttcttccgagcttatcgcggtatcatctctcttcacctacgacatctaccgaacatacataaatcctagagcaaccggaaaacaaatcttgaaagtctcaagatctgcggttcttggatttggatgtttcatggggattcttgcagtgatcttgaacaaagccggtgtttccctcggatggatgtatctcgcgatgggagttctcattggctctgcggttatccccatcgctttcatgcttttgtggagcaaagctaatgcatttggtgctattcttgggtcgatctctggctgtgttcttgggattgttacttggttatccaccgcaaagattcagtacggacgtgttgatcttgataccacagggagaaatgctcccatgcttgctggtaacctcgttgctattctaacaggagggttgatccatgcggtgtgtagtctagtacagccacagaactacgattggtcgacgacgagggaaatcaaagtggtggaagctgaggctccaggggacgatatcgatgttcctgtagaggagctaaaagaagagaagctgagaagagccaaagcttggattgttaaatggggtcttgtcttcactctcctcattgttgtcatctggccagttctctctctcccagcacgtgtgtttagcagaggatatttctggttttgggcaattgtggctatagcttggggaactataggatcgattgtgataattggtttgcctttgatcgaaagctgggaaacgatcaagagtgtttgtatgggaatgttcactaacgataggttaatgaacaagcttgatgacttgaaccataggcttcaagctttaaccaaggctgtaccagaagctgagaggatttatctgcttgaaatcgagaagacaaagaaaaccgatgaagaaagttgaagaaagatcaatatggttatatgaaagattgattttcttctgcttttgtttatatgctttgcttgctcgtttttctagtttgtgtgaaatcatatcagaactatctcctattgtacaatgtgttccttatctaatg

SEQ ID NO: 196 - DNA, 1214 bp, Brassica juncea
gaagcgaaagagagaagaagaaggtcggatgggagtggattactacaacgtcctccaagtcgatcgcaacgcctccgaagatgatcttaagaaagcgtacagaaaactcgccatgaaatggcatcccgacaagaaccccaacaacaaaaaagacgccgaggccaagttcaagcagatctctgaagcttacgaggttcttagtgatccccagaagaaagctgtgtacgatcagtatggcgaggaaggcttgaaagggaatgttccacctccaggtgctgatggagccacttacttctctaccggagacggtccaacgtccttccggttcaacccgagaaacgcagacgatatatttgctgagttctttgggttctccaggccatttggtggtggtggtggtggtggtggtacgagattctctagcagcatgtttggtgataacatttttgcatctttcggtgaaggaggagtaggagtcggtggtgctatgcatcatggtggagccaggaaggccgctcctatcgaaaacaagctgccttgcagccttgaagatctctacaaaggaaccaccaagaagatgaagatctctagggagattgctgatgtcagcggcaagacgatgcctgtggaagagattttgaccattgacgtgaagccagggtggaagaagggcacaagaatcacattccctgagaaaggaaacgagcagcccggcgtgactccagctgatttagtcttcatcatcgacgagaagcctcacccggttttcactcgggagggtaatgacctcattgtcacacagaggatctcactcgctgaggccctgacaggctacaccgtgaacctgacgacacttgatggtcggagactgacgatcccagtcaccaacgtgatacacccagagtacgaggaagtggttccaaaggaaggaatgcccttacagaaagatcagacaaagagagggaacttgaggatcaagttcaacgtcaagttccccaccagattaaccttagagcagaagacaggagtgaagaagcttctcggataaattgagctataatcagtgagtgcataccagtcaaagcaatgtagaacagaggataaggaagatttaagcttcttgtttgtgatttaatacttgttgtatcatcctttttggtcgatctgtaacataataaatactcctaataaaatttgtttgttgtaatcaaaaa

SEQ ID NO: 197 - DNA, 2281 bp, Brassica juncea
ctttctcttataggaagctagctacacttggtttcattttgcatgtggtggtgaataatggattctgagtcttggaagcttctcagaagtgtttgcatactttctttcctcctcggctctttctctgtctatcaaagccttcatgctgttgttgctgctcaagaacaacaagatacacaaccagctgtgactttgcaagtcaatgcttctaatggagctggaagactcatccctgaaactcttttcggaattttcttcgaggagataaaccatgctggtgctggtggtttatgggctgagcttgttagcaacagagggtttgaagctggtgggcagaacacaccgtctaatatatggccttggtccattgttggtgatcattcatcagtatatgtagctacggaccgttcatcaccctttgaacggaataaaatcgctttgagaatggatgtgatctgtgatggcaatggttgtccttcaggaggtgttggagtttataaccctggttactggggcatgaatattgaagaaggaatgaagtacaaggtggcgttttatgtgcgttcgagtgatgatattgatctgtctgtgtcgttgacaagctctaatggatcgttgactcttgcttctgagaagatcatagcgtctgcttctgatgtttcgaagtggactaagaaggaggttcttctggaggctaaagggacggatcatggtgcaaggcttcagttaacaacaaccaagaaagggtcattatggattgaccaagtctctgccatgccggttgatacttacaagggacatggctttagaaatgatctttaccaaatgatggttgatataaaacctcgtttcatccgtttcccaggtggttgttttgttgaaggtgaatggttaagtaatgcattccgctggaaagaaacggttgggccttgggaagagagacctggacattttggtgatgtttggaagtattggactgatgatggtcttggccacttcgagttctttcaattggcagaagacattggagcagccccaatatgggtgtttaacaacgggattagtcacaatgatgaagttgaaactgccagtatcatgccctttgttcaggaagcacttgatggtattgagtttgctaggggagatgctaactctacatggggatcggttcgagctgcaatgggacgccaagagccttttgaactgaagtatgttgctattgggaatgaggattgtggaaagacttactacagaggaaactatattgtgttctatgatgctatcaaaaaggcttatccagatatcaaaatcatctctaactgtgatggatcatctcgtccgcttgaccatcctgctgattactatgattttcatatatacacttctgctagcagtttgttttccatgtatcatcagtttgaccgcacttctcgcaagggtccaaaggcgtttgtcagtgaatatgctgtgactggaaaagatgctggtaaaggaagccttctcgctgctcttgcagaagctgcatttctcattggtcttgaaaagaacagtgacattgtggaaatggcgagctatgcaccactctttgtgaacacaaacgacagaaggtggaaccctgatgcaatagtcttcaattcatctcatctatatggaactcctagctattgggtgcaacggttctttgcagagtcaagcggatcaactcttctcagttcagaactgaagggaaactcttcttctattgtagcctctgcaatctcatggaaaaacagtagccaagattacatacgcataaaggctgtgaactttggagatagctcagtgaacatgaaggtgttggttactggattggatccgaacgtgatgaaagtttcgggatcgaagaggacagtacttacatctacaaatgtgatggatgaaaactccttcacacagccagagaaggttgtgccacaagaaagcttgctagagatggctgaggaggatcttaccgttgttctcccgccacactcgttctcttcgtttgatttgttgaaggaacctgcaaagataagaaagccagtttctgattcttcctatcagaaaacctcaactatgtgatgagacacgattgatgatgacaaggagtattagaaaaacttcatatttaaagtctcttgtggtttttttttttttttgaaacactgtctcttgtggttaaagatacttatattacgtatgcgtacctatgtgtataaagggataaaatagtttggtcaataaaatcttactttctttaatc

SEQ ID NO: 198 - DNA, 1789 bp, Brassica juncea
tatataaataggttggaaatgctataaaataacaagctaagcggtcattcttattagagactcatagtattaaacaattgttttggttcttggtactgatatttgatacttatcagtaatctggaatctagtcgttttttattaagtttaagtatatggagaggaagctgcttcttacagtgtcggtcatcttgaatctcgtattcacttttcatattctttataaaaaatcaaccacatggaatccgacttggaccagtagagctgctattgaagcagaggatgcagcctctgtgtcatgctcaggccatggtagagcttacgtggacggtattggagtccttggcggcaagcaaccgccttgtgaatgcaacaattgctatacaggcaaagattgttctattcttctctcagattgtcctgtcaacgctaactcaggagacactttgttcttagagcctttctggatgcgacaagcagagagcagcgcggctctggtctcgggatggcacaggatgagttatatctatcaagatgggacatatgtctcggaagcgcttgagacggtcatcaggaaactgcatagtgtggtgggaaacgctgttacagataacaggtttgtaatatttggaagtggaagcacacaattgcttgcagcagctgttcatgccttgtctttgacaaattcgtcatcatcaggacccgcaaggcttttggcttcagttccatattacgctatgtacaaggagcaagcggagttctttgactcagtacatctcaagtttgaaggagatgcgtttgcgtggaagaatagcgagcgcaatgataataccacacaagttatagaggtagtgacatctccgaataatccagatgggaagctgaaaagagcggttcttgatggtcctaatgtcaaaacaattcatgattacgcctattactggccttatttctcccctataactgttccagctgatgaagatttgagcttgtttagtctctccaagactacaggtcatgctggctctagattcgggtggggattggtaaaagacaaaactgtttatgagaaaatgaaaagatatatcactttgagtagcatgggagtttctaggacaacacagcttcatgttcttcaactgctcaacgtagtagttagggatggaggcgataatatattccattttggtcatgaaactttgaagaaaagatgggagacactgaacaaggtcttgtcactctctacacgtttctcgctccagaaaatcaaacctgagtactgcaactatttcaagaaagtcagagactttactccttcttatgcatgggtgaagtgtgaaaggccaggagacgcaaactgctatgagatattcagagaggccaagataacaggacgcgatggcaaagtgtttggatcagaggaaagttttgtgagactgagtctaatcagatcacaagatgactttgatcatcttattgatatgttgaagaagttagtcttccaagaaggtgtagaagctcattctatctgaaaacatgatgttgtcaacaaatgtctttaattcaatattatgtagtaacgtatttgtgcgactataattaagcctacaatgcccgttgtatgaaacctttgtaaatattgcggaaatcagtcccaacgataactgataaactgatactatcatactagtatagactaaagtgatgtatttctctgtaaaataggaatccgactctctacgaacagagttgtacgctaatctcctctgtacaatctattaaaagccta

SEQ ID NO: 199 - DNA, 985 bp, Brassica juncea
gtgtggtcggatgcttgaaaccagtggaggaggagaaggagaatgggagatctctacgctttagacttcgatggagttctctgcgatagctgtggagaaagctctctttctgctgttaaggctgcgagagtgagatggcctggtttgttcgtgggagttgattcagctttagaggaatggatcgttgaccagatgcatattgtgagacctgtggtggaaactggctatgagaatcttctacttgttcgcctactgttggagacgaagatgccctctattagaaaatcttcagttgcagagggattgactgttgatgggatattggagagctggggaaagattaaaccagttatcatggaagcttgggatgaagacgataaagatgctttgattgatttgtttgggagtgttagagatgattggattaacaatgacttgaccacttggattggtgccaatagattctatccaggagtgtcagatgcactgaagtttgccagctcaaagatttacattgttaccaccaaacagggccggtttgcagaagcgttgctgcgtgaaatagcaggtgtaatcataccaccagaaaggatctatgctctaggttcagggccaaaggtggaagtgctaaagctactccagaacaagccagaacatcagggcttaaagctgcattttgtggaagacagactcgcaacgctgaagaatgtcatcaaggagcctgaactagacaaatggaacctatacctaagtaactggggctacaacacagagaaagagagagcagaagctgaaagcattcccaggattcaggtcattgagctttccacgtttagcaataagcttaaatgagtgcatactcatcccttttcattgtattctacggaagcaaacatgtcaaagatattgtagctaaagattcagctaaaagagataaacttttcaatctcataactcatccttggtcacatcattcttgttatta

SEQ ID NO: 200 - DNA, 1057 bp, Brassica juncea
cgatctgcagagtacgggggggaaatatcaaagacgaatactcagaatctagttttaccaatatccttccttgaataagattcaaatgacgacgatcatcaattcgggcggcgccatcgcgattcgcgaggtttgggcggagaatctcgaatcagagtttgagctaatcagcggaatcatagacgattatcctttcgtctcgatggacactgagtttcccggcgtgattttcaaatccgatctccgccgtggaaacccggccgatctctaccgcctcctcaaatccaatgttgacgcgctaagcctcatccaggtcggccttactctctccgacgccgacggtaacctccccgatctcggtgatggccgacgcttcatctgggagtttaatttcaaggatttcgatgtggcgcgtgacgcacacgctccggattcgatcgagcttctccgtcggcaagggattgatttcgagcggaaccgccgcgatggcgtcgactccgagaggttcgcggagctgatgatgtcgtcggggcttgtctgcaacgaggaagtgagctgggtgacgtttcacagcgcgtacgattttgcttacctgatgaagattctcacgcgccgggaactaccttgcgcgttgggtgagtttcagcgcgtgatgagagcgttgttcggagaacgcgtgtacgacatgaaacacatgatgaggttttgcgagaggaaattgtacggcggtttagaccgggtggcaaggacccttgaggttaaccgggaggttggaaaatgtcaccaagccggttccgatagtttgcttacgtggcacgcgtttcagaggatgagagatttgtattttcaccaagatgggccggagaaacacgctggtgttttgtacggacttgaggttttctaaaggattatcgactatttgtaatttaaatttaattaattaacttaattaatccttgtagtaaatgttactgtggaaataaatataaataaaaggcaaattttaaaaaaaagtcaatagatatttgtttttcttatgttacacatgaaaacatta

SEQ ID NO: 201 - DNA, 1875 bp, Brassica juncea
tgcatgctcgagcggccgccagtgtgatggatatctgcagaattcgcccttaaaggatccccgtccttaaacaacaaccaactttattacacaaccataccctcttcttataaacctatccaccacttcctctcttcaccaaaggagaaagaagagttcagatagaaactctctctctctctctacccacaaattttagagaaattatgaataagcaagatgttatgaagcttcagacttgtgttctgaaagtgaacgtacactgcgaaggctgcaagcataaagtgaaaaaacagttgcagaaaatcgaaggagtgtactctgtaaaagcagatgtagaacaggggaaagtcactgtcacaggaaatgtcgacccagccattctcgttaagaaactgagcaaatcagggaaacacgccgagatcataggcggtggcggcggtggaaaagagagcaacgggaaagctaatggtggtggcggtggtcaaccaatgcaattgactcctcagcagattcaacaaatcatgatgatgaaggctgctcacggtggtggtgggaaggatatgaagatgatgatgcctcctgtggcatctaaggatcatcagaagaagtctgttaagtttgaggaagaggaggaagacgatgagtttagtgaggaggatgacgatgagtttagtgatgagttcagtgaagatgattatgatgacgatgagttcgatgaggatgatgaagatgatgatgaaagaggaggtcatggtcatggaggtggaggaggcatgcctcctaataaggtgatgatgatgcctaacaagatgcctcaaatgggtgatggtggtggagctaagggacctaatgagattatgatgatgatgaatggtctcaaagccggtggtggcggaggaggtggtggtgggtttgagattccggtgaaaatgaagggaatgggtgagggtaaaatgggaaaagaagagaaagcgaacaagggaggtgggggtaaaaccggaaaagcagatgctaaaagtggtggtggccttctaggctttttcaaaaagggtaaaagtgaaaaaggaggtgagaagaagggaggtggtaagaaagaagacggtggaggtgataaggtgaaggcctccggtggtgggggaggaggtgatgataatgggcctaaaaagggaggaggtaagtcgaaaggagcagcccatggggcccatgatatcgatgagctcatgaaacatgtcaaagcaggtggaggaggtaacaagggcaatcataatcatattagtgccaaggggatgggtggcccaatggttcaaggtggtccaatgggtatgatgggacaccaaagcggctctttcccggcggttcaaggcttaccgatgagtggaggcggaggatattatccaccaccgcctcaggcaatgaaccaacaacagtatatgcaaatgatgatgcaacaacaacatcaacagcaacaggctgcatttcatggaggatatggtggtggtggtcacggtggagacatgtaccatccgatgatgtatgctcggccttacccggcagtgaattatgctcatccaccgccaatgccacctccacactcgggtccttatactgatatgtttagcgatgagaatccagctggttgtagtatcatgtgatcttttgtattgtaatatggtaattagaaaacaaatatgaatatctttgtcttagaagtcttatgtttttttcttggggctgtcttttcttctgtaattccgtggaggattcgaaacaactcgagtttaagggcgaattccagcacactggcggccgttactagtggatccgagctcggtaccaagcttgatgcatagcttgagtattctatagtgtcac

SEQ ID NO: 202 - DNA, 1040 bp, Arabidopsis thaliana
ttgaggaagcaatctatgcaaaaaggtccaaaacactttagcattgaggaagaagaagaagaaagcttcatatttccaggggatacagttgaagcggcatggcaagagtcttcgaatcggattcgggttctggttgttccaatgtactgagtcttgacttaatcagagaatcgttgattaggcaagaagacaccatcgtcttcagcttgatcgagagagctaagtttccactcaattctcctgctttcgaggaatctcgttgtctagattctggaagtttctcttctctcactgagtttttcgtcagagagacagaaatcatccaagctaaggtaggaagatatgaatacccggaagagaatcctttcttccttgagaacattcctcactcggtttttcctacgcacaaatatccatcggctttgcaccctaaggctctatctgttaacattaacaaacaaatctgggatatttactttaaagaattgcttcctttgtttgtcaaacctggcgatgatggcaactatccatcaactgctgctagtgatctcgcctgtttacaagctctttcgagaaggattcactacggtaaatttgtagctgaggtcaaattcagagatgctccacaagattacgagcctgcgattcgcgctcaggatagagaggctttgatgaagctgttgacgtttgagaaagtagaagaaatggttaagaagagagtgcagaagaaagcagaaacgtttggacaagaagtaaaattcaactctggctatggcgatgagagtaagaagaagtataaagtggatccattgcttgcctctcgcatctacggggaatggcttatccctctcactaagctcgttgaggttgagtatcttctacgtcgtctcgattgaatattatttgtatccaaatctggccctgttaaagtgggccttaagtttttaagtgggcctgttgatatttgtcaggatatgatagaataattgaatgaagcaacacagtcatcactattttaaattttgtaagatattttaagg

SEQ ID NO: 203 - DNA, 918 bp, Brassica juncea
aagaagaagatgaagctgaaagtgtatgcagatcgtatgtcacagccgtctcgtgctgtaatcatattctgcaaggttaatggaatcgaattcgatgaggttttgattatcttggcgaagcgtcagcaattatcccctgaattcaaagagattaacccattggggaaagttccaactattgttgacggcagacttaagctcttcgagagtcacgccatcttgatttatctttcctctgcattcccgagtgtagctgatcattggtacccgaatgatctttccaagagagccaagattcactctgtcttggattggcatcacaccaacttacgccctggtgcagctggatatacaatgaatagtgtcctagctccatttcttggcggttctctggactcgaaagcagctgctgaagctgagcagatactaaccaagtctctgtccactctagagactttttggcttaagggcaatgctaaattcttgctcggaagcaaccaaccatccatagctgatctcagccttgtatgcgaacttatgcaactccaggttttggatgagaaagatcgtcttagattgttttctccttacaagaaagttgaggaatggattgagaatacgagaaaggtcacgcagcctcactttgatgtggttcataaaaccctttatggagctaaagacaaagttgagaagcagcggaagatgggaacaacaaccgtatctaaacctggttttcaatctaagatgtgagaacaaatttgtgtcggaggctgtttgtgaaaaccccggtttaggggatcactgtaataactcggttcaacatttacactgtaatcggaaccaaggaatgtatttgtaatcacttatcagggctgtttcaaaataaacattaagtgagacccacccattgaaaataaa

SEQ ID NO: 204 - DNA, 550 bp, Brassica napus
ctagagataattattataaacactcagaaacttgtagattctcccgacttcttcgataactatttattaaaataaaataattctttttttttgaaacttaaattataatataactcagatcatgatttctgttgttgtcatcactgagctactggttgagtacacggcggcgctggcaaaactcaccgccgggattcttccgagacgtcaaggagacagagacgtcgtacgcatcggcggtttctctctacgttatcctcctcgatcgacgacaacgattccagatttctcttctcatctcgttgacttctgatatgcgaccaacgatctttgtcagatctcagttttgtgtgattctccggagcttgtgacgggagagacttttatttatttttcttcccttgattgtattatctcgtactctggtttttgttgtttatgtgaggaaagagttttggatcgattaaaggtttgtaaaattgtatcgagttataattgagataattattttgatgaactgcaaatgatataaatgccaagttagtaaggg

SEQ ID NO: 205 - DNA, 4523 bp, Arabidopsis thaliana
ttagaatctctgaatcccagattccggtagagaagatgagtttcgcggcctataagatgatgcattggcctaccggcgtcgagaactgtgcttccggctatatcacccactctctctccgattcaacgctacagattccgattgtttccgttcatgatgatattgaagctgagtggcctaatcctaaacgaggtattggtcctttgcccaacgtcgttataaccgccgcaaatatccttgaggtgtacatcgttagggctcaagaggaagggaatactcaggagctgaggaatccgaagcttgctaagcgtggtggagttatggatggtgtctatggtgtttctctcgagctcgtgtgccattataggttgcacggtaatgttgagtcaattgcggttcttcctatgggaggtggtaattcttctaagggaagagattcgattatattgacatttcgcgacgccaaaatttcagttcttgagtttgatgattcaattcacagccttaggatgacttcgatgcattgttttgagggtccagattggcttcatctgaaaagaggaagagagtcttttccaagaggccctttggtaaaagtggatcctcaaggcagatgtggcggcgttcttgtttatggtttgcagatgatcatactcaagacttcccaggttggttctggactagttggagatgatgatgcgttcagttctggagggacagtttctgctcgagttgaatcatcttacataattaacttgcgtgatctggaaatgaaacacgtcaaagattttgtttttctacatggttatattgagcctgtaattgtcatccttcaggaagaagagcatacttgggctgggcgagtttcatggaagcaccatacttgcgtgctttctgcccttagtatcaattcgacattaaaacaacacccagtcatctggtcagctattaatctgccccatgatgcctacaaactacttgcagtaccatctccgatcggaggtgttcttgtgttgtgtgcaaatacaatccattatcatagtcagtcagcctcctgtgctctggcactgaacaattatgcctcctcagctgatagcagtcaagaactgcctgcatcaaatttcagtgtggagcttgatgctgcccatggaacctggatatcgaacgatgtggccctattgtcgacaaaatctggggaattgttgctgctgactcttatatatgatgggcgtgctgtacagagacttgatctttccaaatcaaaagcctctgtgcttgcttcggacattactagtgttggaaattcccttttctttttaggtagccggttgggagacagtttactggtgcaattttcctgtagatctgggcctgcagcatcattacctggcttgagagatgaggatgaagacattgaaggtgagggtcatcaagcaaaacgtttgaggatgacttctgatactttccaagatacaattggaaatgaggagctttcattgtttggttcaactccaaataactctgattcagcacagaaatcgttttcatttgcagtgagagattcactagttaatgttggcccagtgaaagattttgcgtatggcttaaggattaatgctgatgcaaacgccactggggtttccaaacagagcaactatgaattggtgtgctgttctggtcatgggaagaatggtgctttatgtgttcttcggcagtcaattagaccggaaatgattactgaggttgaacttccagggtgcaaaggaatatggacagtttatcacaagagctcccgtggtcataatgctgattcttctaaaatggctgctgatgaagatgaatatcatgcctatttgattatcagtttggaggctcgcacaatggtacttgaaactgctgaccttctcacagaagtcactgagagtgttgactattatgttcagggaagaacaattgctgctggaaatctatttggaaggcgtcgggtaatccaggtgtttgagcatggtgcccgtattctggatggttcttttatgaatcaagaattaagctttggagcctctaattcagaatccaattccggttctgaaagttccactgtgtcatctgtttcaatcgctgatccatatgttttacttagaatgacagatgacagtattcgtctgcttgttggagatccttccacttgcacagtttccataagtagcccatctgtacttgaaggctctaaaagaaagatatcagcctgtactttgtaccatgataaaggaccagaaccatggctaaggaaagctagcactgatgcgtggctttcgtcaggagttggagaggctgttgatagtgttgatggtggacctcaagatcagggtgacatatactgtgtggtctgttacgaaagtggtgcccttgagatatttgatgtgcctagtttcaattgtgttttctctgttgataaatttgcctctggaagacgccacctctctgatatgcctattcatgagctagagtatgaactcaacaaaaattccgaggataatacttcgtcaaaagagataaagaatacaagggttgttgagttagctatgcaaagatggtctgggcatcatacacgcccatttctctttgcagtattggctgatgggacaattctttgttaccatgcttacctatttgatggtgttgatagtaccaaagcagagaatagtttatcttcagaaaatcctgctgctttaaattcctctggtagttctaagcttaggaatctgaaatttctacgtatccccttggacacgtctacgagagaggggacttcagatggagttgcatctcaaagaattaccatgttcaagaatattagtggccaccagggattttttctttctggctcaaggccggggtggtgtatgttgttcagagagcgactacgatttcattcacagctgtgcgacggatcaattgcggcctttactgttcttcacaatgtgaattgcaatcacgggttcatatatgtcacagcacagggagttttgaagatttgccaattaccttcagcatcaatctatgataattattggccagtgcagaagattcctctaaaggccacacctcaccaagttacttactacgcggagaagaacttgtacccgctgatagtatcatatccggtcagcaagccgttaaatcaagttctttcttcactagttgatcaagaagctggccagcagcttgacaaccacaatatgagctcagatgatctccaacggacatacaccgtagaggaatttgaaattcaaattttggaaccagaaagatctggtggcccctgggaaactaaagccaaaatcccaatgcagacctcagaacatgcactgactgtgcgagttgtcacgcttctgaatgcaagcacaggggagaatgaaacacttcttgctgttgggactgcgtatgtccaaggggaggatgttgctgcaaggggccgtgtgcttcttttctcttttggaaaaaatggcgacaattctcaaaacgtggttactgaagtctactcaagggagctaaaaggtgctatatcagctgtagcctccattcagggtcatcttctaatatcatctggtcctaaaatcatcttgcacaaatggaatggcaccgaattaaatggtgttgccttctttgatgctccgccgctctatgtagtcagcatgaatgttgttaagagtttcatccttcttggtgatgttcacaaaagcatatactttcttagctggaaggaacaagggtcccaacttagcttactagccaaagattttgaatcccttgattgttttgctacagagttcttgattgatggaagtacgcttagcctggctgtctccgatgaacaaaagaatatccaggtattttattatgcaccaaagatgattgagagctggaagggtctgaaacttctttcaagggcggaatttcacgttggtgcccatgtgtcaaagttcctacgtctgcagatggtttcttctggagcagataaaataaatcgatttgctttgttatttggtactctagacggcagttttggttgcattgctccactggatgaggtcacattccggaggttacagtctctccagaaaaagctagtggatgctgttcctcatgttgcgggtctgaacccactcgctttccgtcaatttcgctcaagtgggaaggctcgacgatctgggcctgacagcatagttgactgcgagttactatgccattacgagatgcttccattggaggaacagcttgaacttgctcaccagattgggacaacccgatattcgattctcaaggatttagttgatctctctgtcggaaccagcttcttgtgaaagatcaaagaaaaaggcagatcgtaatgcgttgttcacccgccgacaaaaataggcagagtcgcttaatatgttgtaaaaaatgctgtaacagtagacaatcgtatgaactttgatgtttagtggcatttagattatgttaagattcttctccactct

SEQ ID NO: 206 - DNA, 8117 bp, Arabidopsis thaliana
ggcttagcctaaaccctagtagccacagagacgaagaagaagaagaagcttcaccgttttacccttttacgattgttctgacctaccaacctggccccggtcaatctccgtggaaagaaatggcttctccgttggagtctcttctctccatctctggctctgtctctacaagctccactttaatcagactccggatcttccgccatgatatccccgagattctccagaattccgatatgacgtctgatattgcgcctgttatagttgacatgatattccaaacattggctatatatgatgaccgtgcctcacggaaagctgtagatgatttgattgtaaagggactgggaaatgttaccttcatgaaaacttttgcggccatgcttgttcaagttatggaaaagcagttgaaattttgttttgatacagtctgttacagactactaatttggtcatgtcttcttctggaaaaaagtcaattcgctactgtttcgaagaatgcatttgttagagttgcatcaacgcaggcttcattacttcgtatcattatggagagctctttccgtatgcggagggcttgtaaaagatttatgttccatttgttctctcagtcacaagctatctacagtttatatatggatgaagttaaaggttcacggattccgtacaaggatagccctgagttattaggactactgcttgagttctcttgttcgtctcctgctctatttgaacagtcaaaggccatatttgttgatatctatgttaaagatgtcctgaattctagagaaaagcagaaaccaaatcttagtaattgtttcaaacctcttcttcaacgcttgtcacatgaggaattccaaactgtcatccttcctgcagctgttaaaatgttgaagcgtaatccagaaattgtcctggaatcagttggatttctattagcaaatgtaaacattgatctaagtaagtatgccctggaactgctaccagttatactaccacaggctcggcatacggatgaagacaggcgtctaggagctttatcaatggttatgtgcttaagtgaaaaatcaagtaatcctgatactatagaagcaatgtttgcgtcagttaaagccataattggagtgcaagaactggcaagtgctcctgaaggaaagtatattggtagtttgtcgaggacgatatgcagctttctcatagcctgctacaaggatgaagcttcatgggcatcacgatcttctgttgccatccaaccaaacttagtatctttcattgctgccggccttaaggagaaagaagctctaaggagggggcatctccgctgtatatcagacttgctatcccctttaattcaacttgtaaagacgggatttacaaaggcagtacaacgtctggatgggatatatgcgctactgatcgtttccaaaattgctgcctgtgacatcaaagcagaggatactatggtgaaggagaaattatggactttgatatctcaaaatgagccttcacttgtgcaaattactttggcctcaaaactttcaagtgatgattgtgtagtatgtgtagaccttcttgaggtgctccttgtggaacactcctccagggttttggaagcattttcattgaaatcactatcacagttgcttctctttctgctttgccatccaagctggaatgttcgtaaaacagcttacaattctgttacgaagatcttcctcgcgacttcacagctagccactactcttttagacgagttctcggattttctttccataactggggaccaaatcgtttcttctagaaccagtgacgcagataatcccgcggatcatcaagctcctttcgtcccctctgtagaggtgttagtgaaggctttgattgtcatttcatcggcagcagttgctggacctccaagctcatggattgttcgtgccatattttgctcgcatcatcccagcatagttggtactggaaaaagagatgctgtttggaagagtctacttggaccaatgggtttaacgagtgctaaaactccggagcagcaagcggccgtatattccttgtccaccatgatgtctctggcaccagaggatacattcacagtgttcaagatgcatctacaagaccttccagatcgactgtctcatgatatgctctcagagactgacattaagatctttcatacacctgaggggatgcttttaagtgagcaaggtgtctatgttgctcagacaattggtgccaagtatacaaagcaggagccgagttctaatcattctctaaagaaaggattggctagtagagaaactgcaaactcagggagaagggacactgcaaagttgacaaagaaagctgacaaaggaaaaacggcaaaggaagaggcacgggaactgatgctcaaagaggaggcctcaacacgggaaaatgttcacaggatacaaaaaagtctttcgttggtgcttcatgcccttggggagatgggtcttgctaatcctgtgttttgtcacagccagttaccttttttggctacttttttggatccattgctgcgatcacctattgtaagtgctgcagcctttgaaaacttggtgaagcttgcacgttgtacagttcagccactgtgtaactgggctctagaaatttcaactgctctgcgtttgatcgcgattgatgaagttgatacttcatttgattttcgtccatcagttgacaaggctgggaaaacatatgagggtctttttgagaggattgtaaatgggttatcgatatcttgtaaatcaggaccacttcctgtagatacattcacgttcattttcccgatactggagcgaattttactgtcatcaaagcggacaaaactccatgatgatgtgctgcagattttatacatgcatctagatccgatgctgccacttccaagactccggatgatatcagttctatatcatgtgctaggtgttgttcccgcgtatcaagcatcagttggacctgcactgaatgaattgtgtcttggattgcaagcagatgatgtcgcaaatgcgctctatggagtctattcaaaagatgttcatgtcagactcgcctgcttaaacgctgtgaagtgtattccagctgtttccaaatgctcccttcctcagaatgttaaaatagcaacaaacatttggatagctctacatgaccctgaaaagtcagtggctgaatcagcagatgatttatgggcccgctatggtcatgatttggggactgattattcaggaatctttaaagcactttctcatataaatctcaacgtccgtttagctgcagcagaagcactggctgatgctcttcatgaaagcccgtcatcaatccagttatccctttcaactttattttctctgtacatccgtgatgctacgtctggtgaggatgtctttgatgctggttggataggaaggcaaggaattgccttagcactgcaatctgctgctgacgtattgacaacaaaggaccttcctgctgttatgacctttttgatatcccgcgcactggctgatcccaacacagatgttcgtggaaagatgatcaatgctggtatcatgattattgataagcatggcaaagaaaacgtttcattgctgttccccatctttgagaattatttaaataaagaggcatctgatgaagaggaatatgacttggttcgtgagggtgttgttatattcactggagcactagcaaagcacttagcaagagatgatcctaaagtacataatgttgtggaaaagctgttggaggtgttgaatacaccatcagaatctgtgcaacgtgctgtctcgacatgcctttctccacttgtgttatcaaagcaagaggaggcccctgccctttttttgaggctcttggataagctaatgaagagtgataaatatggtgagcgtagaggagcagcttttggtcttgcgggagtagttatgggctttggaatttctagcttgaagaaatatggtcttatagtcactttgcaagaagcacttattgacagaaattctgctaaacgtcgtgaaggagcattactcgcatttgaatgcctctgcgagaagcttggaaaattatttgaaccgtatgtgataaagatgttacccttacttctggtgtcgttctctgaccaagtcggagcagttcgcgaagcagcagaatgtgctgctcgagctatgatgtctcaactatctgcatatggtgtgaaacttgtccttccttctctactcaagggacttgaagataaagcatggagaacaaagcaaagcagtgtacagctcctcggtgctatggcattttgtgctcctcagcaactgtcccaatgtcttcctagggttgtgccaaaacttacagaggttttgacggatacacatccaaaagtccagtcagccgggcagttagcacttcagcaggttggaagtgtcataaagaacccagagatatcctctcttgtccccacccttctattggccttaacagatcccaatgagtacacacgccatgctcttgacacccttcttcaaacaacattcgttaattctgttgatgccccctcgcttgcactgttggtaccaatagtacatagaggattgagagaaagaagttctgaaacaaaaaagaaagcttctcaaattgtcggtaatatgtgttctttggtgacagagccaaaggatatgattccttacataggattgctccttcctgaggttaaaaaggttcttgtggatccaattcccgaagtacgttctgttgcagcaagggctgttgggtcacttattagaggaatgggagaggataatttcccagatcttgttccgtggctgtttgaaactctaaaatctgatacaagcaatgttgaaagatatggagccgctcagggattaagtgaggttatagcagctcttgggacagattactttgagaatatacttcctgacctcattcgtcattgttctcatcaaaaagcatcggtccgagatggataccttacgcttttcaagttcttgccaagatccttgggtgctcagttccagaagtacttgcagcttgttttaccggccattctggatggtcttgccgatgagaatgaatctgttcgtgatgcagccctgggggctggccatgtactggtggagcaccatgcaacaacgtctctgcctcttcttcttccagctgtggaggatggtattttcaatgataattggcgtatccgtcaaagttctgttgaactgcttggggatctattgttcaaggttgctggtacatcgggcaaagctctactggagggtggaagtgatgatgaaggtgcaagtactgaagcgcagggtcgtgccattattgatattttaggaatggacaagcgcaatgaagttcttgcagcgttatatatggtccggactgatgttagtttgtctgttcgtcaggcggcactacatgtatggaaaaccatcgtagcaaatacaccaaagacgttgaaggaaataatgccaattttgatgagtaccttaatttcttctttggcatcaccatcttctgagaggcgccaggtagcaggaagatcacttggagagctggttaggaagcttggtgaaagggtgcttcctcttatcattccaattttatctaaaggactgaaagacccagatgttgacaaaagacaaggtgtatgcattggcctgaatgaagtgatggcaagtgctggaaggagtcagttgctgagtttcatggatcagcttattcccacaattaggacagcactttgtgatagtgctctcgaggttcgggaatctgctggactagcattcagcactctgtataagagtgctggactgcaagcaatggatgagattattccaactcttttggaagccttagaagatgatgaaatgtctactactgccttggatggacttaaacaaattataagtgttaggacagcagctgttcttccacacatcttgcccaagcttgtccatcttcctctctctgccttaaatgctcatgctttgggagccttagctgaggttgctggtgctggttttaacacgcatcttgggaccatacttcctgctttgctctctgcaatgggaggtgaaaacaaggaagtccaagaattggcacaagaggccgcagagagagtggtgcttgtcattgatgaagaaggcgttgagactctattatcagaacttctcaaaggagtgtctgatagtcaggcttcaattagaagaagttctgcatatctgattggttacttcttcaagagtagcaagctttacttaattgatgaagctccaaacatgatatctaccttgattgttatgctcagtgattctgattcaacaacggttgcggtttcctgggaagctttggctagggttattggttcagttccaaaggaagtacttccttcatatataaaacttgtacgtgatgctgtatctacagctagggacaaagagcgcaggaagcgtaagggaggatatgttgttattcctggtctatgcctccccaagtcccttaagccattacttccagtatttctacagggtctaataagtggatctgctgaactaagagagcaagctgcaattggtcttggtgaacttattgaagttactagcgagcaagctttgaaggagttcgtcatacctataacagggcctcttattcgaatcattggagaccggtttccatggcaagtcaaaagtgctatcttggctacattaatcatcctaatacaaaggggtgggatggcgctaaagccattcctccctcaactgcaaacaacatttgtcaagtgtctgcaagactctacaaggaccatccgttctagtgctgcggttgccctgggaaagcttagtgcattaagcacaaggattgacccattagttggtgatttgatgacaagtttccaggctgcagattctggggtacgtgaggccatcctatctgcaatgagaggtgtaataaagcatgctgggaagagcattgggcctgctgttagagtacgcatttttgatctcctaaaggatctaatgcaccatgaggatgaccaagttcgaatatctgccacaagcatgctgggtgttttatcacagtacttggaagctgcacaactcagtgttctgcttcaagaggtcaatgatttatctgcttcgcaaaattggggtgctaggcatggctcagttctctgcatttcatccttgctgaaacacaatccttccaccattatgacgtcatcgctcttttcctctatgttaaattctcttaagagctctttgaaggatgagaagtttccattacgtgaaagctcgacaaaggccttgggaaggcttttgctaaaacaacttgcgacggatccttccaacacaaaagtggttatcgatgtcctttcatcgattgtctcagctttgcatgatgattcgagtgaggttcgaagaagagcactctcttcacttaaagcttttgcaaaagataatccatcagcaaccatggcaaatataagtgttatcggacctcctctagctgaatgtttgaaggatgggaacacaccagtgagacttgctgcagaaagatgtgctttgcacgtgttccaattaacaaaaggcgcagaaaatgttcaagcagctcaaaaatacattacaggattggatgcccgacggttatccaagtttcctgaacaaagcgatgacagtgaaagcgatgatgataatgtaagtgggtaggaggaaacatgttttcgccatctctgttgaatccattttgtaggagaggctcattaagcataatcccttgagtcgcggatgaaattgtatcatttttctttcgcatgagaatatagatacacagaggtcaatatacaatatatagatatacctgactttggattatcagatccttctgtgttctttgttgagaagcactcatctcattttttttatttgatacgggtacttcgattttgttaaatggtaatgtctcaaatgggttaaattttatgcgtctttagtttttgctttcagtctataacagactagattatactactaaatcttctaattacgttattgtattatgaatatgatttgttactaaaattc

SEQ ID NO: 207 - DNA, 2410 bp, Arabidopsis thaliana
ctcagctcctcatcaaattatcttctttctctttctctctgatcatttccaaattatttctaagctaagaaaatctttaaaaataacaaagcttctaaaataataatccgacctaccggattcaaaccattgatctgaagatcatctataaaccagtccttgatctataaactaaaataagggaagaaaaaaacaagagagagaaatagagaatgaagtcttttgcggctaaggtagaagagggagttaaaggaatagacggaaagccgtcggtaggtccggtgtaccggaatcttctgtcggaaaaaggttttcctccgattgattctgagatcaccactgcttgggacattttcagtaaatcagtggagaaattccctgacaataatatgcttggatggcgtcgaattgttgatgagaaggttggaccatatatgtggaaaacgtacaaggaagtatacgaagaagttttgcagattggctctgcactacgagccgccggagctgaacctgggagtcgagtggggatctacggtgttaattgtcctcagtggatcatagcaatggaggcttgtgcagctcacactctaatctgtgtacctctatatgatacattgggttcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagcgacgagcttagccacaaggcttcagaaattggagtcaaaacatactcctggatcgattttctccatatgggacgtgagaaaccggaagacacgaacccgcctaaggcgtttaacatatgcaccataatgtacaccagcggcacaagcggtgatcctaaaggtgtggttttgactcaccaagcggtcgcgacttttgttgttgggatggatctctatatggaccagtttgaagataagatgacacatgatgatgtgtatctctccttcttgcccttggctcatattcttgaccgtatgaacgaggaatacttctttcgcaaaggcgcttccgtcggctattaccatggaaatttgaacgtgttacgtgacgatattcaagaactgaaaccgacttatctagctggagtaccaagagtgtttgagagaatccatgaggggattcaaaaggctcttcaagaacttaacccaagaaggagattcatcttcaatgctctctacaaacacaagcttgcgtggttgaatcgtgggtactctcatagtaaagcttcacccatggctgatttcattgctttcagaaagattagagacaaattgggaggtcgcatccggttgctagtatctggaggagcacctttgagccctgagattgaagagtttttgagagttacttgttgttgctttgtcgttcaaggctacggtctaacggagacacttggaggaacggctttgggtttcccggacgagatgtgtatgctagggacagtcggtattccagcggtttacaacgagatacggcttgaagaggtgtctgaaatgggctatgacccgctcggagaaaatccggcaggagagatctgtataagaggacaatgtatgttttcagggtattacaagaaccctgaactcactgaagaagtcatgaaagatggatggttccacacaggagatataggtgagattcttccaaacggagtactcaagatcatcgatcgtaaaaagaatctgatcaaactttctcaaggagaatatgttgctctcgagcatttggaaaacatcttcgggcaaaactctgttgtccaagatatatgggtttatggagacagcttcaaatctatgcttgtcgcggtggttgttcccaacccagaaaccgtcaacaggtgggctaaagatctcggttttactaaaccattcgaagaactctgttctttcccggaactaaaagaacacatcatttcagaactgaagtccacggcagaaaagaacaagctaagaaagtttgagtacatcaaagcggtgacagtggagacaaaacctttcgacgtagagagagacttagtgactgcgacgctcaagaatcggaggaacaatcttctcaaatattatcaggtgcaaatcgacgaaatgtaccgcaaattggcctcaaagaaaatctgaaagtgttgcgatgatgtgtgtgctgttattgatagttatatatgtacgttatatgtatcaataattcatagatatgagctttatgctttatgtaatattttatttttatgttgtatgacatcataattatggaatttttttttgttgatttttgctttggtaatgtaactctctatttgtatccataatctaccaaaatccacgtaactaccact

SEQ ID NO: 208 - DNA, 2122 bp, Arabidopsis thaliana
aaaatatcataaggctgagagcttatcagagaagaagaagatatttctgtaagcgagaaaaatggcgagagaacatgcgatcggagaagccaccggaaaacgaaagaaacgcggcagagttgaagaagcagaagaatactgtaacgatggaatcgaagaacaagtagaggatgagaagcttccgttagaggttgggatgttctattacccaatgactccgccttcgttcattgtttccgatgctctggagccagattttcctttgatctatgtcaacagagtcttcgaagtcttcactggctatcgtgccgatgaagttcttggtcgtaactgtcgattcctacagtacagagatcctcgagctcaaaggcgtcacccattggttgatcctgtggttgtatctgagattaggagatgtcttgaagaaggtattgaattccaaggagagcttcttaatttcagaaaagatggtactcctttggttaacagactacggcttgctccaatacgtgacgatgatggaaccattacacacgtaattgggatacaggtcttctctgaaacgactatagaccttgaccgtgtctcgtatcctgtgttcaaacataaacaacagcttgatcaaacatctgagtgcttgtttccaagtggaagcccgaggtttaaggagcatcatgaagatttctgtgggatattgcagctatctgatgaagttttggctcataacatcttatctcggttaactccaagggacgttgcttcaattggttctgcttgcaggaggttgaggcagttgacgaagaacgagagtgtgaggaagatggtatgtcagaatgcgtggggaaaagagataactggaacactggagattatgactaagaagctaagatggggtcggttagctagagagctcaccactcttgaagctgtgtgttggcgtaaatttactgttggagggattgtacaaccttcccgctgcaatttcagcgcgtgtgctgttgggaaccggcttgtgctatttggtggggaaggggttaacatgcagccattggatgatacttttgttctcaatcttgatgcagagtgtcctgagtggcagcgtgtgagggtgacgtcgtcgcctccaggacgttggggacacacactctcgtgtctcaacgggtcgtggttggtagtctttggagggtgtggaagacaaggattgcttaatgatgtatttgtgcttgatctagacgctaagcatcccacatggaaggaagtagcaggaggaactcctccattgccaagatcttggcacagctcgtgcaccattgagggctctaaactggttgtctcaggtggctgcacagacgctggagtgcttctcagcgacaccttcttgttggatctgacaacagataaaccgacatggaaagagatcccgacatcatgggctcctccttctagacttgggcattctttatcggtctttggtcggactaaaatcctaatgtttggcgggcttgcaaatagtggtcatctaaagctaaggtcaggggaggcatacactatagacttggaggatgaagaaccaagatggagagagcttgagtgtagcgcattcccaggcgtggttgtaccgcctccaagactagaccatgtggctgtgagcatgccgtgtggtagggtcatcatctttggagggtcgattgcagggcttcactctccttcgcaactgtttctaatagatcctgcagaagagaaaccgtcatggaggatcctgaatgtccccgggaaaccgcctaagttagcttggggacatagcacatgcgttgttggaggaactagagtattggtccttggtggtcacactggtgaggaatggatactcaatgaattacatgaactctgcttggctagccggcaagactcggatctgtaaagactctttccttcttcatttggtttgtggttttgtatctgtcacattccaaactcttacgacatgtagaagagatatatcagaagctagaagcgtgtgtacatagtaaattagtgattgttgtacgctttagatagatattcatgtaatgttaatggttttgctgtatgaagatccttctataatatacttctccttgtt

SEQ ID NO: 209 - DNA, 2891 bp, Oryza sativa
actcctcctcccctcacctcaccttacctaagaacgccacccattgccggagttgataccaaacaaggaattcatcaatggcagcgcatacagtgacggacccactggaggagctatggaaccacacgatgtcgatggacaagacgcacctgatgtgcttctacccgagcaagatcaccatgggtggcgtctggacgggcgacaatccgctcgacttctccatacctctcctcctcttccagatcctcctcatcacctccaccacccgcgccgccaccctcctcctctctcctctccgtctccccacctacatctcccagatcctcgccggcttcctccttggcccctccgtccttggccacctccctcacttctccaacctcgtcttccccgtccgtagcctcttcgtccttgagtccatggcccttctcggcctcgtctactacaccttcatcgtcggcgtcgagatcgaggtctccgccatcacccgcgccggcatccgtagcttcggcttcgccattggctgcacgctcccgcccttcctcgtcggcgctctcaccggctacgtcgcgctcagcactgacgacaaacacaagggtgacacgttcctcaacaagctctccttccccatcttcctcggctccaccttctcctccaccgccttcgccgtcctcgcccgcaacatcgccgagctgaagcttgccggcaccgacgtcggccagctcacgctctctgcgtcactcatcaacgacaccttcgcctggaccggcctcaccgtcgccacggtgctcggccactcgcgctgcaccatcacgcagaccacgtggacgctcacgtcgggcgtcgtcatcttcggcgccagctacctcctgctccgccccatgctcctgcggctggcgaggcgcgccgccgagggggaggcggtcggcgaggaccgcgagtgctggattctgatcggcgtcatggtggcggcgctggtggcggacgcggggggcacgcacgccatattcggcgccttcgtgttcgggctcgcggtgcccaacgggccggtcggggtggcgctggtggagaaggtggaggacttcgtggtgggcgctctgctcccgctcttcttcgccctcagcggcctccgcaccgacaccgccaagatcaccaacatgcattctgccgtgttgctcatggtcgctgccatggtcgctgcggtcttgaaggtcgtcgccgcaatcggcgtcgccggtgtgttcggcatgccgctcggtgacggcacgtccatcgggctgttgctcaacaccaaggggatcatcgagctcgtcatcctcaacattgcaaggaacaaagggattatgagtgaccagtcgttcacggtgctggtgttcgtgtcagcgctgatcacggcgatggtgagccctttcctgggcatggtggtgaagccggcgcggcggctcgtgttctacaagcggcgcacggtggcgtgggctcacccggaatcggagctccgcgtgctggcctgcgtccacgtgccgcgcgacgtgcccgcgctactgacgctcctcgacgtggtgacgccgtcgagccgatcgcccgtgggcgtcctcgccctccacctcatcgagttcgtgggccgctcctccgcgctcctcctcatcaacgcctcggcgccatcgtcgtcctcctacgacgcctccgtccacgggcgcagccacacggagatgcagttcaagcacatctcccacgccttcatggcgtacgaggagcagtcggtgggcgtgtcggcgcgcaccatggccgccgtctcgccgtacgcctccatgcacgaggacatcacctccgccgcggagaaccagcactcggcgctcatcctgctcccgttccacaagtaccggtcggtggacggcggcctggaggtgtcccacccggcgatacagccgctcaactgcagcgtgcagagcttctcgccgtgcacggtgggcatcctcgtggaccgtggcctcgcggcggtgccgggtggcgggtaccgcgtggtggctctcttcttcggcgggagcgacgaccgggaggtggcggcgctggcgacgcggatggtgaggaacccgaccatcgacctgacattgctccggttcgtccagaagggaggaagcttcacggcgagcgagttcgacgcgctgaaagagcggaaggccgacgaggggtgcctgcgcgacttcctggagagggcgaacgagggcggcggcgcgacggtggagtacagggagcgcggcgtgttcaacgcgagcgagatggtgggggagatacagagcgtggaggccatggggaacaaggacctgttcgtcgtcgggaaggtgcccggggggtcagggctgacggcgggcatggcggagtggagcgagtcaccggagctggggcccatcggcgacctgctggcgtccaaggacttccagacgacggcgtcggtgctggtgctgcaggcgtacgggaggccggcggcagtggtgggagcgggagcgggagcaatgtcggtggattttggcggcgacagcgtggcgatggcggagaggacagccagtgggcgtaggccatgggcacgaccgggtgtatgatcatcgatcatcggagaatttttctttctagaattggtgaccgttgagatagatgtaggaatagctgataatatggtgtggataattgcatattatggtataaaatttatacatagtgcaaagcttaaacatagttcttggaaaaataaagctaaataaccatacactagcatgttgttaatcaagcagtcatcgttgtgatgcaacattttgttatttagagggcctgaggatgagaacaaatgcagggaggtttggaaatatcagaagaaactcaggagcagtttcattttc

SEQ ID NO: 210 - DNA, 640 bp, Hordeum vulgare
aaagcaagaagccagacgaatcaaagctccgacgcgccccgacaaatggcatctaagctggttctcctcgtggccacgctagcgtgcgtgctcggcggcgccgaggcgaagctcggcaggctggtcgtcagcggcgtcgtgccgtgcaacaccggcagcctcatcgacatcgccacctcccctgcgttcccaaacgcggaggtggagctgcggtgcgcggggcaggtggtggcgggcgcgacgaccaacaccaacgggtccttcacgatggaggcggacctgacgagcgcgctggcggcgttcatcggccggtgctcgctggtggtggacacgccgctcatcaagtgcgatgcccagctgccgccggcggggaggctcgtgtcctacctgcagggcccgctcaccaggctgctcggcggcatctttcacctcttccccgccggcttctcgttccacagccgatgaaattagctccttgtgtcgtcggtccaacgatttcagcatactgagatctggttaactacctcttgtatatctttagtttggtttgaaatgaaatgtatctcaagttgcaggagctgcaaacgcttgacgcaagtgttgttgtaagttggctaagttgagcaactggatggataat

SEQ ID NO: 211 - DNA, 1112 bp, Brassica juncea
aaaaaaactctccatctctacacgatacgaaaatctctctctaaatacaaaagctctcgcttctctctaacgacgaaccctaactccggcccggtttattccggagccggagaccccctctttcccctttttttctttttttcttttgctcccttccccccacttgacgctggtcgagatgctcgatgctctggctcggcaaatccaccttaagttttcttcttgagacaaacggtggtgagatccggtctctggagtagcggcgagaccaacgtgacggtggtgtggaaaggagtcggcttttagggcttacggagaaaccaaatctgattttcccctttctagatctccggtgactctggttcagcgacggcgcgtggcctcgggagacgtcttctccaccgtggatctatggtccctcacgacggtgagataaaaggagaaggtttgtgatggtgagctgacagagaaggatctccaggtataagtaccggttctcggagatcacacgaatcacgactcacgcggacaaggtacacaacatgagattacattagcggcgtttcgtggtggtggtttctattccccagagcagaaagctacaaccaatggatggcaccgattctctaaagctcgtattaggtacaccaacccgcgctttttgtagctgaaacccgactttcattcggatctcgtgtccgttttaggctgagggtcacagtgattgaagaccagcaggatgagactccctcgataatgcacctatggtgaagaagctaagtgaccatgtactttgaagccaagctttaggatcatttagtttgtttttaattggttcgggggttgttcttagttccggttgtgttagtaaacattgttgtaccatgaggttgaattttaggtggttgaaggggtggattgcttcgggtcgtggagtgatttcatcccactgtggttgaaaaatacaatgaaggatgttaggttgcgttggttccaagtagtgaatcagggtggaactagactacttcattgtatatgtggtagaaatcttgtgtggtcataagctttgtattaagaattggtgaaatgaaatgttgttgttgagccaaaaa

SEQ ID NO: 212 - DNA, 972 bp, Brassica juncea
ggaactcttctcttctctctctctctactaaaaatcatccaacttctctctagaccttcaaaagctgatatcgttttccggcggccggtaggctaatcgccaccggttgccatactcttttgtgttttctttttggtatattatattatcttccgttaagcggataatggttttcgctaggcgacttgtatttcgtttgacgattttgttgtgtcttttcaagccaatatcgaacttgttcttcatgattatcttgtgctttcgatttggtttgaataaataagttttagatatgtccagaaaatcctctttgcttgctttaatcaaaaatcccgaagctatgttcttagttcttcttttctcatcttagcttgttttacttcaatggactataaatctacatgatttatggccacataaactgggctttgcatgtagtatttcattgtttgtaaatcaagagattgggagtgtcttggcgatggtgagatcagatcaagaagagttggggtcttatggatgtcctaacaaatgatctatatctcttcctccttaaacctccccggagatacgtgaagatggtgactgaagaatatggtcatatgcctaggcagtctgcaaagaggataatctcagaggatttctgaagtctgttgatggtggtataatgaagcggagaagacagcggtttagaggcggagaaacaccgacttcgcggcggaggatacatcgacttcgcggcggaggatacaccggtaataggcgtgttcggaagctggtggaagatgctagatctatctcctaaatgatgccacgtggtcctaatctctttcggtggaagatgcgtagaccaattctcatctcatcaaatatgttttctttccgattaagtttaatatattggacatttatgtagactttaaatcctctgtaccttgtccattgggctttatgaaatgaattatgttgaca

SEQ ID NO: 213 - DNA, 1367 bp, Brassica juncea
ggtgagaagtgaggagtttcttcattaaaaatgtatttctaataacacagtaatcgaaataacgaagtcaagcgcaaccgaccgaaagagatccgactctgttcagttttttctctcgctcgtgaacagcagcctctatcacaattctagatctgaggccttttccggccggcggtttccgctgcgctgggagaaggcctccacctttgtctctctttattagtaatcatgtagatttttgagttgcggcgatgggggttggtgacgtggtttctctccgacggcaatggcgttgtggtttggtggagctgtggttggttttggcttgttcttggtgaggtcgtcttcgttatcttggcgtgttctctccgtcggtggcataaagctgattatagatccaagagggttgaatctggttggttgtggttgccctgctgtggcgttggagtgaaggccctagtcttcagcttctatcggtctgttggctctgtctttagcttttggtatcccttagtaaagatgtatgtgtttgctgctggtttgttcatggttattagccgggtttaacctgttcgtatgagcggtttcttttcggttttatgctcgtttgagtcgactcagtgttgttgccttgtttcttatggtgttattctgcttggtttgggctgccagtgttagaccttatctggtttctggttcgcagtggtcgtttttagctggttcagatgtgggttcttcattgttcgggtttggtctggcagtctctcaagtgaggcatcagaggtttcttggctcttctatccagcagaaacatttcatcttcggttttagatggtttacaagaactcttatttagccatgttcagtgtgtaagtttctttggagtgcttcagtattcgtgtctcccttgaagatccatttgggctcacctatgttactatatggacggactgatgtaagtaccggatcgttgctgcgggaactttgaggatcctccacccttatgttttggctctttggataggaatctttttcaggttccctacccctctctatgaagtctcttggacctgtctctatccttcgtttggagatcgatgtgctctgcgttttggactgcaatcatcaacgctactccttcgcttatgttttggattttggcttatgtattagagtttcttgtaaatcgtttttagttgtctagtagttttctcttatggctctggaaagatttcgatctttgccggcttatggctccggaagaaaaatgtttcttgccggcttaggtgtgtttcgactgtatttcacctgtgataatataatctttcagatgacaaaaaaaaaataacacagtaatctagtatata

SEQ ID NO: 214 - DNA, 1311 bp, Brassica juncea
ctgtttcctttactctctctcctctctggctgcctccgatatgcgtgtgtccctggggtttcgagcttcgccggcggaggaacctaggctgaagcaggcggacgtcttgagtttctggtgacactgcgaggtaggtgtagcggtggatggtgattagggtcggctcttgggggttgggatttgttgctggtcgattttcattcttagatctacggcggatcccggtcagtctgtagcgcgtggtcatgaaggaggctacttcactctggatctgttcttacacatgtatcccggctcttctcgtgtcctggtggagatgatcggaggcgcgtgttttctccctgcgcgtggtgtctcgttgtagggaggtttctggttgtcccttgctcagtaggttcggtggggttcttctccatcggcgcgtctgtaagcctgttcggatgcgtcgtgtatcgtctccggcgatcttcgatttggcgtgtgccttggcgtttgagtatctgacgagaagtcgtctatggcttgggtttggatcctcagtgtctgttacctgcttgtccccctctggtcatggcgtttccccttagcgctcatgctggtttccattgcgtgaagctcatcgagtatcctcctgttttacggctgttcttcattgttctgttccgttttccgttcgagtcggtcagttctctggttctcagagactgtgtgtgtcgaggctctcttatccggttgtcatttgggtaggtcgcttctcgtgtttgaacccatcatcccagcacttgaagcctagcgcccgggcgttttttgtgtttcttgtgggtgtgttcatccggctcgtgtgtggtagctcggagtattaagggtggagccgcggttacttctaaccccatgtttgtgcaggtttttgtcgtatggctccttggggctttgcgtccaataattgctcagtcttgttgacgcaggcgtacttggcctctagcgttcatgtctggtcgcgtgggcggattctaatgttgtttacctcgagctgttcttggtcgagccaatccttaagagcggatcatcggggagggccaaatttaccgggttccgactctcgttataactgcggttctttcttttgtggcaagcggtggtgcagattaggtgaggcttccgggtagcgggttctgcttgttgagtctgtccctgtgttagcttaagattgagttggtgtttagtcttttatttttctttgatctgcttcttgtagtctttgtacttctgtcaaaaattgaaaattggtaataatatctttacatttttacc

SEQ ID NO: 215 - DNA, 1418 bp, Brassica juncea
tcgttaagaatgtacatacaatgataatctcgaatacaaagtgtatgttgagatttgagaccagatctaactacaccgaaaaacttgcacagataaaagcataaaattgtgaaaattaaacaaaaagacataggaagtgaatgaacatgaaattcatataaagaggcaagaattcacagagtaattgccatgaaatgtatgattacacacatcttttacattataataacattgaagaatacatggtgaaacacttaggccggcagaacacataacgatctccggaaaccaaatcccaacattgggagacttaagctcaaaggataggacatgagcaactaaacagatcaaataaactaagacaccttgcacgaaactaagagaatacatacaacaaccaaacaagaagtaatagaatcatagcttaactgactacgattagccggattccttgctacgaactgagcaagacagcacgcaccgcaaaggacttcatgaagaatagcagcaccctcatctgaaccactcgttcacgatgatcacacacaaactaccttgagaaaccaaaacaacacccataaagaaacaacacccgaaataaaccccttactcaacaaacccttcatctggacgcttcaaagcctcaacctctttatactgcttcaatccatagaagccaccgaggataaacaaagaccaaagacagaccaggaaaccaaacttattcaagggaagagagaaggacccttagcagcagggagatggagaggtgacctgaaaccagcttcttcttgacaacaatacctaacaactgctcatcccacaccactgtgacgctgctacaccgtagctgaatcaatgaccaactaagataaactctacactccaagcaagattaatcagattctaccgcagacgagaggaccaaaacagaaactgaacacaacctaaggacgagacacatatgaaggtgatagatgatctgaaacccactagaagaaggataatgcccagactagaaggaaccatgaacacaaactaactaaccaccagaccggaggaagaaagagtagatctaggggttcaaagagtaccaaactctgataacggcgaaaacaacgcacacacgacttcattttctagacgaaaccactccctaaccaccggatgctgaaaatgctctccacgcgctgccacgctccttcacgccggaatcttcacacctctcaagcaaatcagatccataccacaccttcacaaaacaacaacaggaacgaaacaaccatgagctagagccacgaaacccgactccggtgctatgtgagccaccggagtcgaccactctgtaaacctagatctgagtctctctctctctttctcgctctctatttctttttccaaagtcttcaggatcccat

SEQ ID NO: 216 - DNA, 1138 bp, Brassica juncea
agaaaatgaaaacatttacaatcaaaaaagtgaaaaaagttgtagatctctctctaaaaaaaagcgctctcttccctctcaagaaacaaacggcgtaaccctaactccggctcggcggccgccgaagccggaggcttctctccccccttaattcttctcttctctttgctttcttctctttcgtccttccccaaagtctccctgcttgtttgttctgggtttgtcgaaaccaaccggagactcttagtgagtttgtcggtgatagtcttcggcctcttcctggaataacagcgatacttttgcggcgacgaagtaggaaagagtcggcttttagagctgaagaccagtcggatctggttttcccttttcatatctccggctactcctcgacagtgacggcacgtggtttggtgagacgcctcctccaccatggatctcccttcccacgaagcggtgagacattcagaggagaggactaacaaccggtgaaagtggtttgtccttcggttctcggagacaacatgtacaagggcttcgtgacaaaggactggtcaaccggaggagcgtatcctcacgacggtacgtggcggcggctctgcatcccagcactggaaaagagtgtatgctccaaccggtggtacgagctctgcacctctgtaatttggattcacggaaccggctcgtgtctgacaccgaagttcgctttttgcactacggatgagtctgtccgtttttatggctgaggatcgaggcattgaagactgatgagttgagactagttcgggaaacgccttctggtagatgctgttggaacaaaaacttcaagctgatcattagggaccaatagctctgtatattattgtaatctcgaattaggttctgtctctttgtgtttagtaaatgtcttcgtatcatgagatcgaatttcggtggtcttaagagaagaacttattccgatcgtgggatgggtttgtttctcaccgggtttaaatgtacaatgggatcggattgggtagcgttggatcctcggatgtgatccagggtgatactaaatcatcccatttgtataaggggttaaatctctgttgaggttaaatctgcgtacccaaattattggttaatggaggttgtacttgag

SEQ ID NO: 217 - DNA, 1790 bp, Brassica juncea
tgacttgagcgtcgattttgtgatgctcgtcagggggcggagcctatggaaaaacgccagcaacgcggcctttttacggttcctggccttttgctggccttttgctcacatgttctttctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttaaaggatccagacaatgttctgagagagaaacagagagacaccggagagatttcaatccctagttccggccggccggtttggctgtgccggaggcgattctctttccccttcctcattttttctttgctttcctttccccagctcaaaaccgagacgatatgcaagctattctgacatggccgtttcctccggagctcgtgttgtagacggagacgatgtcttgtttggagttgcggcgagtctaggtctagactgagaggaggaggatcggcttttaggattgaagggtaggccagatctaattttcccctttcggatctagggtttaaccttcctggtaatggcgcgtgaagcgggtttgacgactcctttggctcggaatcacctccttacgtgacagtgagaagggtggaggagaggtgtgataaaacggaggtaggaggcttgctgacagggtgaactctcctgaagccttcatcagggtctcaattgcttttccattgccaagatccgtctttcagtccggacttctgtccggcttggccatggtgcgagacggcgaacgatggtggcacgaatcgaagcgggtttgcgactttaggtgatgatgcagctgggttacggtctcgactcatatcctttggaatcctcagctttgaatttgtattggagcccgttttgattcttggttacagtttgttcattgcatccacatcacatggtctttagagtagttttttcagtcggactctatgtccgtacgtggctaaggacaatagcaattgaacgccagcagatacaagcctcccgcggaaacgcgccttcgggtgaagatgctactggcaacgtacagaatgtcgatcctatgaggccatagcttggtgctgaactgtttttttcggtatagaattgtgtttgctgtgttagtagttgttttctgtcgtgtgtagaatgtaggggtctaagaggtgagtctcatttcgagttgtggagtgagctcattttcgttgtggttaaaaatgcaatggtgtttcagttgggtagcgttgaatccaagttagtgattcagggtgttactagactacaccattgcatcagtggtcaaattctgtagaggtcaaaatgtttgtaccttattgaattggtgaatgaaagtgattattgactcgagaaaaagggcgaattctgcagatatccatcacactggcggccgctcgagca

SEQ ID NO: 218 - DNA, 1447 bp, Arabidopsis thaliana
agtctgagttttaataatttattttccatttttctgtacagccagtcctcgtcttgctggcctgcaataataatgtctctgatcggccgcctcaatcttggtcggcgcttctgcaccgccgtgccaagaagatcggaagacataatgtcaaacccagattgccgcccttctgatctatgcttgagggtctcgtacttgatcagatgcgttggggatctcgacacggcggcgaagtacgctcgtttggctgttttcaccagcatcaaatcggagtcaacaacaacaatatgtcaatccatcatcggaggcatgttacgggataaaaggctcaaggacgcttatgatctctacgagttcttcttcaatcagcataacctcagacccaacagccattgctggaactacatcatcgaatctggtttccaacaaggtcttgtcaacgatgctctgcatttccaccaccgatgcatcaattccggtcaggtccacgactacccaagcgacgattctttcaggatcttgactaaagggttagtccactccggtcggttggaccaagccgaagcctttcttagaggcaggacagtcaatcgaaccacctacccagatcacgtggcgtacaacaatctgattcgcgggtttttggatcttggaaattttaaaaaggcgaatctagtcttgggcgaattcaaacgcttgtttttgattgccctatccgagaccaaagatgatttgcaccattcaaactatgaaaacagagtcgcattcctgatggccacattcatggagtactggtttaagcaaggtaaacaggtggaagctatggagtgttacaaccgctgtgttctatcaaacaggttactggtttgtgccgaaacgggtaacgcccttttgaaagtcctgctcaaatacggtgaaaaaaaaaatgcttgggcattgtaccatgaactcttagataaaaatggaaccggtaagggttgcttggactctgataccattaagataatggtggacgagtgctttgatatgggttggtttagtgaggctatggagacctacaaaaaggcgagacccaagaacgactacctcagtgacaaatacattattacaaggttttgcgaaaacaggatgttgtcagaagcagagtctgtttttgttgattcacttgctgatgattttggatatattgatgttaacacttataaaacaatgatcgatgcttatgtgaaggctgggagaatacatgatgctataaaaacctccaacaagatgatcgatgcaactctaaaggaggtctcccatctcttttgaccattcctcgtcacttggtgatctttatttaatgtccctttttaatatattttttatcagacaataatagatttttgtttgtttttattggtcggccaatttatccactagatgaagacataaacgtttacagaac

SEQ ID NO: 219 - DNA, 3678 bp, Arabidopsis thaliana
atgatccccaacggagaattgagattacctgctctcaaggtccgtgaagaccgcgtgtcaccctcagctcctattccggtcaccagaaccctagtggctgatactgacgtcacttccgatgacgatatgagtacaaattccgaggatgtctctctcgattcgtctcccgagaacagtagagtgtccagtgccgttggtcgcagctacgggagaaattcttcttattatacttactccgaggtgagctcatcaagagagactttggtcggtgcgcgcgaacagacgggacctagatttgatggtgatacggaggaagatgaatccaccgattcagcttctagcacgcaattttctccgccgccggcagctgggaggattaacgacggcgtatctcaggagtttgatgagacgttttcttctgaagaagtaagcgatattcccagtgcccctccattttccggggcagcagaggaatctgaagaaattaaaccagcaacttcaagcgttcaagtttcagaagtcaaaacaggagattgtgtagaaagtagaaagactggccactttactagacctagtgcagcttctgagtcatctgggccacctgatcaacatccagctcggcttcctacttttcatgcaagttctcgtgggccatggcatgctgtggtttcctatgatgcatgtgtacgactttgtctgcatgcgtggtcaaccggttgcatggaggctcccatgtttttggaaaatgagtgtgctcttctacgagaagcatttgggttgcagcaactccttttgcaatcagaggaagagcttctggcaaagcgatcttcacaagctccgcacgaaggagttgcaccaaaacccaagaaaaacattggcaaaatgaaggtgcaagtacgacgtgttaaaacagttatggatggtccaaccggctgtagtatatcatctttgaaaccatcgttgataaagtttgagaaaatccggattcacttttccaatatgtcaacacgcttattttctggatggcgggctctaaggaagatccatgtccgtgtaccagccaatggttcttctcttcctcgtcaaagtctggcatatgttcatgccagtacacagtacttaaaacaagtttctggtctcctgaaaaccggtgtcacaagtctacgtaataattcaacatcttatgatattgtacaagaaacatactcgtgtaagttaagattgaaaagcttagctgaagataacgccattatgatgcaacccggatctggtgaaagccatgttttctttcctgatagtcatggagatgatctgattgttgagatcctggatccaatggggaaggattttgggcgtgtacttgtgcaactagctaatatttctgaagattcgtacgtttcaagtgattctaatgaagaaaccatacaggctgagaaacttcgctggtggtctgtttttcgtgagccagaacatcaacatgtgggaaaactccagctctatattgactattcagcaagttttgatgataacagccatttgaagtgtgcttctgttgcggaaacagtcgcatatgacctagtcctggaagtggccttgaaaatgcagcgatttcagcaaagaaacttgttgttatatggttcatggaaatggcttttggaagaatttgccacctactatgggatttcagatgtctacaccaagctcagatacttgtcctatgtaatggatgtcgctacaccgacttccgactgtctccatttggtacatgacttgttaacacctgtcatcatgaagggaaatggcaagagcgccttgagtcatcaagagaatcggatcttgaatgaaatcaaggaccagatcgagcagattctaaaactggtctttgagaattacaaatctcttgacgagtcgtcattttctggaatgattgatgtggtcaattctgcgtcaggtgttccagcgccagcactcattcctgctgtgaaattgtacacgcttctgcacgatgtcttatcacccgaggatcagactcatctttgtcattatttccaggcagcagcaaagaagagatctagaaggcacatgggtgagacagatgagtttgttgcaaacaacagcgagcccaatttttgggatatgtctgcaatgtcggctgcataccagaaaatgacaatggcctgcaagaatgtaaagaatgagatctatactgatattgagatccaaaatgaagatatacttcccagctttcttgaccttccaaacctgtcagcgtctatatatagcactgatctctgtaatagacttcgagcatttctcgttgcttgtccgccctctggcccttcaccaacagttgcagagctcgtgattgcaactgcagactttcaacgtgatctttccagctggaacattagtcctatccaaggcggtgttgatgcaaaagagttgtttcatctatatatcatgatttggattcaagataaacgcctttcattacttgagtcctgcaaacttgataaggtaaaatggtctggagtcaggacacagcattcaacaactccattcgttgatgaaatgtacaagaggctgaacgaaaccattcaagactatcaagttatcatttccagatggccagaatatatctttgttctggagagtgccattgctgatgttgaaaaggcaacagtggaagctctggagaagcagtatgcagatgtcttatcacctctcaaagaaaacttggctccaaaaaaactaagcttcaagtatgtccaaaaactgaccaaaagatctgtgattccatatgtagtcccggatgagctgggcattctattaaactccatgaagaggatgcttgatgttctacggcctaatatagaggctaaatttaaagcatggtcttcatgcattcctgatggtgggaatgcagctcctggtgatcgtctttctgaggtgacagtgatgctcagagccaagtttcgtagttaccttcaggctgtggtcgaaaaacttgtagaaaatagcaagctacaaaaaacgacaatgttgaagaagattcttcaggactctaaagaaagtgttggagaatcagacatcagaagcaaaatgaataacctcaaggagcagctcaccaacacagtgaatcatctacactcggtttgtgagacgcatgtcttcatcgcattgtctagaggatattgggatcgtatgggacagattgttttaagctttttggagaacaggaaagagaacagagcttggtacaagggttctagagttgctgtctcgatattagacgatacatttgcagcacagatgcaacagctgcttggcaactcgctaagagagcaagacctggagcctccgagatcgatcatggaggtccggtcgattctttgcaaggaccctgcagataataaagccaaatcgttctactactgagcaccttaacagctaaaaatgcttgaaagatttcagatctcatttgctcgtctgcttgaagcttcaagtattttacttggtggagcaaatcgtggaaaccttgagaaagctttagatgtataagaaagtacaatgggtaccacatctttctttagtgctaatcaaatgtcaatatattacaagactggcatcacatctgatacgaattgtaataagagttggaagtcaaagttttactac

SEQ ID NO: 220 - DNA, 5579 bp, Medicago truncatula
atgaaactgaatcaagcaggttctcagttacctggactagcccaactcaatgggaacggacagatgccatctttaggcggtgtttcacgatcagcacttaatatggaccctgaatttcctagagcacgcgagtttattcaagagaagatctgtgagacgttatttcgacggcatcagcagccaattagtgaaattcaaaaaaggaggattaaggatcttgcaaaacgcctggaggagggcatgttaaaaaatgctccttctaaggaggagtacatgaacttggaaacactagaggctcgtttatctcttttcctccgacaagcaactatgaataatcgcagccaacagtatccccagcttgttagctcgtctcctattggtacaatgattccaacccctggtatgtcgcatggtccaaattcaaacgtggttgttgcatcttctatagatgcctcaatgatttcttccagtggtggtaatagtgtagtatcaacaactttcaatggtgtaaatatattaccaactggtggcatacatggaagctccttaaatagatctgatggtttatcaaatggatatcaacagtcttctaccagcttttctgctggctcagtggggaacatgtcatcaatgagtgtgccgagaacttcaagccagatgattcctacgccgggatatacagtcaacagcaatcactcacatatgaatgtagattcatctactaatggtaatgtcttctccagtgcagagtctactatggtaccactgtcacagcttcaacagcagaaacagcatgttggtgaccaaagccaggtattgccgaacattggcagccaaatgagtagtggaatgagatctggtttgctacataaacagtttacaaactcaaatggtgctgtgaatagtgggctaggcctgattggtaacaatattcaactcccaaatgaaccagtcacctccgatggctatgcttcaacttatgctaattcccctaaacacatacatcagcactttgatcaaaatcagaaaccagtaatgcagggtgatggatacggattgaataatgttgacccttttgcttctggaaacttttatgcatctgcaacatcttctgggtctatgatgaacactcggaacacaaattcagtacaattgccatcaatacccaaaactagctcgttgatcagcggtcactcaaatttgcatggtatgcagcagtctgctcacataaagtctgaagcaatcaaccaattggaaaagttgaattttcagtcttcatcaacttcaagagatgcccttctgcattctcaacagcagtatcagcaaaggccccatcaatttcaacagtcagagcagtatcctcaatcacagcaacaatttcaattgaaactacatagtcaacagcctcggcatttggtcaatgataatgctttcaatcagtctcagttgtcttccaatctagaaaaccaagtgaagtcagagcctggaattgagcatcataaagaagtgctcagttctcatgttcctgaacagttccacatgtctgagatacagaatcagttccagcagaactcatctgaagattgctctagagctcaatacctttcctttccatctggtcagcataatttatcctcatcagtacctcaaagttcgcaacaaatgttgcatccacaccatttggttgcagaatctcaaaataagttcagctgtcttacagttgaggctcaatgcaattccaaacaatggactgactcacaagatggtaacccaatgtctaacaatagttcacacgaccatcatctccatgtggattttcatcaaagaatatcaggaaaggatgaagctcattgcaataatttatcatcagatgtatctatgggccaagccgttgctcctaggggtgcagctgagccgctagacccaggaagtactaccaaaaatgcacacaggaatcaacaacggtggcttttatttctacttcatgctcgacgatgttctgctcctgaaggacgatgccaagaacgcttttgttcttttgcacagaagctatgtaggcacatggatggatgcaacctgcgccattgtccgtaccctcgttgtcatcatactaaggaattgtttcatcattttatacactgcaaggatccatgttgccctgtttgtgtttttgtaaaaaaatgccggcgggcatgtcaacttaaggctcagagtcagccaccatctgaatcgagtttgccaagtgtggtaaatgggtcctgtaaatcttacaatattaccgccacgtcatcaagattgatctcaaaacccacattagttgtggaaacatcagaagacctgcacccatctgtaaaacgcataaagattgagcattccactcagtctgttaatcttgaaaaggacaactctgcttcttctgtttctgcaaattgtgattctgtagtttccagggacgctcagtcccaaacatatcccaatgcggagaagtctatctcaattaaatctgagattacagaagtaaaagcagaagttttggctcatgccaagcttagtgaaatgaagatggattcgagtaatgcagatgataaaattcctgatggtgagcctgtgaagaatgatgatactggtaatttagctaggccagaaaatatgaaaactgagaaagaagttgggcaagataagcaagaacatgtgatgcagccaggtgaaaatgcagctggaacaaagtctggtaagccaaaaataaaaggggtctctttaaccgaattatttactccagagcaagtcagggaacatattactggtctcaggcaatgggttggccaaagcaaatcaaaggcagagaagaatcaagcaatggagcactctatgagtgagaattcctgtcaattatgtgctgtggagaagcttacgtttgaaccaccacctatttattgcacgacatgtggggttcgcatcaaacgtaacaatatgtactataccatgggtactggtgatactcgacattatttttgcatcccatgctataatgatgctcgttctgaacacatcgttgttgacgggactcccattgccaagtcaagattggaaaagaagaagaatgatgaggaaactgaggaatggtgggttcaatgtgataaatgtgaagcttggcaacaccaaatatgtgccttgtttaatggtagaagaaatgatggtggacaagctgaatacacttgccctaactgctacattgaagaggtagaacgaggagagcgcatgccattaccccaaagtgctgttcttggagccaaggatttaccgagaactattcttagcgaccatatagaacaacgattatttaagcggctaaagcacgaaagacaagagagagcaagatttcatgggaaaagctatgatgaggtgattaatatactggttgtcagaaatacatcatgttctatcttttactacatggttacttttctttttgggttaatagtgcttttcacccctgaatatatgtcattttcggttcctggagctgattcccttgttgtaagagttgtatcatctgttgacaagaagttagaagtgaaacagcgatttttggagatttttcaggaagaaaattacccaacagaattcccatataaatcaaaggtagttttgttgtttcaaaagattgaaggtgtggaagtatgcctatttggcatgtatgttcaagaatttggagctgaaagtcaatttcccaatcagcgtcgggtgtatctttcatatttggactccgtgaagtatttcaggcccgagattaaatcagtaactggagaggctcttcgaacatttgtttaccatgaaattctgattgggtaccttgaatattgtaagctccgtggttttaccagctgctatatatgggcttgtcctccgctgaagggtgaagattatattttgtattgccatccagaaattcagaaaacaccaaaatctgataagcttcgtgaatggtatctagccatgttaaaaaaagctgcgaaggagaatgttgtggtcaatatcaccaacttatatgatcatttcttcacatccaccggtgaatgtagggctaaggttacagctgcaagactcccatattttgatggtgactactggcctggggctgcagaagatttgatttatcagctacgccaagaggaagatggaagaaaacaaaataaaaaaggaacaaccaaaaaaactatcacaaaaagggctttaaaagcatctggtcattcagatctttcaggaaatgcatcaaaagatctgctcctcatgcacaaacttggtgaaaccatttccccaatgaaggaagattttattatggttcatttgcagcatgcatgtacccactgctgcattctaatggtgtgtggcaaccgctgggtttgtaatcagtgccagaactttgagatttgtgataagtgttatgaagcagagctaaaacgtgaagagagagaaagacatcctattaatcagagggaaaaacacagtctttatccagttgaaattactgatgtaccatttgatacaaaggataaagatgatattcttgagagtgaattctttgacactagacaggcatttctgagtctctgccagggaaatcattatcagtatgatacactaaggcgggccaagcattcctcaatgatggtcctatatcatcttcataatccaactgctcctgcatttgtgaccacttgtaatatatgctatcttgacatagaaactggtcaaggttggcgttgtgaagtttgccctgagtacgacgtatgcaattcttgttatcagaagggaggcattgatcatcctcataagttgacaaatcatccgtcagtggcggatcgtgatgctcagaacaaagaagcaagacaagttcgagtattgcagctaaggaaaatgcttgatcttctagtgcatgcatcccaatgtcgttctccacattgccaatatcctaattgtcgcaaagtgaagggcctcttccgccatggtatgcactgcaaaacacgtgcttctggaggctgtgttctttgcaagaaaatgtggtatttgcttcaacttcatgctcgtgcatgcaaagaatccgaatgccatgtgccacgatgcagagatttaaaagaacatctaaggaggctgcagcaacagtctgattcacgacgtagagctgctgtaatggaaatgatgaggcaaagagctgcagaagttgctaacaatgctggatgagtaatttgtacatgtaaatacggggcgcttcaaagaaatgttctacacatctagacacctatgctccaacggcatcggttgtttttgtgaatggaatacatagggtatacatagcttcctagccttgcagattcgctgattgatgacccgggttaaattgaaccatttagtgcagcttcgcagcttccctcagctgcaagggattaaccaggtccagcgagggtatttggtggcgcttccttttatgttgtccgattctttgattttgtctagttatttgtatcatcaatgtcaaatgtcatcgttgggtggcaggtgtactatagtcctaattagtc

SEQ ID NO: 221 - DNA, 921 bp, Medicago truncatula
cttatctcatgcaagattcatctggcttaaaatatgtttcaatcttcaagcctaccgatgaggagccaatggcatttaataatccccgaggattacctatctctgtggatggtgaagggttaaagaaaggcacacaagtagggcaaggtgcattgagagaagttgcagcttacattttagatcatccgaggaaaggacctcgctcatatcataacaatgaggagaagggttttgctggagttccgccaactgttatggtcagatgcatgcatgaagggttccaccatcctgaaggttataagaatgtttcaagtaatgtaaaaataggatcacttcagatgtttatgaggaacattggaagctgtgaagacatgggccctagaacatttcctgtggaagaggtacataagatctctgtgctggatatgaggttggtaaatgcagatagacacgctgggaacattttggttgccaagaatggagaagatggtccaattgtcctgattccaattgatcatggttattgcctgcccaagagttttgaagactgcacttttgactggttatactggccacaagctcaagagccttactccctagacaccactgagtacataaaatctctggatgcagaggaagatattaagcttttgaagtctcatggatgggaacttccgctggaatgcgcccggattcttcgtatatcaaccatgcttcttcagaaaggtgcagaaaaaggactcactcctttcaccattggaagcatcatgtgtcgagaaacactgaagaaaaagtctgtcattgagcagattattcacaaagcagaggaagctgcacttcctggaacaagtgaagctaaattccttgatcttgtttcagtgatcatggataatcatttagaagggctattcccatgactga

SEQ ID NO: 222 - DNA, 917 bp, Solanum lycopersicum
ctctaatcgcggtctcaaccaccagactggcgaagaaagagctagtccggttcggaattatacaaactatcggaaaaatccttagcaattcggaaaccgctcgggcggtggtagagaagtcattgaagctgttggaaacagtagcgacgtgtgcagaaggcaggacggcgataggtaaaggcgaagagtgcttgtcggcgatagttacaaggctgatgaagagctcgaaagcagcgacggagcacggggtgacagtactatggagcgtgtgttgtttgtttcgtcatacggcggcgcgtgaggtagtgggaaaggcaaatgggctaacaaaagtgttgctggtaatgcagagtgattgctccgcggcggtacggcagatgtgtggggaattagtgaaagcattgcgcgtggtgaatactttctcagtccggacggaggaagtaataaagataaagaattattcaaagtcgtgtttggcgagttatgatacccaaactactcacattatgccctactgaaaaatataataaatacccctcttaattggtgctgactaaccatccataccaaaagaatcaaacactatttttcttttttttgtcttttaataattattagtccatttgtttgtttatagaaatggaattaggtaagattcatgctgtaaatccaaaggaattctgctaatgatacaaatgacatcaaactgttagctaaacagtacatcataagatcgtgatatttctttcattaatatcattgttattggttttatagtgttgtcatgattgatcagtgttggttgtattaggtatttttattagtttacggatgatatgatgtgtttattatccattgacgtgtaaaaccatatgcacataaattatatataaataattgatttcttaaaaaaaaaa

SEQ ID NO: 223 - DNA, 1345 bp, Solanum lycopersicum
tttggatgatgaaatctggcggttgaaaaagatcgccaaagatggtgcatcacacaaacggttgagtaaggaaggaatatcatgtgtgaaagagttcctacggctgtttgtcactgatccatctcttttacgtaagatgctggcttgtgggaacaacatatgggagaaaataactgaacacgtgagcacttgtccgttagacaacagcgagtggtacgtatacaacgctggagaaagtattgtacttctgttcaactgcatctatgagcttgtaggtgcaattcttgatggacaaaatttccagtccattgacaaattagatatatttcagaagcggatggtggaagactttaagcgtagtgtttataaaaatttgaattgtctagctccccttgaggaccattctttgattggccaagcaatccttacatctaatctgcagaatggccttaatcatattcctagttcaagccaacagaatatgaactactcagatgaacaaggtcaagtggagttccagagcaactctgatcatgccacaatttcatcaccgctagcctacacagctcaacaggatagtccaactacagtgtccatgcctgaaagctttaatggaatacaagcatttaattcgaccttggcaagcagtttcttggttggtgaaccttgctccagtatctaccctggtgattatgattggggttccaatggttcattggattcactagggatgactgattatctacctcctaacaacaattatcagtttgagacaccagtgtggcaagggaatgaattgttagcgagttcaagtgttcagccggtgtctcctaatattggctttcacatcacaagacgtggaaatcctagagccatatggtgcacaatccgtgctgttctgaaatggaaaacattggttaagagaaaatagctatttgaagattggaaaggcttttacaagtagatatctgaagtttgttcgagatataaccagcaaacttcacctccatctctcagcctattctttgacaattttaaaacataaatatatttatatgtccattacatatagcatccatcgtatatatgtgagtaaattgtacatatagtaaggtttttgtcaggatgaaggtgcatgtaggataaattttcttgcagaaacagtagcaagatatcaaatattatgaaatgccatcgtccttggaggagtttagtgctacccctttagtaaatagtactagtagttttcttgtgtttttctgcatcagatgtaataaatggtgcttgtacaggaagtaatattattaccttaattattagtttataaattaagagattctatgtc

SEQ ID NO: 224 - DNA, 724 bp, Solanum lycopersicum
aatccggcggatataccggcaggtatactaggaggacgagctttggaattgcttcgtacggggcaagttgacggcggcggtgcggccatcacagcggcggagagcagcggcttcaaggcggatgaagatatgagcccacggttgtttggtgtatcaattggggtaaagcgcgtgaggagaagcagcgaagaagaatctgaggatcaggatcaagtacaaccgcatggatcagacatgaaatcagagccgttagattcaggaagtgctcaacatgatgatcagccatggattgatcgattagatttagggtgttgatttcccttggagggtggggtccacagaagcacttcggcattgatgaccaacacgtgtacaatggaagattgttggttgtttctggtggtttctagaagaagtgagaaatcaagtcaaatggttttttgagaaggccccaaaagaggtggaaaaggagaaaaacgaagtggcttttttaatatgttttcataattggattggaaaaaatagagggggctgagctggttggttgaaaaagatgacaaatgttggaaatgatagtcaaatgtattaattagttgggattagggaaatatttatgttacaatttaaggtgccaactaatttttggctaaggaaattatttgtgcataattgaaacattaataatgttgtaactttatgtttagaaaaaaatacctgggtaaat

SEQ ID NO: 225 - DNA, 767 bp, Solanum lycopersicum
actcactagtaaaaatgaattctttgatgatcaagttgttgttttttctcgtccttatttccaatggatattcaacaaaattagattcatatcctccaacttgtaaaaaaattgaatgcccaaattatgatgtgattgaatctggaaaagactatgaaattcgtcgttacaattcccctatgtggatgtctactgaaccaattgatgatacgtcatttgtttccgccacccgaatcggtttcaccaggttatttatgtatattcaaggaaagaacgatcagcatgagaaaatggatatgacagcaccagttatgacacaagttaagccaagtgatggaccattatgttccacctcatttgttgtgagttttaacgtaccaaagaagaatcagccaaatcctccttcagctgaaggcctacatccccaaaaatggaaccaaagtagttatgccgcggtcaggcaattcagtggatttgttacggatggtgatattccgaaacaagctgctgcccttactgccagcatcgctgacactaaatgggcagcagctatcgaaaaaagcaggagtaaagataatagtacgatttatacagttgcacaatacaactctccctttgagttcagggctagagtcaatgagatgtggtttacttttgttatggacactgcaattgacatttgagaggcaacaaagtttactattctctcagtttattgttttgtattatcaaaaaagtgtagttgttatgtatgaccagaatgctat

SEQ ID NO: 226 - DNA, 431 bp, Solanum lycopersicum
caaattcaacaaaatacactcacttcactcactacgaagttttgactattataatagtcgcgactatattaaaagaaataagcaatttcctcgagatgaatagtgataactttagagttcaagatgaaggagtatttctactagcttcgagtcaacctaagaaacgcgcaggaagaaagaagttcaaggaaactcgtcatccagtttataaaggggtgaggagaagagataataacaagtgggtgtgcgaggtgcgtgagccgagtgagcaaaaaagaatatggctagggacttacccgacccctgaaatggcggctcgagctcatgacgtagctgcattagcacttagaggtaacctagctactttaaatttcgccgattctagttggcggttgagtgtgccgatatcaaaggatcctgacgaattacgt

SEQ ID NO: 227 - DNA, 918 bp, Solanum lycopersicum
cattagaggatggaagagataatagaagaaaaaaagatgaagattctttgtttgcatggatttagaactagtggaaatttcttaaaaaaacaattaagcaaatgggatccttctatttttgctaattctgaaatggattttccagatggaatatttgcagcaaagggtaaatcagatattgaggggatatttccaccaccatattttgagtggttccagtataatgaggatttcacagaatatgagaacttagaagaatgcattacgtacttgtgtgagtatataacaagcaaagggccttttgatggtcttctcggattctcccagggagcaactttatcaggccttttactagggtacatggagcagggggagattctgaaagagcatccaccaatgaaattatttgtatcaatatcaggtgccaaatttagggacccaaatatttgtaacattgcatacaaagatatgatgaaggttaaatcagttcattttattggagagaaagattggctcaaacttccttcacaagaacttacaacagattttgagaatcctatcatcataaggcatcctcaaggccacactgtgccaagaatagatgaagcagctgtggagacattgaaaagttggacaagggaagttgccttatcttccaatgagagttgtgttggtggaggaccaaatgaagcctgcaaacatgttaacattgaaaatggtggggaacaaggcaaaaaactagagaagcctaatgaagtagagatccaaaaggctcaagaataatagtcaaaagctcttctctattatattctatttttgcattacaaaagctagtttaatataaatatattatgcatgtagagacttaacctagtatgtacctatttatatctatttaattttctgatcaattcttta

SEQ ID NO: 228 - DNA, 1179 bp, Solanum lycopersicum
gggagagtttgcgcctctgcttccacaatttcttatctttccatctctccatcattgctaaaattttccggtggttattctcctctttgcctaccatcaaacgctttcctctcttcgttcctttcatcgacgcttatatatccctcttattccgatttgccaacttatcaccatgcaccctcgatctagacgaccaaaccaccatccatttctgggctcccaatcaccggcgttacgataaaccaaatctcgtcctcatccacggttacggaggcgatgccaaatggcaatttatgtaccaagtcaaatcactggctgaatccttcaacctctacattccggatctgttattcttcggtaaatcgtatacaactcggaaggaacgaacggaggagtttcaggcgaaatgcgtggtgcaagggttaaaggaattgggagtgagaaattgttcgatgtttgcaattagttatgggggatttgttgggtatcgaatggcggagatgaatccgcaaatggtggagaaagtagtgatattgagtagtggagtgggttgctcgaaagatcagaaggaagagcagttgaaaaagattggaagagatccggttgaattgctcataccggagaaaccagaggatctgcatgtgctcgtaaacttatcaatttacaagtacaatcctttcaagtgggcccctgattacttcctccaagaattcattgatatgataagtaggacttacctgaaggagaagcaagagctagtgcaccacttgctgtccaatcatacagattgcagattgcccatcctaaatcaggaaactctgcttatttggggtgacaaggacagagttttccctcttatgttcggctaccagttgcaaaggcatttggggcctagagcaaagttggaagttataaaaaacacaggacatgcagcaaacattgagtctcctgattctgtcaatgctttgattaaagcctttatcttgccgcaaagcaaagacttatagggttgacactgggattgatcttgatactgctaggcttagctgggggttcttgctccctatgttacatatctctattactttctcattgtttgtaaataatgaaactactaatgggactttaaagtattacgaagtctcctagatgatataaatcaagttgattaatgtatgt

SEQ ID NO: 229 - DNA, 1154 bp, Solanum lycopersicum
cttcaatcgaagcttcttctgcaagatcgatttcttctagaagattctgcaacagcggagaacttgatcaatcttcatcggctccacactatcaacgaatcactgaattctctcaactttgaagatttcagaggttatggctgatgacgatttccttcagctcctcaagagaattggggcatttcttactctcaagatttctaatctctcacaaacactggattcaagatgtgcaggagctatagcaggtcttgcatttgcaatagtatttatctggaaaataatgagatcacctagtggaccacagaggaggcatcctaagcaacaagctgttacacctggtagttctggtgtaagcagtcattttagtgaaaatgtaccgtcttcagaagttagccccccttcagagaattcaaatgcacaaaatgtcattgatgagttctttcagcctgtaaagccagctctcgggcaaatagttaggcaaagattgggtgaggggaggaaggtaacatgtcggttgcttggagtaatcctggaggaaacgagcccagaggaactacagaaacaagctactgttcgatcctctgcgcttgaagtgttgctcgaaatcaccaaattttgtgatctttatctcatggagagagtacttgatgacgaaagtgaaaaaaaggtcctactggctttagaagatgctggagtgtttacatctggtggcatggtcaaagacaaggttctcttttgtagcattgagaatggacgaacatcatttgtgcgacaactggaacctgattggcacattgatacaaatccagaaattgtttccaattagcgagatttatcaaatatgagctacacgttacgcctaccaagtcagaaagaacagctataaatgtcttcagttcaacgtctttggagcagttttttggagcagcttagacgcatttggtttgttgttttaggtctcaccgtcctcttcaagtttgggctgtgagagttcatatttttaactcaattacatctttttctggtacctgcaactgcataattttgaggttcaaggaaaaacttttgtatattacgctgttgtacgcagaacgtgtcacttcatcatcatatcatattcatatggtcgtaagtgagaagattttaacttc

SEQ ID NO: 230 - DNA, 1966 bp, Solanum lycopersicum
tggatacgagaactggagaacccattacctacatagaatactacaaaaagcgacatgggattaacatatgctttgaagaagaaccgcttcttaggggaaaacatatttgtaaagtgcacaattaccttcaaagaagcagaactcagaaggctaaagattcaactgattcatctgttgagttgcctcctgaaatttgttccctcatcatgtcacctctctctatttctacacttaatacctattcatatgttccttcaatcatgcatcggattgagtccttggttatggcctcaaacttgaaaagaatgcatttggatcactgcacactgaatgttcctattccaaccgctacgattctggaagcaatgacaacaaagaaatgccttgagaagtttcatttggaatcacttgagacacttggagactcttttctcaaatatgctgccagtataaagctgttcaagacttacgaaaatcatcatgagggtcttctcactgtcaagaaaactcagattatttccaatgctgcactatgcaagcttggatgtgctcgtaaaataccgggatttatccgtaatgaaccattcgatcttaaagcatggatcattcctggtgataattctcaagttcacagcttcgacgaagtgctcctaacgtcctcagataaaatgtatagtagggtaaaacagaagatcagaagtaagagagtagctgatgtggtcgaggcactaataggtgcctacctcagctcgggtggggaagtagcggctttgtcatttatgaaatggcttggagtggacatcaattttgttgatgcacctatgtcaaggcactttcccatgaatgctgagaagctagttaatgtcagatacttggaatccctgctacattacaagttcaatgatccttctctgcttgttgaagcgctaactcatggatcttacatgatacctgagattccacgatgctatcagcgcttggaatttcttggagatgcagtgctcgattatgttgttacagcacatctctatttcaaatatcctggactgactccaggactaattactgatttgaggtctgcctccgtaaacaacgaatgctatgctcaatctgcagttaaggctggcctgcacaagcacattcttcatgcctcccaagatctccaaagacagatatgtagtactgttgaggatttcgataaattgaaccttgactccacgttcggatgggaagctgaaactactttcccaaaggtgcttggagatgttatagagtctcttggtggtgcgatctttgttgattctggctttgacaaagaaactacatttcagtgcatacgacctcttttggaaccgttggttacacctcagacactaaagccccatccggtaagagagttaagtgaactatgtgaccagaaaggttatataaggaagaaggatgtcgtctctcgtgagaatggtatagcttatatcacagtagaggtcgaagcaaatggcgttgtccacaagagtacatgctcgggacgagacaaactaatagccaagaaggtggctagcaaaaatgtgctcaagtctctgaaagaatgtccatctaatgctactgaacagtagttacaaaattcccagaattgcttaaatattgtaagtgtcattctgtttggatgtgttgtttcatgatatgtactattggatctgttgttatgtgaaaaatgaaagattctccatctatggttaatttctttcgtaaagacggaattagtcgagaaatctttctttctgaacaatttcaacatcctcgttgagagtagctttgtgagacgacacgtttagttgtctctgacttggtcttcgaataacgtggtctatgttttagtgtgtttttgttcttttacaaggttaaagcctcaaaatttcttgtgaaatttcgttgaatatataaatatttttttaagtcaaaaaaaaaa

SEQ ID NO: 231 - DNA, 949 bp, Solanum lycopersicum
cctcatagactatatcttaaaaaatatatgaaaatgaataatctttcactcttatttctcactcatctcacactatttttcatttgtgtttgttaacaaaatatagcacaaacacaatttgtttataaatggtcagaaacttattgtaataaggatacccctgtgggatgtaagcaaattcctcctctcaaattcactctaaaaggtttttggggcacagattccaatggaaatattcaacaaggttgtaaagatccagtagaacgtgattggaacaaagtgtttgataccgcgatggtagataaactcaacgtattttggccctctcttactaaacaagatcccaaagacatgtggaaggaagcttggaatacatatggaacatgtacaatagaaaggttcaaaactccaatacaatatttcaatagggcttcaagattggatagtgaaattggagatttattacaaagtcatttaataagctcaaatggaattgtcccttgtgactctgctacatacaacaatgttgagatcttgaactcattcaaacaagttgcaaaggataaagatgtgtctttcacttgcaaagacattaacacaactcatgcttatttgaatcaagttacattttgctacacaaatgatgcaaagaattttgtgaattgtccaacttctctcattaacaaacgttgtcgtgttcaaaacattattgttcctcgtccttcgcctccaaagcctatcaaacaacaggagaaaagcttggaccaaatagcttatggagattcttggtcaattgtgtgaagctttattatattagaaagtttagcgactaataataatattaattattattattaataatagaaagatgaataatgtttttaattgtgactgtgatatgcactgaataatgaagcccctccaatgatcatctttctattttatatta

SEQ ID NO: 232 - DNA, 821 bp, Solanum lycopersicum
ggagtgttggagaaccacgttagcagtatacgacaaggaagattaccagtgtccagtgtgcgtgtgtgtaatttataatcaacaaaattagcagtggccgagttatcttttagtttttcaaaaacaagaagaggtgcagagaacagggagggaggaagaagcaatggcggagtctcagttggttcaccctcctttattcacctatatctcaatgatcactctgctcactttagtacccccttttgttattctcatgtggtatacaaatgttcatgctgatggatctgtattgcaaacatataattatctaaaggagaatggcctgcaaggactaattgacatttggccaagacccactgcaattgcgggaaaaataataatttgctatgctctatttgaggctacacttcagcttttgttgcctggtaaaagggttgaaggaccgatatctcctactggacacaggcctgtctataaggcaaatggcatggcagcatatacagtgacactaattacctatctcagcctttggtggtttggaatattcaatcctacaatcgtgtatgatcatctgggagagattctctctacactaaattttggaagcttaatcttctgtctctttttatacataaaaggtcatgttgcaccatcttccactgatcacggttcatcagggaacataatagttgactactattgggggatggagttgtatcctcgcattggcaaacactttgatatcaaggtcttcacaaactgcagatttggcatgatatcttggggactcctccctattacctactgtataaagcagtatg

SEQ ID NO: 233 - DNA, 667 bp, Solanum lycopersicum
gctataagaaagatatcattaatattcaccatggcttgttgccatcgttcaagggtagtaatccatctaagcaggcttttgatgctggcgttaagttgattggggcgacaactcacttcgttagtgaagaactagattcgggaccaatcattgagcaactggttgaaagggtttctcatagagataatttgcggacatttatacaaaagtctgaggatgttgagaaaaggtgtcttgcaaaagcaatcaaatcatactgtgaactgcgtatttttccatatgaggcgaacaagactgttgtttttaggtcctgattgaaaaggaagctgtggtagctgcatcatctctttccattctgtccatcattcgggtgatcatcgatatcatcgttatcactcagttatccaagcaaaacttccacacaggccactccgagaagtaaagacagagaaggtgttgcatctggaaaagggaaaaaaaaagaaaaaggtttcatctgaattcatgttttaaaattcgaagatttaagacactgtcttgaaatctgtttccaccttatcacatgcaacagatatttgtacaagttccaaattttgttttttgaaatcaaaagtgcctcaaagctgctttcaatggttatagaacttttaaacattttgtcatttgg

SEQ ID NO: 234 - DNA, 639 bp, Solanum lycopersicum
gaaaacttttaattgcaatttttacatttttcttcttcttattcttcctcttatttttgaatcatgttgtttagcaagagttcaagttcatattatcaacaagcttcctgatggactggcaatgactctccattgtcaatctcatgacaatgatttaggacagttgagattgacgggaggtgacgaagctagttggacttttagtgttaatttttggggcaccactatgttttattgcgacgctcaatgggatgatagttccacaacatatcgttttgttacttatgatgccgctcgggatgcccgacgatgtcaaacggaatgctggtggatgatctctgaagaagaaacgttatatggttataatcaagagagtgaatactgggagttgtttcccttcaccagtgcataaaatctcttaatgatgcctattatcttcgtgtgtgtttaaaaaattatcaatttttcgtatttaagattaaccaaatccaattatcgttacttcgtacaatgtaaggttgttcggtgatcaacacatgtaacatgtacaaggcaatatgatatttatatatagttactattacttacaatttcatcattgctgcaaaattatcttaatataattataaagtttgatta

SEQ ID NO: 235 - DNA, 632 bp, Solanum lycopersicum
gccggaaaattcaaaattatggaggtacataaacggaaatatatacacgatggagagatcgaagcaaaaaagcaaatgaaaacggaggaaattgatggaacggcggcggcggtggtggaggacgacgaagtggaggagttttatgctattctgcggagaatacgagtggcggtgaagtatttcgagaagggaaacgccgagggcagtggcgccgggagaaatctgacggcggcgaagccgtggagtccgaatttccggcaggaggaattgaaacgggctgttgacggcgttaaagagagagaaaccgtggaagataatgcgggtttggatcttaacgccgacccggttactgatccgagttcttcagaagccaattaatttaatttttttttggcttaactattaggggatttcaagataagtgggagtaaaattattataattcgataatatgtttttctttttcattttaattggatcgagttattttttttttttttttaaggttaattattaggatattttgactcttaatatgtttttcgcccattttaattgcctcggaggggctgtaattactgattatgactaattatacactaaaactatatttatatccgttaaaaaaaaaa

SEQ ID NO: 236 - DNA, 597 bp, Solanum lycopersicum
agctgtccagggtttatatcagacggtttaaatagagttaggtgggccaacaaggcatacaaggcgatggtgggtgatggggcaggggaagtggttgtttggctagtgatgaaagatgatgtacggctgccggagagcaaatccatggcggcgttcacttgccgggttagggttgtcaggtgcgggaaggagaaaaattcattgattctgccgtgcgatgtgtggagaatggacggcggaggatttgcatggaggttggatacagaagccgctctctctttggggcggtaggtaattgaagtaatatcaactccacccgaagggtaaagaagtaaatttgtatgccgaaccactaataaaactttgccaccttgtgccttgtctacgtatagaggacatgcagacgacttgcatgtgcttttatcagaagaaaaaattgtgaatatctttttagagttcagaaatgttttttttaggtgagtttttatttttctttggttttttcaaggtggagttcgggtggtggcggatttacttatgcctagtttatgggatgtttgttagggatacttgttgaaatacagttactactggtcg

SEQ ID NO: 237 - DNA, 794 bp, Solanum lycopersicum
gctcgtaaccctattttctctctcattttgccggagtttcgatggctttcgtaaactccatttcaacagttacaagaccataccgccattctcgtttcttataaacactctatttctcaaacaatttcaactcttattcccaattttcaactttaatttgtcaaagatgtggagaaattcctgtaatctattgaaacggacagttacattggttgcgaggacaaatacggttaacaatggggtgaggccgtttttgggtgtggattataagttcgggtgctattgtggcccgaccagaatggtgggtgggtactattttagctctgggtcaaatgggggtggggaaaacaagaatggggatagtattactcatgaggaagctaagaggttgatgagattggtgaatgttgaggagctgaagtggaaattggggatgaagaatacggaggttattgggtatatggatctgttaaaggcgtgtaagaatatgggtgtggctaaaacccatgatgaagctgttggttttgctagagttcttgatgaggctggtgttatattgctattcagagataaagtttatcttcatcctgataaggtagtggatgaaattagaaaggcagttcccttagcacttctacccgaagatgaccccacaatagaacaactaaagattctgcaagagaacaaggacaaaatagatgagcttgcccataggcatgtgcgtcgcgttttgtgggctggtttaggggctggccttttgccggttgggctcttcttccgtcttacgttctggg

SEQ ID NO: 238 - DNA, 744 bp, Solanum lycopersicum
gtaatgagctcattgagcctaaagccaactttcactcatattcattttctattttattctctactcatctccaaatttttgttaaattaacctaaaaaataaaagatggcttctaacacattgatgagttatggaattgcacctgtttacccctctattctctcttcttccaagtctaaattcgccaccgcgttgccggtatccaccggagttaccaacgacacgtcaaggttcagtatgtcggccaattggatgcccgggcagccccgtccatcctacctcgacggctcagaccccggagatttcggatttgatccacttggttttggagaagtaccagaaaatttggaaagatacaaagaatctgaacttattcattgcagatgggctatgcttgctgttccagggatcatagtaccagaggcattgggcttaggtaattgggtcaaggcccaagagtgggcagccattcctggtggacaagctacatatttgggccagcctgttccatggggaacacttcctactattttggctattgaatttttagccatagcctttgtagaacaccaaaggagtatggaaaaagattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatat

SEQ ID NO: 239 - DNA, 343 bp, Solanum lycopersicum
caattgagaaaaacaaacaagaagaagatgaggaattgtatagtttagaagaaactaataaacgtagagtagtattcggagagttagaagctatttgtattcgtggaattgcatctgaatctgctgataatttgccaaccaaccacaatgtcacttttcctgaattggctctcaatgaagccatggttaacaaaatggataatactatgggtaaatttcataaaaggaagagagggaaagatgaatggggaagatttttcaagtcattagtgaagaaactggcgaaccaccaagaagatctacaaagaagtttgatggaaacaatggagtgattagatcaaga

SEQ ID NO: 240 - DNA, 180 bp, Arabidopsis thaliana
atgttagaattgttatgtctagtgaggaccgataaccaattacatagtaacccttgtaggcagtcttttccatggacttggctcgagtctaaggagcaatggggcctcagagattattatgaaactctatatgtcattttagcttccaagtgtatggttaaatttaagttgaaaaagtaa

SEQ ID NO: 241 - DNA, 629 bp, Solanum lycopersicum
atcaaaaaaaaaaagaaaaaaaatccccaatctccaatggcaaaatccacaaaaattctctcatcaatcctcattctcttcttcattttcagtctattttcttcatcaaacgcattaggcggaaagctcggcggaagaacacaaatcaaaaacgtgaaaacaaatcaggaaattcaagatctaggtaagtactgtgtcgaagaacacaacagagatttgcggcatatcaatggtgctttgagttctttattgagtttttctcaagttgttgaagcagaaaaacaagttgtttctggtgttaaatattatctaaaaatctcagctattgttaaatcatctagctcaccaaaattgttcgatgctgttgttgttgttaaagcttgggagaagaagaaggaattgcttacgttttctccttctccttcaccggctacaaagtgaattttcgatggttgatagtggctaaaagttaaaacttctagtagtgctaatgttgtttaatctaattttgaagtactttaatttgtagcctttttattttttttaacctattttgagttctcttgtgtactatgtgatgcaataatcaatgaatgacatatgtattagtatgttattatagataaatt

SEQ ID NO: 242 - DNA, 2183 bp, Arabidopsis thaliana
aagatgaaccccaaaatcagaaaacccaataattcatcttcgaagaaggtcacagtttccgttctctctgttttcttagtgttcgtcttcgttaatactttcttctacccaagtttttactctgactctggctcaattcgacgcaatctcgttgattctcgagaaagtttccattttccgggaaattttcgtaaaacgaaggtttacatgtacgaattgccgacgaattttacttacggagttatcgagcaacacggcggagaaaaatctgatgacgtcaccgggttgaaatatccgggtcatcagcatatgcatgagtggtatctttactcggatcttacccgacccgaagttaaacgagtcgggtctccgattgtaagggtttttgacccggctgaggcggatttgttttacgtctctgctttctcttcgttaagcttgattgtggattcgggtcggcccgggtttgggtacagtgatgaggagatgcaggagagtttggtgagttggttagaaagtcaagaatggtggaggaggaacaatgggagggatcatgtgattgttgccggtgatccaaatgcgttgaaacgggtcatggatcgggttaagaatgcggttttgcttgtgacggattttgaccggttaagagcagaccaagggtcgcttgtgaaagacgtaatcataccttattctcataggattgatgcttatgaaggcgagcttggagttaagcagaggaccaacttgttgttcttcatgggaaatcgatatcgcaaagatggaggcaaagtccgagatttgcttttcaagctgcttgagaaagaagaggatgttgtgatcaaacgcggaacacagtcaagagagaatatgcgtgcggttaaacaaggaatgcatacgtctaagttttgtctacatctagctggtgatacttcttctgcttgcagattatttgatgccattgctagtttatgtgtcccggtgattgtaagcgatgggattgagctaccttttgaagatgtcatagattacaggaagttctctatattcttgaggagagatgccgctttgaaaccagggtttgtggttaagaagctgaggaaagtgaaaccaggaaagattttgaagtaccaaaaggttatgaaagaggttaggcgatattttgactatacacatctaaatggaagtgtgaacgagatctggagacaagttactaagaagataccgctaatcaaactgatgattaatcgggagaagcgcatgatcaagagagatggaagtgaccctcaatgttcttgtttatgctcaaaccaaaccgggatcatccatggtgtctagtaaggttaaatgcctagcaagctcatgctaagcaacaaaatgtgatcattattaatgatgaatcaaagactggaaaggaacaacaagagaaaccacatcactctctaattccgggtcaagggtttgatcaagaatgcgcgtttcctggtgggttttgactttgggagtgttaaatatcaagagagattcaagcaaagagagatctcagggcacgctcccaaccctcgaccctctcaggctcccctgcatggttttgcttcagttgcttaaaaggaagggaaaactctccatcaagattgccttctccatcgggattggctgctctttttacatcgtccgatcttacgttatagaagattggaatcaccacgagtttcttttccttcatctgttcattcatcgtcacaagctcatccaaacaccactttgactcacagtacctcttggagaagatagcaagcgcgatttttgacttcttgatccttgtgaagagatattgtagtcttctccctttctgctctttagtgtctatgaagacgttgatccctgcgtttcttaattgcagctctagatggttgacaaagatttcgcgcagctcatctcctcggaagttgataaacacctgatcagaaagaggttcttggacctgctcatccattggaatggtgtctaggttcgtctgaataaaaaatagtgaatatagttggtgagagactttgttgtctcactttgtcctttaaaatacattacagagaaacgattctttaattcttcagaccaatcagtggctcgatgccaagtctgcgcctatcctcagtctttctttaatattatacaacattattgtc

SEQ ID NO: 243 - DNA, 931 bp, Brassica napus
atggacgcctgcggtccggtccggaattccgggtcgagcacgcgtccgctcatcgccggagacgacgaagcctgcggagacagccgtagcgagaccgagacacacgggcttaacgagaacgacttcgttgccggcggagtcggaggaagagtggcggaaaaggaaagagatgcagactcttaggagaatggctgccaaaagaaggagaagcgagaagcttcgcaccggcggtggaaacagcaccaagtcaaccgaagctaataataatccgggagaagcggccaccacttcgaggcggcgaggtagaccgtcgtcgggacttccacggtggtcagcgacggctaacagtggtggactcttacggcaacatagcgctggtcatgagtcactacaaggctcccttgagtcccaaggcggcggcggcggtggtgtcggaagctcttcaagtgtctccgagttggaaaccaaatcccatcaagcatctagtgaagaagcaagaagcttaccgtcgacacaacaacaacaggaagcgatagcaaagccgaacactcggcttagaagattgagttcagtggacatgaagatagagccaccacaagggaaagggaaaaacgagatgccatgtgtgttcacaaagggagatggacctaacgggaagagagttgatgggattctttatagatatggcaatggagaagaagtgaggatcatgtgtgtctgccatggtgacttcttgtctcctgctgatttcgttaaacatgctggtggtcctcatgtagatcatcctcttaggcacattgttgtcaacacttcttctccttctaatctcttatagaaccccttcctaacccctctcctcatttgatccctttattttaagaccagagtgttgcgaagatgttgtaagaggtttaagcagctattcttgttg

SEQ ID NO: 244 - DNA, 701 bp, Brassica juncea
gagtggctccgttgcgcagcttcacaatgttttcgtctatggtagctttcaagagcctgaggtcgtcaaggtcatgcttgatcgtactcctgaaatcatccctgtaacactccctggctttaagaggtttaggcttaaaggacgtttgtatccatgtgttataccgtgtgaagatggagaagtcaaaggacagttactaatgggattaacggatgaagaacttgagaatgttgatgctgttgagggtaatgaatatgagagagtgacagttggtgttgtacgagaggacaattctgagaagatgactgtgaaaacatacatatggctcaataaagatgatcctgatatcgatggagaatgggatttcgaggaatggaaacgactacacatgaagaaattcatagagacgttcaaagaaatcatggaatggaagaggaatcctcatggaaagggaagggacgacttcaaccatgtcctgcgcgatgctccatcggcttgaattgaatctgtgttaagagtatgttctatgtttcatttttctccagattccgagtataataaaacctagaaaactgataggtattgtggcgatcagttaaaataatagtaatgctatatgttattttgtatgttctatgtatcacatttcttctagagattttggcattcatcttgtgtatggtttggttgatgctaatgct

SEQ ID NO: 245 - DNA, 821 bp, Brassica juncea
aagaacgagttgattatggcgccacttgtttcttcactgttggtctttggatttttggtagctaagctgagtgtagatgctgtgactgcagctattcttggattatcggtgcttcttgtgacaggtgttgtcacatggaaagagtgcttagctgagtcagtcgcatgggacacactcacttggttcgctgctctcattgcaatggcgggttatcttaacaaatacggtctcattgaatggttcagccagaccgtagtcaagtttgtgggaggattgggtttgtcgtggcaactatcgtttggaatcctcgtcctcttgtacttctacactcactacttctttgcgagtggagctgctcacatcggggctatgttcaccgcctttttgtctgtctcaacagctctaggcactccaccttactttgcagccttggttcttgcattcctctcgaacctgatgggaggactgacccattacggtatcgggtctgcgcctatcttctacggggctaactacgtgccgctggccaaatggtggggctatggattcttgatctcgatagtcaacattcttatctggcttggtgtaggtggtgcctggtggaagttcattggcttgtggtgagtgggatcaccacacagtagcattctcattcttttccttacttatatataatctctcacgagtggctttgagattcagatttgttaaggattaaggattgataatcaggatttgtaagagtttgagttcgcgatagttgatactctcgcacacattttgagttgtaaaagatcttaacttgcatcaattttgttttt

SEQ ID NO: 246 - DNA, 532 bp, Brassica juncea
ttgatatgcttaaggaaaggaatgaggaatatggaacgataaagttcgtcgacatcagttccaatgattattccccgcaagagaatcaagggcttaattacgaaactgttatggggcaaatccacgcgattcagtccgatggaaatgtggtaacgggtgtggaggcaattaggaaactatatgaactggttgggcttggatgggtttactctatcactaaatttgaaccaatagggaaggtagctgatgcagtgtatgatttctgggctaagtatcgacttcaggtcacagggcggccacctatagaagctattcttgaagcgagaaagaaaaataaggtagagacatgtggtgacagtaaggcgtgcaagacgtgatttttcttacaaattacatataccacaaccagtttgtagttacatatgctctgttttcccgcattatgtaaacttgagtgtttcgatgtattagataaaaagtacgttacgtatatatcggaccagatcttcctttggaaataagaatattcgaa

SEQ ID NO: 247 - DNA, 626 bp, Brassica juncea
cctgtaagatcccgttctcctcgtcgtagaagaagcccaagccgtagcaggagccttagccgtagccgaagctacagccgctcaagatcccctgtgaaaagaagagagagaagtgcagaggagagatctcgcagtccaaagcgaatggaggactctctgtcgccaagaggcagagaccgtagtccgattatggatgatgaaggtagcccaaggatcatagacgggagccctccaccatctccaaagcttgaaaagcaagaccatgatggtggtagccctcaagacaatgggaatggcaggaaaactaatgccagtcccgtggtgggacgcgacagtccgagagaggaccgaagccccgttgatgatgactacgaggccaaccgtgcttcccctagaggaagcgagtcaccttgactttgatggctcatggcctcaagtcacaggcacttagcatgttgtactatttgatcagactgccccagatatttactctctttttatgtgtgtttgctttggatattcttaagttcatgttgtcaggagttctttcttttacccaactgagatgatggttaaacttgtaagacattaatgggttggcttttcattttcagacaattttttgt

SEQ ID NO: 248 - DNA, 967 bp, Glycine max
gttcgccatattcataggtagtggttgtgagcgaaactatgccatataccacaacacaacacattaatataccataacactcctattgttttgtttctgtgttccctacgttacacgcgttagtagttactcactttccttctcttcacaaacctacttgtttctctctcattttttccccactatagcatgtctctaagtctagccatcaaactacacctggcttcttcttctccttctttttccctccttaccctcaacaaccaccaacatgcaaacaagttaacaacttccgaaacttgttccaacaccaaggttcgtcccaaacccatttatagcaccaaccctttgatcattcccacgtgtaaagtgaggccaagagtgctaagatcaccttggctgagtcactgcctaaggtgcagctcacaaggattgatcttgagtgggtgcatgtggtgggggaagggtgggctagtcccttgaaagggttcatgagggaggatgagtatcttcagagtttgcatttcaattcccttagggtcaaggatggttctgtggtgaacatgtcccttcccattgttttggccattgatgatgagaccaaagagagaattggatcctcttcccatgtggggttgctcgggcctgatggagattgtgttgcaattcttcgaagtattgaaatctacaagcataacaaggaagaaagaatagctagaacttggggaacaactgctcctggattgccatatgttgaggaggtgattactccggcaggaaattggcttattggaggagatttggaagtgctaaaacctatcaaatataatgatggcctagataactacaggctctctcccaaacaactccgtgaagaatttgacaagcgtcaagcagatgcagtttttgcctttcagttaagaaaccctgtacacaatggtcatgccttgttaatgaatgatactcg

SEQ ID NO: 249 - DNA, 2281 bp, Glycine max
cttagccttcttgtttcatctaaaagagtagcaaccatgtggtctgcagtaacagatcccattagagctttttttgcaaattttctccgccatttcatccacaaagacttccatgaagcagtggccagaatgaccataatagatgctttcctcttcgttattgtgcactccattgataagttggggatatggccacgcttgccggttttcttagggctattgtacctggcgattcggcggcggcttcatcaggagtacaacctcttcaacgttggaacaacaccggtgggggttaggtttaaccattctgattttccatacagaacagctgatggaaaatataatgaccctttcaacgaagttgctggcagccatgggactttctttggcagaaatattctccctgtggatcagaaaaaaaagctattgaaacctgatccaatggtggtagccacgaaactacttgctaggaggacatacaaggatactggaaagcaatttaatgtgatagcagcttcttggattcaatttatgattcatgattggatcgatcatcttgaggacacaaaccagattgaactcatcgcaccaagagaagttgcaaggcaatgccctctcaaatctttcaaattctacaagacaaaggaaattcccactggcttctttgagattaaatccggatcatcaaacatccgtacaccttggtgggatgcaagcgcagtatatggaagcaatggagaagttttacagagagtgagaactttcaaagatggaaagataaagatatcaaaggatggccaccttcttcataatgaaaatggaacagcaattgcaggtgacatccgcaatagttgggctggtgtttcaaccttgcaggcccttttcattcaagaacacaatgcagtttgtgacaatctcaagaaacattatcctcaattgggagatgaagaactttatcgccatgccagattggtgacctcagctgtgattgcaaaggttcataccattgattggactgtagagctccttaaaactgatactttacttgcaggcatgcgtgccaattggtatggattattagggaagaaatttaaggatacatttgggcatgttggtggagtcatcttgggaggattagtgggtcttaagagaccagaaaatcatggtgtcacatactctctaacagaggaatttgtgactgtttatagaatgcactcactcctacctgataacctacagctaagagacatatccgctactccaggacccaacaaatctcctccattagtcaaagaaattcctatgaagaatttgattggactgcaaggagaaaaaacattatctgaaataggagttgcaaggcaacttgtgtcaatgggtcaccaagcttgtggggcattagagctttggaactacccagagtggctcagagacctcgtaccacaaaacatagatggcacagataggcctgatcatgtggatctagctgctcttgaaatttatagagatagagagaggagtgtggctagatacaaccaattcaggagggcattactgttgatacctatctccaagtgggaagatttaacagatgacaaggaagcaattcaagtattggaagaggtatacggtgatgatgttgaagagcttgatgtactggtaggcctcatggcggaaaagaaaataaagggttttgcaatcagtgagacagcttttgttatattcctactcatggcaaccaggaggttagaagctgacaggttcttcacaagcaactttaatgaagagacatataccaagaaaggactggaatgggtgaatacaactgagagcctaaaggatgttattgatcgtcactatcctgaaatgtcacacaagtggttaaactcttctagtgctttctctgtttgggactcaccaccaaactctcaaaatcatatacctctctatcttcgtgttcctcactaatttgtttgccctcacaatatctctttgccattaatgcctttaatttaatcattgggtctattttgggtgtttgtatttcggtttatatccttttgttgtatttgagttaactcgtgtatactttatcttatctctatcccaaaattcagcccacttaggtgcttgtatttagtcttcttaaacaatattttgatgcatttgagtttatggatgaataatagtctgtttgtatcttgatgtattcaacaacaaaaaaatgtatttagttaattgtttttttttaagtatgtacatgttgcataattttacaatt

SEQ ID NO: 250 - DNA, 744 bp, Solanum lycopersicum
ctgttcaatttcactgcaaattcaacggcactccccacaagttttatcaaaacttcatgcaaaatcaccacatatccacaagtatgcgttacttcgttatcagtttacgcaccaaccatcaaacgtagcccgcagcagctggcgcaaacagccttgtcagtaagtctggacagggcacaatccgctcacactttcatcaccaaactgaacaaatttaaaggtttgaaatcaagagaatacgcggctctaaaagattgtttggaggaaatgagtgagacagttgatcggatcaataaatctgttaaagaacttacacggatggggagttcacgtgggaaggatgttcagtggcatatgagtaatattcagacatggatgagtgcggctattacaaatgaaaatagttgtgcagatgggtttgctggaagggctttgaatggtaggattaagagttcgattagagccagggtgactcatgtaactcaggttacgagcaatgctttggccttaattaaccaatttcctgcaaaacattaagacctataaatagtttaattttatgttttcacattttgagtaatattcacttttttttttttttgtgtgtgtgtaagttttggtttgatgggaactatatataaaagcgagaatgaaattttattcgtgtaaaatggagaactaaaggattatgatgtggatgctttaatctctgtctccctaaataggcaaattaaatgtatgaaa

SEQ ID NO: 251 - DNA, 765 bp, Solanum lycopersicum
gttgtgaggtcccacaaggagaaacgctcttcgtatgcaccagacaaaggagtacgatacgacggggtctacaggattgaaaagtgttggcggaaaccgggaaaacaaggattcaaagtttgtcgatacctttttgtgcgctgtgataatgatcctgcaccatggaccagtgatgaacaaggtgaccgtcctagggccttaccttccatcaaagaactaaaaggcgccacagatatgactgagagaaaaggatctccagcctgggattatgatgaggaaaagagttgctggatgtggaaaaaggctcctcctcctagtaggaaaccagttcaatgtgaaaatgaagatggaacaaaagtgagaccagtcagaccaaagagacttacaatgtctgtaaagcagaggctcttgaaagagtttacatgtcatctttgtcgggaagtgatgaataacccgcttactactccatgcgcgcataacttctgcaaggcatgtttggatggtgcctttgcaggtcaatcctttacaagacagaggacgtgtgaaggcagacgtacattacgagcgcagaaaaatataatgaaatgcccatcatgcccaactgatatatctgatttcctccagaatccccagattaatagagagttgatgaatgtaatcgaatctctgaagcgccaaattgaggaagaaatgcagcattgagtgctgatgtagatgatggcagcttagatggaaatgagattctagctgaaacagataaaagca

SEQ ID NO: 252 - DNA, 3143 bp, Arabidopsis thaliana
ctcctttcccagatctagagattgtacttagctcttcttctctcttcttcttctcattctcttcgcttgtaaccacagaactttgcagtggtcttgttccactaatattagcctcgtttttgcttactaaaagtttatctctattctcatcaccatggggagttgtttttctcttcaagttagtgatcaaacactgaatcgtatctttaattgcttaattggtaaaagttatattcgaaccctcgagaagaatctcagagctctgcagagggaaatggaagatctcagagcaattcaacatgaggtacaaaacaaggtagctagagacgaggcacgccatcaacgaaggcttgaagctgtccaggtatggcttgaccgtgtcaatagcgttgatatagagtgcaaagatctgctaagtgttactcctgttgagcttcaaaagttgtgtctatgcggtttgtgttcaaaatatgtatgttcaagctacaaatatgggaaaaaggtattcttgttactggaagaggttaagaaactaaactcggagggaaattttgacgaggtttctcagccgcctccaaggtctgaagttgaagagaggcctactcagcctacgattggtcaggaagacatgctcgaaaaggcatggaaccgccttatggaagatggagtcggaatcatgggtctgcacggtatgggtggtgtaggcaaaacaacccttttcaagaaaatccacaacaagttcgctgaaataggtggtacgtttgacattgtgatctggatcgtggtgtctaaaggcgtaatgatttcaaagcttcaagaagatattgcagagaaactacacctttgtgacgacctgtggaagaacaagaatgaaagtgataaggccactgatatacacagagttttaaagggcaagagatttgttttgatgctagatgatatatgggagaaagtggatttagaggccattggtattccctatccgagtgaagtaaataaatgcaaagtagcattcacgacacgttctcgggaagtttgtggggagatgggggatcataagccgatgcaagtcaactgtttggaaccagaggatgcatgggagctgttcaaaaacaaggtcggagacaacacattaagtagtgatcctgttattgtggagttggcaagagaggtcgctcaaaaatgtcgtggtctgccattggcgctcaacgtcattggtgagacaatgtcatctaaaactatggtacaagaatgggagcatgcaatccatgtttttaatacatccgctgcagagttttctgacatgcaaaacaaaattcttccgattctcaagtacagctacgatagcttgggggatgaacatatcaagtcgtgtttcctatattgtgctctgtttcctgaagatggtgagatatataacgaaaagttgatagactactggatatgcgaaggattcatcggagaagaccaagttataaaaagagcgaggaataagggttatgcgatgctcggtacccttacccgtgcaaatttgctaacaaaggttggtacatattattgtgtgatgcatgacgtggttcgtgaaatggctttatggattgcttccgattttgggaaacagaaagagaattttgttgtgcaagcaggagtcgggttacatgaaataccaaaagtcaaggattggggagctgtaagaaagatgtcattaatggataatgatattgaagagataacatgcgagtccaagtgttctgaacttacaactttgttccttcaaagtaataaattgaagaatctaccaggtgcattcattcggtatatgcaaaagctagttgttttggatctttcatataatcgtgacttcaataaacttccagagcagatatcggggctggtctcgttgcagtttcttgacttgtcgaatacaagtatagagcacatgcctattggtctcaaagagttgaaaaagctaactttcctggatttgacttatactgatcgactttgtagtatcagtgggatatcaaggttgttgagtttaagattgttgagactgctagggtctaaagttcatggagatgctagcgtattgaaggagctgcagcaattgcagaatctacaagagctagccataactgtatccgcggagttaattagtttggatcaaaggttggcgaagttaatctctaatctttgtattgaagggtttcttcaaaagccattcgatttatcattcttggcgagtatggagaatcttagttccctacgggtggaaaatagttatttctcggagataaagtgcagagaaagcgagacagaatcgtcttatttacgcatcaatccgaaaattccatgctttaccaacctctcacgactggagataatgaagtgccatagcatgaaggatctgacttggatattgtttgctccaaatcttgtcgtgctactcattgaagattcaagagaagtgggagaaataataaacaaagagaaagcaaccaatcttacaagtattacaccatttctgaaactagaatggttgattttgtataatttgccgaagctggagagtatctactggagtcctctcccctttccggttttgttgaccatggatgtttcaaactgtccaaagctgagaaagcttccattaaatgctacaagtgtttcaaaagttgaagaatttgaaatacatatgtatcctcctccagaacaggaaaatgagcttgaatgggaggacgatgataccaaaaatcgattcttgccttcaatcaaaccgtacaagtacttcgtctacccaggaatgagtttcctcactgtctaaaatcagaattcacgcttcttcttcttctattgctttatctatcttcttgtagtgctgcatttggattgtataattgatttgcattctgatacttctggaatgtgttgttgtgttgttcacttggattatgtttttcattttccttttgtattccctaaaacgttttgcatcctgttcaaactacatttttacacaatcaaaagtttatgcgtttaggtaaaatccatttgttggtttctctttcaccttgcagtgtctttcttcatctgttggtttctttttcatgttccagttgttaatgaaaagatttgattttggt

SEQ ID NO: 253 - DNA, 2652 bp, Arabidopsis thaliana
gagcctgactggagaaatcgagaatggaggacggcgaaatagaggaaggaatggtaactgccgacgaattcccgacgccggaagtaactaccatagagactatacaacctccccgagagccaggaaaatctccactcgagctacttcgagagagcaaaacctccgtagaagaaatcgtcgcgaagatgctctccatgaaaaaacaaggaaaccacaaatctgagattcgagaactcctcactcaaatgttcctcaacttcgtcaatcttcgtcaggcgaatcgggcgattttgactgaggaagataaagtgaaagcggagacggaaagagcaaaggcacctgttgatttcacgacattgcaattgcataatcttatgtatgagaagagccattacgttaaagctatcaaggcttgtagagatttcaaatctaagtatcctgatattgaccttgttcctgaacaagacttctttcgtcatgctcctgaagctatcaaagatcaatcgctttcaagtgatagttctcatgttttgatgcctaagagactcaattttgagcttcatcagaggaaagaattgtgtaagcatcgagcgagattggagcaacagaagaagagtttattagaaaccattgcggagcgtaagaagtttttgtcgagtcttcctctacaccttaagtctctgaagaaagcatcgcttccagtacagaaccacttgggtatacagcacacaaagaaactgaagcagcataatttagctgagctgcttcctcctccgctttatgttctatactcacagctcttggcacaaaaggaagcttttgaggagagtattgaattggaggtagttgggagtcttaaggatgctcaagcttatgctagacaacaatccagaaaggactcaggtatgtcgagtaatacagagagttctaggttggaggatgatggacctgatgacgatgatgatggacaaaggagaagaaaacgacccaagaaacttactagcaaagaaggttctgacaaggcaggattatatcaagtccaccctctcaaaattgtccttcacatatatgatgatgagataccagatacaaaatccttgaaacttgtcattctcaagtttgagtacttgctgaagttgaatgttgtatgtgttggcgctgaaggctctcaggatggaccagaaaaaaacatattttgtaacttgtttccagatgacgctggacttgagcctcctcatcagtcaaccaagctcatccttggtgatggtcagacgtttgatgagaacagaacttcaaggccttataaatgggtacaacatttggcgggaattgatatttcaccggttttattaggccaagaagctcataacactgacccagctaaaagtgatacgtttgtgcctgatctttcattgtatcgccagcagcatagagtgcaaacagttctgcgaagaatacgcttgcggaaaaaagcgcatctggctcttgcggaacagcttgatttgcttatgaaacatgagttaccagtggtgaactgcgaagatgctccttgggcactgcataaggttctctgtgctttggattcctggttacatatacaatcttcagctagtaagtcatgctctctgactctgaacagtgtggaacaagttccagaacctatggaaatcgatgtagatggaagatctatttctggaaaagaagattttgaaagtatacgggaagatggagaacttccctctttggtcacggcggctgcttcgttaaccagttccaatcataccccatcgaaagtatctaatcaagcacggtcaaggcagttggccttgatgacaaagaatctagattctccgattagcaaaggaaagtccccaagtttcaagaaatacgaagatgatttggatcttgttctggacgatgatagtgaaatagatgagccaaccggaagaactgaggcgcatgtggaagagttatgccctgagaaagctgataattcatgggtggattatggttcgagagagtttgcgcttgtgttctccaggaaaacagatggcggaaagttgtggaagttagaagcaatggtacaaattagcatggagtatcctcttcgacctcctttgttttctctgtctctccacgcatcttcttcatcaggaaatgaaaatgggacaaatgaaagtgaccattacaatgaacttcgagcaatggaagcagaagtgaaccttcatatgttgaagattattccttcagatcaagaaaactatctcctatctcatcaaatcagatgcttagcaatgttgttcgactattacgtggatgacccatctccagattccaaaagaggaacagccacaactgtggttgatgtcggtttgtgcaagcctgttgacggtaagcttcttgtgagatcattcagaggcagagatcaccggaaaatgatctcatggaagggcagaggatgtgcatcgggttatccatgctagagattacatcgccactcacttctctatattatctttctctggtggtacaagcaaaagtttttgcatgtaacatttttttatcgtataaaccgttattgaaacagcctacttgttgggtgaggacctggtctgttttaaacctggcaatgtttcaagtccaatccgtttt

SEQ ID NO: 254 - DNA, 2125 bp, Solanum lycopersicum
acggccggggggtgtccaaacccctcaaagcctccaacaacttttgagttttgcagtcagtctatttgttgctctcataaaaatggcgtccatcccttctcctcacactgcccgcctcaattctctcctctcttcttcttccgtcaatcacaacaaaccttcaaatctctctttcctccatgcctcctcaaatccatcttccatcaaactccttcactctgtttcaccatcaatttcttcttcttcgacgacggtgatttgtaatgtcctcaaaactgttgaatctgctgacatctccctctctagagatcttcacggcgttgtatccacttccaaaccaaccattctcgtatccgagaagcttggagaggcgggtctagatttgctcaagagtttcggcaacgtggattgttcttacgacttgtctcctcaggatctctgcgctaagatctctctgtgcgacgcgctcatcgtccgtagtggtaccaaggtgacccgtgacgtgtttgaggctgctcagggaagactcaaggtcgtggggagagctggtgttggtatagacaatgtcgatctgcaagctgcaactgaatttggttgcctcgtcgttaacgcacccacagctaatactattgctgcagctgagcatggaatcgctttgctcacctccatggcccgtaacgttgctcagtctgatgcctccatgaaagctggaaaatggctgcgcagcaagtatgtgggtgtttctcttgttgggaaaacattagctattatgggatttggtaaagttggttccgaggttgctagacgtgcaaaaggcctcggtatgcatgttattgcccatgatccttatgctcctgctgacagagctcgtgctattggagtcgatttggtttcatttgagcaggccatatctactgctgacttcatctcactccacatgcctctcacacctgctacgaacaaggtattcaatgatgacacttttgcaaagatgaagaatggagtcagactaataaacgttgctcgaggaggtgttatcgacgaggatgcattagttagagcccttgacagtggaatagttgctcaggcagcacttgatgtgtttactgtggagcccccaccaaaagatagcaaactagtgcagcatgagaatgttactgttacacctcatcttggagctagcactaaagaagcacaggaaggagttgcaattgaaatagctgaggctgttgttggtgctctaaatggggaactttctgctaccgctgtgaatgctccaatggtccctcctgaggttttgtccgagttggctccttacgtcgtgctcgctgagaaagtgggtagattagcagtacagctagtgactggtggcagtgggattcagagtgtgaaagtggtttacaaatcggctagggaccctgacagcttggacactagacttcttcgagccatggttacaaaaggcattattgagcctatatcggatacaatcatcaaccttgtaaatgcggatttcagtgcaaagcagaagggtcttcgcattagtgaagaaaggattattgttgattcatctccagagtaccctgttgagtcaatccaggtgcagattagtaatgtgcaatcaagatttgcaagtgcgttatcagagaatggaaacattagcattgagggtagagtgaagtatggagttccccatcttacacgtgttggaccatttagcgttgatgtgagcttggagggtaacctcatcctttgcaaacaagtggatcaacctggtatgatagggaaagttgggaacatacttggtgagagtaatgtgaatgtgagttttatgagtgttgggagaacggtgaagggaaagcaggcaattatggcaattggagtagacgaagaaccagacaaggatactcagaagaagattggagaggtgtctgcagttgaagaatttgtcttccttaaactatagtcaatattgctggctaatgggatggaatggaacttgttattacgtattattatcaagtaaaagataaaaagggtgtaatgaaattttagctgtgtctgcttaatgtgttgatcaaattaatttacaaggaacacttatcctcagtcttttatgatgtgt

SEQ ID NO: 255 - DNA, 1730 bp, Brassica juncea
aaatggagaaaggttccaacggttccgcggcgttggagatgcagacgtccgagctcgatcagccggcggctctccgtaagatcatttcggtgtcctccatcgccgccggtgtacagttcggttgggctttacagctatctctgctgactccttacgtgcagctactcgggatcccacataaatgggcttctctgatttggctctgtggcccaatctccggtatgcttgttcagcccatcgtcggttaccacagcgaccgttgcacctcgagattcggccgtcgtcgtcctttcatcgtcgccggagccggtttagtcaccgtcgccgtgttcctcatcggttacgccgccgatataggtcacagcatgggtgaccagctcgacaaaccgccgagaacgcgagctatcgcgattttcgccctcgggttctggatcctcgacgtggcgaacaacactctccaaggaccatgccgcgctttcttggctgatctatccgcgggaaacgcgaagaaaacgcggaccgcaaacgcgtttttctcgttcttcatggcggtcggaaacgttttgggatacgcggcgggttcttacaagaacctctacaaagttgtcccgttcacgatgaccaagtcctgcgatctctactgcgcaaacctcaaaacgtgttttttcctctccataacgcttctcctcttggtcacgttcatgtctctatgttacgtgtcggagaagccatggacccctgagccaaccgcagacgggaaatcctcgagcgttccgtttttcggagagatcttcggagcgttcaaggagctgaaaagaccgatgtggatgcttcttatagtcactgcactgaactggatcgcttggttccctttcctcctcttcgacactgattggatgggccgtgaggtgtatggaggaaactcagacgcaactgcatccgacgcctctaaaaagctttacaacgacggagttagagctggtgcgttggggcttatgcttaacgcgattgttcttggcttcatgtctcttggtgttgaatgggtcggtcggaaaatgggtggagcaaaacggctttggggagctgttaacttcatccttgctatttgcttggccatgactgttgtggtgactaaacaggcggagaatcaccggcgagatcacggcggtgctaaaacaggaccgcctggtaacgttaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccacagatggtggtatctgtgggaggtggaccattcgatgaactattccatggtggaaacattccggcgtttgtgctaggagcaattgcggccgcggtgagtggcatattggctttaaccgtgttgccttcgccgccaccggatgctccagctttcaaaactggggctatgggatttcattaaagttttagaagtgtttgggtggctatgtaactctcataaaacagtagtgttattgtgcaaatcctacataaagagaaaaatggaaattaatcttcttgggttgttggtttatattgtacctaaacccattgtgttccttttttgtaactgaaattttcaatttggagtatatttcaccttttgccaccttcaaggcttcat

SEQ ID NO: 256 - DNA, 750 bp, Brassica juncea
ttaagccaccagtttcaccaccagccaagcctccggtttaccctccgaccaaagcccctactaagcccccaactaaacccccggttaagcttcctgtctctcctccagcaaagccaccggtgaagccaccggtttaccctccaaagtttaacaggagcctagtcgccgttcagggtacggtcttctgcaaaagctgcaagtacgcttcttacgattcactcactggcgccaaaccggttgaaggtgctgtggtgagactactgtgcaagagcaagaagaacatagtcgcggagaccacgacggacaagaacggatacttctttttgttggctccgaagacggtgactaacttcggtttcagaggatgtcgtgcgtatcttgtgaagtcaaaggactacaaatgcaacaaagtctccaagctcttcggtggagatgtcggtgccgaactcaggccggtgaaaacgcccggaaaatctgcagtggtcattaacaaactcacctacggtgtctttaacgtcggtccgtttgcgttcgaccctgtctgccccaaataaagatgattaagatgatctggttactttcttgatcacgttaagttcaaaagagtgagaggagagagatgtgtttctgcgttgcgagtgtaatgttagctagtgttaagttaaatgttgtgttgcttttatgaatgtgtccctaagtgacgttgtttcaagttccatttgaataaaaatagccagcttcaagaagacc

SEQ ID NO: 257 - DNA, 361 bp, Brassica juncea
ctctgtcatgcgatgacaatcaataagagtcaaggacaaagtctcaaacaagctgctctatatctccctaggaatgtctttactcacggccagttgtatgttgcgttatcgagagtgacatcaccggagggtcttaagatactggacgagagctctgactcaaatggtgctgatggagtaaccaatatagtgtacaaggaaatctttgagggccttcaaggttcaaagggaaagaagccaatgtggtcttgaacaattctgaacttcgacgtagatacttttgttgacggttctgagcatcgtctactcaaccactctactatctcttcttttaccggttaccgtttgctttttcaataac

SEQ ID NO: 258 - DNA, 778 bp, Brassica juncea
ggagagagagagacaagccacagagaaaaatggtgagattcacggtgttgattgcggcagtgatactagcttttgtagtggcggtgccgcctgaagtgacggcgaagaagtacactgtcggcgagaacaagttttggaatccaaacatcaactacactatctgggctcagggaaagcatttctacctcggtgactggctctatttcgtgttcgacaggaaccaacacaacattcttgaagtaaacaagaccgactacgagaactgtaacgccgaccatcctctcgtaaactggacacgtggagctgggagagacattgtcgctctcaacgtgaccaaacactactatctactcgacggaaagggtggctgttatggaggcatgaagctcgctgttaaagtagagaagcttcctcctccgccaaaagctgcacctgtcaagagcattggttcagtttccatggccactggtgttgctcagttcgtgattccgtttgctcttttctctgtttcgacggtgtgggatgccatcttaaggatgtggtagtgaccaccaatctcagaggtctttagttggaatccattttcgagtttaaagaaacatcaaattctttttcagggaaagcattttaagttagagagttcatcagttgagtttatgttttgtaatgttggattgttgggttttaatattttgttttgtttgtgtctttgaattaattgttgaaaaaaaagttgtatttgatttacttgagattaattaatggtttaaaactttcg

SEQ ID NO: 259 - DNA, 1442 bp, Arabidopsis thaliana
gtgatgttcgatgagagaagttaattccttttctaaatttagggtttctcttcatcgagatgtttcttttaaatgatattcttcttctttcagtaatggaataatagcttctgtacgaaagatctttctggcatttgtaagtgaacccattccactcttcttgcatttgttgtttctgctgttgcttctgatgatgatggtgatgatgatgatgactggggtaccaaaatggattatcagtatataaagttgttggatagtttcagagaagatggaagtttaaatctgagtgacaatccactaaggtctattaggtatgaagtagataatggtggatatgacaagcgggagtttaaagcagtgtttacaaataagcggagtagagaagatcgaaacactattcgtgtaaccaagaagaatgttgagccaaagcctcctcatgttcaagcaagtacagagaaggtaacaaaagaagccggtttcaaattaaggcgaagagagagtcttgtgagtcagaagagtgttgaagcaatgcttattacaagtcatgtgagaagaaactcccaacacaataatggcgacgctagcgagaaggagaattttgaggatgacattgtattggatgaggtttacagatcttatctcaaacggttagtggaaaattcgaaaagttcaagaactaatcctgaaaaagagataaaagtaaagtgtgaggaggatcatacagtgtctttgtctgattctgattctgatattattgtggttggagattgtccgtttctggaagaagaggattctccatttgtgccatcaaaaagttataaagtgattgatttggatgaagagagcagtgatcaacgcaattcttggtttaggagggagataatgaatgttctgaagcagccatacactgtaacagagctcaaggaacttcacaaggaagcatcagtgcatggagtgtcatccagacatatagaactacgagatggaacagagtttagctttccaacgaacaaaaagaaaccttcatatctcgataggtatccagacttcaaaaagcagtaccttgactctttgcgtgaaaaggatgagcgtaaagctctgaacctgttgcgcgggtttatcttttatataacgaatgtggttcgtgatgatgcattcaaaccgtggctcgatcaagaatgtttgaagatcagatgtgtctgacaaaagagtatcagcacttggagttctgacagaagactactaattaggagatgtaagacctttgtttcatgaaataagtttggacaagatttgcatttgtgtaaaattagcctcaccattgtgtagtagttcatgactcaagactggcccagtggcttcaggttctatgatgtgattatctcttccatgtccttaagtgcattgtagagagcttccaagcggacttattagaagga

SEQ ID NO: 260 - DNA, 1347 bp, Arabidopsis thaliana
atggaatgctctgcaactcctcccaagctttatccaaccgtcgacacttcaaccaccgttgctcctctccctaagtcctcttcctcctcctcttctactaataataataatctctatccttcaatcaatgtcaatgatcttgtcaacaatatcttccccgatcccaccgcctctgactcagcttcagcgcctcctctcgcgacggaggaagtgattctcacaatccacggcgcgatggtccacctcattgacaaatcctacagcgtagagctcgcttgcggcgatctcgagattctccgtcttgttcaaggagatatcaccgtcgcggttttcgctcgcgtcggtgacgagatccaatggccgttgactaaagacgaacccgccgttaaagtcgatgagtctcattacttcttctcgctccgacccgttaaagaatccgagtcatcggatcattcagtcaacgaaacagagaacgagatgttgaactacggattaacaatggcttcgaaaggtcaagaaccgatgcttgagaagctagacaagatcttagctgattacagtagtttcacagcggaggagaaacagaaagaagagaacgttttggatttgacggcggcgaaggagacttcaccggaggagctgaagggaaagaggaaaaagatggtggagaagcagtgtacggcttattggacgactctggctccgaatgttgaggattacagtggcgttgcagcgaaactgatcgctgctggttctggtcaattgattaaagggatcttatggtgtggggatctcacaatggatagactcatgtggggaaatgatttcatgaagaagaagttgtccaaagcagagaaggagagacaagttagtcctggaactttgaaacgtctcaaaagagtaaagaagatgacaaaaatgacagagaaagtggcgaatggtgtgctctctggtgttgttaaagtttctggattcttctcgagttcagtgataaatagcaaagctgggcagaaactctttgggcttcttcctggagaaatggttcttgcaacacttgatggattcaacaaggtttgtgatgctgtcgaagtagcaggaagacacgttatgaaaacaacttcagatgtaactactgaaatcgtcgatcacaagtatggagcaaagacagcacaagcgacaaacgaagggcttagcgcagcagggcatgcttttggaacggcgtggactgttttcaagattagacaagctcttaaccccaagagtgccatgaagccatcatcactcgctaaaaccgtagttaaaacggcagctaaagagagaaagaaggggaaaaaaagttctaagtag

SEQ ID NO: 261 - DNA, 780 bp, Sorghum bicolor
acttcccctcgctcgattcgatccccccgccccgagaagagcaggagcaagctaggcgcaaccgaccagctacgcaacgcaacaatggcttccgcttcctcgaatgccaagcagagcctctacccggatgttgaccagtcccaccctgatctcaacacccccttcttcgcgcccaccacctccaccggcgccggcaccaccgccgtgggcagctccctctaccccaccgtcgacccaaacgagctcgccgagaacctcttccccgagacggccgaggaggacgccgcgccgccgccgcccaccaccgaggagaccgtcgtcgccgtcccgggcgcgcagctccacctcgtcgaccccgaccgcagcctcgacctcggcgctggcacgctctccatcgtgcgcctccgccagggggaccactccgtcgccgtcctcgcgcgcttgatccccgagaagccccaccaacgccgcggcctcttccgcctgtttagcagcgggcggtctgacggtggcgccgagcaggagcccgtccagtggccgctcacccgcgatgtcgccgcggtcaagctcgaccccgcgcactacttcttctcgctccatgtcccgcacacggaccacccggacgacaaggatgacgccgaggatgccgaggcggacgcggaggcggcgctgagctacggcctcacggtcgttgggaaggggcaggacaaagtattggaggagctggacagggtcctcgaggagtacactaccttctcggtgaagcaggtggaggcggcg

SEQ ID NO: 262 - DNA, 858 bp, Solanum lycopersicum
acttcactttgatcacttcaatggcttccaaaaaccctaattcctcttcaatgtatccacaagtagcagtagttgaccaaaatgtccctttcccttcatctacttctcgccaaaacctttacccaaccattgacatgaacgaccttgtagaaaatctcttccctcaaaatgaccaaactgcccctgagcgacaacattattcaccatctgcccctcctgaaatccttgaagaaacccttctcgttatccccggttccattcttcatttgattgacaagcactattccgttgaactcgccatcggcgatttattcctacatcgtctccgacaagggaacaatatcgtcgcagtacttgttcgtgttggaaatgaaatccagtggccgttgactaaggaccttgccgcggtaaaactcgatgattcacattactttttctcatttcaagctcctaaagacgatgaatcggataaagaatcatcagtcagtgacttggcaaatgactcgttgaattatggtttgacgattgcttccaaaggacaggagaaattattgaaggagctggatgacattttggaaaattacagtaactttgccgtgcagaaagtggaggaaaaggccgcggtagcattaggtggaccggtggcgaaggaattgtcaccggcggatttaaagtcggagaagaagaacgaggtgttggaagagagatgtgcggcttattggaccacattggcgcccaatgtggaggagtacaatgcaacagcggcaaagttagttgcttcgggctcaggacacttgataaaggggattttgtggtgtggagatgttactgcagatagattgaagtgggggaatgaag

SEQ ID NO: 263 - DNA, 857 bp, Solanum lycopersicum
tcttctcatcccaaagcaaaatctcagtattttaaggcgattttcttcgattctaagacaaacccagttcaattctgtgtttaatcttcctgtttcgtctttctctaagccgatccgaacagttttacccaattctttggttacctctaagggttttgagttgtggggtttaagatcagatcataccatggctagtcaatcaagcaaccctcaatctgtttatgatttcactgtcaaggatgctaagggcaaggacgttgatctcagtatttacaagggaaaagtccttatcattgtcaatgttgcatcacagtgtggcctgactaattcgaactacactgacatgacggagttatacaagaagtacaaggatcaaggtttggagattctggccttcccttgcaaccagtttggtggacaggagcctggaaacattgaagatatccagcaaatggtctgcactcgcttcaaggctgagtaccccatatttgacaaggttgacgtgaatggtgataatgctgctccattatataggtttctgaaatcaagcaaaggtgggttctttggagatggtatcaagtggaacttctccaaattcctcattgacaaagaaggacatgtcgttgatcgctactctccaaccacttctccagctagcatggagaaggatatcaagaaactcttgggtgttgcttaagctctagagtctggactcggcggtgctgtctctgcattttgtgctagaaataatgaacatatcattgcgaataagctatgtttgatgtaattttcttcttgttttagttcctacagatgtttgctactttgtacaatttcaatatactgatcaatatttc

SEQ ID NO: 264 - DNA, 746 bp, Brassica juncea
cggtttaggtggtggagctttgtctatgactaatcagatcaaagcgacgtcgttctcgtactgcctcgttgatcgtgactcgggcaagtcctcgagtctcgacttcaactcggtccaagccggaaccggagacgccacagctccgcttctccgtaacagcaagatcgacactttctactacgtcggactcagcgggttcagcgtcggcggtcaacaagtctccatcccttcgtcggtgttcgccgtcgacgcttcgggagccggaggagtgatcttggactgtggaaccgccgtgactcgtctccagactcaggcctataactcgctgcgcgacgcgtttgttaaactcacggcgaatctcaaaaaggggacgtcgagcatctcactcttcgacacttgctacgacttctcgtctctctccaccgtgaaagtcccgacggtggcgtttcatttcaccggtgggaagacgcttaatctgccggcgaagaattacttgatacctattgatgatgccgggacgttctgcttcgcttttgctccgacgtcgtcgccgttgtcgatcatcgggaacgtgcagcagcaggggacacgtatcacttacgatctagcgaatcatcttatcgggctgtcagctaataaatgctaaaaaggttgaagattagtagttttacagatgtgaagtaaaactctttagttctcggttgtttaatgaaaaaaataaaatatgaagtgtgaatttacttttt

SEQ ID NO: 265 - DNA, 317 bp, Brassica juncea
agcctatttgagacaggaggcgcaaagggtttaacaggagaccttgttgagaagatcccaaagttgacaatcactgacaacaataacacagatgcatctgagaacagagagtcctgttctgtttgtcttcaggatttccagctcggtgagacagtaagaagcttgcctcattgtcatcacatgttccacttaccttgcatagacaaatggctcctcaggcacggttcttgtcctatgtgtagacatgacctttaatgtaaaccgtgcagctcagatacgtctacacacagctccttacctctcaagaatctggtctt

SEQ ID NO: 266 - DNA, 479 bp, Brassica juncea
gaaaatggcaggaagactgagcggtgtggcctcacgaatcatggggggaaacggcgtcgttgcccgatccgccgcctcttccctccgccaacgcgctggcatgggtctccccgtcggcaaacacatcgtccccgataagccgctttcggttaacgacgagctgatgtgggacaacgggactgcgtttccagagccttgcatagatcggattgctgacaccgtcggaaagtatgaagcattgggatggttgtgtggcggtctagggttctttgctactctgggtatgctcgctgttgtgaacgataaagcttctaaggttccatttacaccacgagtttatccctatgacaacctgagagtggagcttggaggagagccatagagacctgtcaagtgatctagactagatcatctagtcgagcgtgttttcattcacgcttttgttcttcaaaatgttttcatttcgtgctcagaacctg

SEQ ID NO: 267 - DNA, 1155 bp, Brassica juncea
gaagtatggacaaaatctgacaaaactcctgtcactgcagctgattatggatcacaagctgttgttagtcttgtattagagagggagctcaaacctgtaaccctctcattagtagcagaagaggatactggagatctacggaagaaagggagtgaggagtttctagaaggcataacaaagcttgtgagagataccctagcttctgatgaatcatacgcggactctcctataaccaaagaggatgtgttgaatgctatacactgtggtaaatcacaaggaggtagcactggttgccactgggttcttgatcctattgatggaaccagaggatttgtaagaggagagcaatacgctgtgggattagccttgcttgtggaagggaaagtggtggtcggcgttatggcttgtcctaatcttcctttgtcttctgcggttgttgagaaagacgacaagtcttgccaggataatgttggatgtctcttctttgctacaactggttcaggagcttacgtgcaaccgctcaatggcaattctccaccacaggaggtgagagtgagtagcaatgagaatcttgaagaagcaaagttcttagaatcataccatatgccaattcccctccatagttccattgctaagaaacttgggatcacagcgttacctgtaaggatcgatagccaagcaaagtatgcagctgtgtccagaggagatgcagagatgtacttgcgtttcactcttgttggataccgtgagtggatatgggaccatgcagctggttcaatcatcacaacagaagctggaggcgtcgtttgcgatgctgaagggacacctctggacttctcaaaaggaaagcgtcttgatcacaacagagggatcatagttaccaccaagaaactcaagccattgattctgaaagctgttagagaatccatggaagaagagaatcttcgtgtctgagacacaactgaaactctacttgtatttgtatttgtattttgtctgaactgataaattgtgtgtgtattgcctagttctttgtattgtctacgtgttagatgtgtaatatatgtgtgcttggaggtcaagattctactttgtttctttgagaaagcgattgatgatcacttttgtcttcttgcgaatattactagaaggtga

SEQ ID NO: 268 - DNA, 1106 bp, Brassica juncea
cagcggtttaaacagtttgtctctcaaagcatagcaaggatggagaaccggttgagaggaagtggtcatggagttgctgcggcaaggatggatgcaatgttgaacattgctggctggatggctaaacagatgggtggtctcagatattttgaattcttacgcacccttgaaaagaaagtggatgaagactgggaagggatatcatcctcacttgaggagatcaggagatctctcctcgccaggaaaggctgcattgttaacatgactgcagatggcaagtctctcaccaacatcgaaaaatctcttgagaagttcctagatttactccctgaaaacccctctggtgggctagtcacttgggatggtagactacctctgagaaacgaagccattgtcataccaactcaggtaaactatgttggcaaagcaggtaacatatacagcacagggtatgagcttgatggaagtgcatatgttatatcaaagcatattagcaacacttggttatgggaccgtgttcgtgtaagtggtggtgcatatggaggtttctgtgatttcgattctcattcaggagtattctcgttcttatcgtaccgtgatccgaacttgttgaagacacttgacatatatgatggaactggagatttcttgcgtggtcttgatgtggatcaagagacgcttaccaaagctattattggaaccattggtgatgttggttcgtaccagttacctgatgccaaaggttatagcagtttgatgaggcatttacttggagtaactgatgaagaacggctaagaaagcgtgaagagatattgacaacaagtttgaaggacttcaaggatttcgccgaggcaatagatgtggttagagacaatggtgtagcggtggctgtggcatccgcagaagacattgatgcggctaacaatgcacgctccaacttttttgaggttaagaaagctctctaagctgagaactcctacactttatatgatttagaatctcattagatttgatctttgctttagcctttctctactggagtgtccttgctatgtgaaaattattacagtatgtgaaattcaaagcattttataaagatacagta

SEQ ID NO: 269 - DNA, 448 bp, Brassica juncea
ctgccatatctggtggagaaggtatgtccaccacctgctgaaggggcatacaagttggatccatttaactgtgaaagaatgggtggtgtgtacgagaacacccgaagtggcgattgtgggccagtttccataaagtttatggaattgcatgctgtagggaacccacatcctggaatggaaggcttgagcgatgcgctggtggacatcatgaggaagcagttcgcaatggatgtgtacaaggattgggtagtaccactgtacattgggggatgatagagttttctctatatgtatttgttgtatggtaattggaaggttttagtttgtggtagattttgtatgatatggacgaaaatggtttgtaaggatgatgctttaatttctgatttggtttgaacttctattaaaaatgtcactatttgctaaaaaaaaaaaagaagtactctgc

SEQ ID NO: 270 - DNA, 247 bp, Brassica juncea
tcgctttgctaactccaccgttgcagagtttaagcgcctcctcggtgttaaaccaacacctaagaacgaattcttaggcgtacctgttgtaagccatgacattgacatctctctcaagcttcctaaagaatttgacgctagaactgcttggtctcagtgctccagtattggaaggatcctagatcagggtcactgcggttcttgctgggcatttggggcggtagagtcactgtctttccaggtctct

SEQ ID NO: 271 - DNA, 267 bp, Brassica juncea
ttaaagaacttggttttactataccattcgaagaactatgttctctctcggagttacaagagcatatcatttcagaactgaagtccacggcagagaaaaacaagctaagaaagtttgagtacatcaaagcagtggcagtggagacaaaacctttcgacgtagcgagagacttagtgactgcaacgctgaagaaccggaggaacaacctgctcaagtattatcaggtacaaatcgacgagatgtaccataaattggcgtcaaagaaaa

SEQ ID NO: 272 - DNA, 280 bp, Brassica juncea
atgcggtgagtatgtcacgctaaggaaggttggtccaactggtcagaaggggggagcatcagggccacagcaaattctgatagaaggaccgttgtgtgaagattattataaaatcagagattatctctattctcagttttacctcctttgaatggtataagagagaagatacaatttcttcttctgttgtttccctttcgtttccaacacattcaaactagttcagtgtaatcttctttgtacccttttgaataacttgagtgtaatctttacatagtcg

SEQ ID NO: 273 - DNA, 679 bp, Brassica juncea
gctcccatgcttgctggtaacctcgttgctattctaacaggagggttgatccatgcggtgtgtagtctaatacagccacagaactacgattggtcgacgacgagggaaatcaaagtggtggaagctgaggctccaggggacgatatcgatgttcctgtagaggagctaaaagaagagaagctgagaagagccaaagcttggattgttaaatggggtcttgtcttcactctcctcattgttgtcatctggccagttctctctctcccagcacgtgtgtttagcagaggatatttctggttttgggcaattgtggctatagcttggggaactataggatcgattgtgataattggtttgcctttgatcgaaagctgggaaacgatcaagagtgtttgtatgggaatgttcactaacgataggttaatgaacaagcttgatgacttgaaccataggcttcaagctttaaccaaggctgtaccagaagctgagaggatttatctgctagaaattgagaagacgaagaaaaccgatgaagaaagttgaagaaagatcaatatggttatatgaaagattgattttcttctgcttttgtttatatgctttgcttgctcgtttttctagtttgtgtgaaatcatatcagaactatctcctattgtacaatgtgtttcttatctaatg

SEQ ID NO: 274 - DNA, 535 bp, Brassica juncea
atcacattccctgagaaaggaaacgagcagcccggcgtgactccagctgatttagtcttcatcatcgacgagaagcctcacccggttttcactcgggagggtaatgacctcattgtcacacagaggatctcactcgctgaggccctgacaggctacaccgtgaacctgacgacacttgatggtcggagactgacgatcccagtcaccaacgtgatacacccagagtacgaggaagtggttccaaaggaaggaatgcccttacagaaagatcagacaaagagagggaacttgaggatcaagttcaacgtcaagttccccaccagattaaccttagagcagaagacaggagtgaagaagcttctcggataaattgagctataatcagtgagtgcataccagtcaaagcaatgtagaacagaggataaggaagatttaagcttcttgtttgtgatttaatacttgttgtatcatcctttttggtcgatctgtaacataataaatactcctaataaaatttgtttgttgtaatcaaaaa

SEQ ID NO: 275 - DNA, 985 bp, Brassica juncea
gtgtggtcggatgcttgaaaccagtggaggaggagaaggagaatgggagatctctacgctttggacttcgatggagttctctgcgatagctgtggagagagctctctttctgctgttaaggctgcgagagtgagatggcctggtctgttcgtagacgttgattcagctctagaggaatggatcgttgatcagatgcatatcgtgagacctgtggtggaaactggctatgaaaatcttctacttgttcggttactgttggagacgaagatgccctctattagaaaatcttcagttgcggagggattgactgttgatgggatattggagagctggggaaagattaagccggttatcatggaagcttgggatgaagacgataaagatgctttgattgatttgtttggaaaagttagagatgattggattaacaatgacttgaccacctggattggtgccaatagattctatccaggagtttcagatgcactgaagtttgccagctcaaagatttacattgttaccaccaaacagggccggtttgcagaagcgttgctgcgtgaaatagcaggtgtaatcataccaccagaaaggatctatgctctgggttcagggccaaaggtggaagtgctaaagctacttcagaataaaccagaacaccagggcttgaagctgcatttcgtggaagacagactcgcaacgctgaagaatgtcatcaaagagcctgaactagacaaatggaatctatacctaagtaactggggctacaacacagagaaagagagagcagaagctgaaagcatttcaagaattcaggtcatcgagctttccacgtttagcaataagcttaaatgagtgcatactcatcccttttcattgtactctacggaaccaaacatgtcaaagaaactgtagctaaagattcagctaaaagagataaacttttcaatctcataattcatccttggtaacatcattcttgttatta

SEQ ID NO: 276 - DNA, 896 bp, Brassica juncea
gtggggagaggaggagaggagaagaaatggggcgggtttgagattccggtgcaaatgaagggaatgggtgagggtaaaatgggaaaagaagagaaagcgaacaagggaggtgggggtaaaaccggaaaagcagatgctaaaagtggtggtggccttctaggttttttcaaaaatggtaaaagtgagaagggaggtggtaagaaaggagacggtggtggtgataaggtgaagtcctccggtggtgggggaggaggaggtgaagttcatcattatgatgatgggcctaaaaagggaggaggcaagtcgaaaggaggagcccatgatatcgatgagctcatgaaacaaatcaaagcaggtggaggaggtaacaagggcaatcataatcatattagtgccaaggggatgggtggcccaatggttcaaggtggtccaatgggtatgatgggacaccaaagcggctctttcccggcggttcaaggcttaccgatgagtggaggcggaggatattatccaccaccgcctcaggcaatgaaccaacaacagtatatgcaaatgatgatgcaacaacaagctgcagcttatggaggatatggtggtggtcatggtggagacatgtaccatccgatgatgtatgctcggccttacccggcagtgaattatgctcatccaccgccaatgccacctccacactcgggtccttatactgatatgtttagcgatgagaatccagctggttgtagtatcatgtgatcttttgtattgtaatatggtaattagaaaacaaatatgaatatctttgtcttagaagtcttatgtttttttcttggggctgtcttttcttctgtaattccgtggaggattcgaaacaaaatgtgctttaattttgttaaaaaaaa

SEQ ID NO: 277 - DNA, 813 bp, Brassica napus
ggggttctatctaaaaccaaatacattagatacgggaaattaacttttctagattttattcagtaagtaagtacagttattacatgaaaagtggcagctaatggtattttgccgtacgtatttgtcttctcgccgtgactattgtctagagcgcgcaacacgcgacagactacaaaaagcaagaaaaaaaaagggaaagcgatatacgactaataacactgtaatttatcgcctatataaagagattttccaacaccacttttctagagataattattataaacactcagaaacttgtagattctcccgacttcttcgataactatttattaaaataaaataattctttttttttgaaacttaaattataatataactcagatcatgatttctgttgttgtcatcactgagctactggttgagtacacggcggcgctggcaaaactcaccgccgggattcttccgagacgtcaaggagacagagacgtcgtacgcatcggcggtttctctctacgttatcctcctcgatcgacgacaacgattccagatttctcttctcatctcgttgacttctgatatgcgaccaacgatctttgtcagatctcagttttgtgtgattctccggagcttgtgacgggagagacttttatttatttttcttcccttgattgtattatctcgtactctggtttttgttgtttatgtgaggaaagagttttggatcgattaaaggtttgtaaaattgtatcgagttataattgagataattattttgatgaactgcaaatgatataaatgccaagttagtaaggg

SEQ ID NO: 278 - DNA, 786 bp, Brassica juncea
attttcccctttctagatctccggtgactctggttcagcgacggcgcgtggcctcgggagacgtcttctccaccgtggatctatggtccctcacgacggtgagataaaaggagaaggtttgtgatggtgagctgacagagaaggatctccaggtataagtaccggttctcggagatcacacgaatcacgactcacgcggacaaggtacacaacatgagattacattagcggcgtttcgtggtggtggtttctattccccagagcagaaagctacaaccaatggatggcaccgattctctaaagctcgtattaggtacaccaacccgcgctttttgtagctgaaacccgactttcattcggatctcgtgtccgttttaggctgagggtcacagtgattgaagaccagcaggatgagactccctcgataatgcacctatggtgaagaagctaagtgaccatgtactttgaagccaagctttaggatcatttagtttgtttttaattggttcgggggttgttcttagttccggttgtgttagtaaacattgttgtaccatgaggttgaattttaggtggttgaaggggtggattgcttcgggtcgtggagtgatttcatcccactgtggttgaaaaatacaatgaaggatgttaggttgcgttggttccaagtagtgaatcagggtggaactagactacttcattgtatatgtggtagaaatcttgtgtggtcataagctttgtattaagaattggtgaaatgaaatgttgttgttgagccaaaaaaaa

SEQ ID NO: 279 - DNA, 642 bp, Brassica juncea
atttctgaagtctgttgatggtggtataatgaagctaggttcttagttcttcttttctcatcttagcttgttttacttcaatggactataaatctacatgatttatggccacataaactgggctttgcatgtagtatttcattgtttgtaaatcaagagattgggagtgtcttggcgatggtgagatcagatcaagaagagttggggtcttatggatgtcctaacaaatgatctatatctcttcctccttaaacctccccggagatacgtgaagatggtgactgaagaatatggtcatatgcctaggcagtctgcaaagaggataatctcagaggatttctgaagtctgttgatggtggtataatgaagcggagaagacagcggtttagaggcggagaaacaccgacttcgcggcggaggatacaccgacttcgcggcggaggatacaccggtaataggcgtgttcggaagttggtggaagatgctagatctatctcctaaatgatgccacgtggtcctaatctctttcggtggaagacgcgtagaccaattctcatctcatcaaatatgttttctttccgattaagtttaatatattggacctttatgtagactttaaatcctctgtaccttgcccattgg

SEQ ID NO: 280 - DNA, 1367 bp, Brassica juncea
ggtgagaagtgaggagtttcttcattaaaaatgtatttctaataacacagtaatcgaaataacgaagtcaagcgcaaccgaccgaaagagatccgactctgttcagttttctctctagctcgtgaacagccgcctctatcacaattctagatctgaggccttttccggccggcggtttccgctgcgctgggagaaggcctccacctttgtctctctttactagtaatcatgtagatttttgagttgcgacgatgggggttggtgacgtggtttctctccgacggcaatggcgttgtggtttggtggagttgtggttggttttggcttgttcttggtgaggtcgtcttcgttatcttggcgtgttctctccgtcggtggcatgaagctgattatagatccaagagggttgaatctggttggttgtggttgccctgctgtggcgttggagtgaaggccctagtcttcagcttctatcggtctgttggctctgtctttagcttttagtatcccttagtaaagatgtatgtgtttgctgctggtttgttcatggttattagccgggtttaacctgttcgtatgagcggtttcttttcggttttatgctcgtttgagtcgacttagtgttgttgccttgtttcttatggtgttactcagcttggtttgggctgccagtgttagaccttatctggtttctggttcgcagtggtcgtttttagctggttcagatgtgggttcttcattgttcgggtttggtctggcagtctctcaagtgaggcatcagaggtttcttggctcttctatccagcagaaacatttcatcttcggttttagatggtttacaagaactcttatttagccatgttcagtgtgtaagtttctttggagtgcttcagtattcgtgtctcccttgaagatccatttgggctcacctatgttactatatggacggactgatgtaagtaccggatcattgctgcgggaactttgaggatcctccacccttatgttttggctctttggataggaatctttttcaggttccctacccctctctatgaagtctcttggacctgtctctatccttcgtttggagatcgatgtgctctgcgttttggactgcaatcatcaacgctactccttcacttatgttttggattttggcttatgtattagagtttcttgtaaatcgtttttagttgtctagtagttttcttttatggctctggaaagatttcgatctttgccggcttatggctccggaagaaaagtgtttcttgccggcttaggtgtgtttcgactgtatttcacctgtgataatataatctttcagatgacaaaaaaaaaataacacagtaatctagtatata

SEQ ID NO: 281 - DNA, 600 bp, Brassica juncea
ggcgtctatggcttgggtttggatcctcagtgtctgttacctgcttgtccccctctggtcatggcgtttccccttagcgctcatgctggtttccattgcgtgaagctcatcgagtatcctcctgttttacggctgttcttcattgttctgttccgttttccgttcgagtcggtcagttctctggttctcagagactgtgtgtgtcgaggctctcttatccggttgtcatttgggtaggtcgcttctcgtgtttgaacccatcatcccagcacttgaagcctagcgcccgggcgttttttgtgtttcttgtgggtgtgttcatccggctcgtgtgtggtagctcggagtattaagggtggagctgcggttacttctaaccccatgtttgtgcaggtttttgtcgtatggctccttggggctttgcgtccaataattgctcagtcttgttgacgcaggcgtacttggcctctagcgttcatgtctggtcgcgtgggcggattctaatgttgtttacctcgagctgttcttggtcgagccaatccttaagagcggatcatcggggagggccaaatttaccgggttccgacaaatttgaccctc

SEQ ID NO: 282 - DNA, 276 bp, Brassica juncea
agatatagagagactcagatctaggttttcagagtggtcgactcaggtggctcacatagcaccggagtcgggtttcgtggctctagctcatggttgtttcgttcctgttgttgttttgtgaaggtgtggtatggatctgatttgcttgagaggtgtgaagattccggcgtgaaggagcgtggcagcgcgtggagagcattttcagcatccggtggttaggaagtggtttcgtctagaaaatgaagtcgtgtgtgcgttgttttcgccgttatcaga

SEQ ID NO: 283 - DNA, 172 bp, Brassica juncea
gcactacggatgagtctgtccgtttttatggctgaggatcgaggcattgaagactgatgagttgagactagttcgggaaacgccttctggtagatgctgttggaacaaaaacttcaagctgatcattagggaccaatagctctgtatattattgtaatctcgaattaggttc

SEQ ID NO: 284 - DNA, 549 bp, Brassica juncea
ggttacggtctcgattcatatcctttggaatcctcagatttgaatttatattggaacccgttttgattcttagttactgtttgttcactgcatccacatcacatggtctttagagtagtttattcagtcggattctatgtctgtacgtggctaaggacagtagcaattgaacacaagcggatacaagcctccctcggaaacgcgccttcgggtgaagatgctactggcaacgtacagaatgtcgatcctatgaggtcatagcttggtgctgaactgttttttcggtttagaattgtgtttgctgtgttagtagttgttttctgtcgtgtggtagaatgtaggggtctaagaggtgagtctcatttcgagttgtggagtgagctcattttcgttgtggttaaaaatgcaatggtgtttcagttgggtagcgttgaatccaagttagtgattcagggtgttactagactacaccattgcatcagtggtcaaattctgtagaggtcaaaatgtttgtaccttgttgaattggtgaatgaaagtgattattga

SEQ ID NO: 285 - DNA, 865 bp, Arabidopsis thaliana
acgcaccgagctttaagaagagtgaaagatggtgatggactcatcaaaatggtggtggattggaaatcacaacactactaatttctctccttggcttcattctactctctctgaattggatgaaaagacaaaggaaatgctgagagtgattgatgaggatgctgattcttttgcggcacgagctgagatgtattacaagaaaaggcccgagcttatagctatggtggaagaattctaccgttcacatcgctccttggccgagaggtacgacttgttgagaccctcttctgtgcataaacatggctcagactcggagagtcatgagaaatcatcaacttgtgatgagtcttcttggtctgaggcttgtgagactcatgaggagtatgcggagtctgaaatagataacggtgaaagcaaatgggtcgatgaaagtgaaattgatggcattgttgaggaaatagaaccatcggaagtcgtttacagtgaaggtaatggaaattctgagatgatgaagatagagatagagaggctgagagaggagaataaggtttacagtgaaatggtgagagagaaagatgaagagaagagagaagctataaggcaaatgagtgtagcaatacaaatgcttaaagaagagaactcagagcttaagaaacgtgttaccaatactgttgttgcaaggcgtaataaggaaggtggtgattctcagaggaagcaacagatgtggaagccatttgagtttaagaagattaagcttgaagggttatgggggaaaggctttggcaattgggctctcccaaacacagattctacttccaaagagctcatgactctttagaggagacagagaggtccgagtgattag

SEQ ID NO: 286 - DNA, 1217 bp, Arabidopsis thaliana
tgcagctaagaaccagagatagagagatagagatgcggaggatcaattcactgtacggaagaattggtctcctaaaacgagtacccgagaaatctacgaagcaagctcatacatttctcgcatctctctccttctctacggaaggtgcttatggcggtgacggtgagtttcagcagaacagctccaaagtcaagatctttgaccgagacctcaagcgaatacatcgtgatcgagcggcgtggctttctcgccaaaaaaacgattcttttgttgacgctgttgcagataatctacttgatcgcttagaggattgtaagaagagttttcccactgcattttgtttgggaggatctcttggtgctgttaagagattactacgtggtcgcggtgggattgagaagcttatcatgatggatacttcatatgacatgattaagtcatgtagagatgctcaagacgattcactcgataactccattgaaacctcttactttgttggtgatgaagagtttctgccagtcaaagagagttcggttgatttgatcattagttcgttggggcttcactggacaaatgatcttcctggatccatgatacagtgcaagctagcactgaagccggatggcttatttttagcagcaattcttggtggagaaaccttaaaggagctgagaatagcatgcactttggctcacatggagcgggaaggagggattagtcctcggctatcacctttggcacaggttagggacgcagggaatctgttgaccagggcgggttttagtcttcctggtgttgatgttgatgaatatgtagttaaatacaagagagcgatggatcttatagagcatcttcgtgcgatgggtgaaaccaatgctcttctcgagagaaacaagattttgaatcgtgaaactgctgttgccacggcagccatatatgactccatgtttgccacagaggacggcactatacccgctacttttcaggtgatttacatgacaggatggagagaacattcgtctcacccgcaggccaaacgaagaggttcagccaccgtatccttcacggatctccaaaagcaatttggcggacaatcttgatggaatgattgaagaagagaaacattcaataagcagagactttacaaatgacacttgagagagaaatcagtgacttaagctataaggtacttggaggaactcttgtagatttgtcgg

SEQ ID NO: 287 - DNA, 1275 bp, Arabidopsis thaliana
ttcgaaatatcaaaagaaggaacaaaaatgcaagccatcggtagcagccatggcaggaggctctgcttcaaccactatctctccgattccttctccaaattcctctctccttcttcttctccttcccttctccctcagagatgccattcgttctgtatccccaagcttggaagtagtagtaccaatgagaatggcagaggaagaagtgtaacagtgagagcttcaggagatgaagattctaatgagaactttgctcctcttgctcctgttgagcttgaatctcctgtaggacagcttttggagcagattcttagaactcatcctcatcttttacccgttactgtcgatgagcagctcgagaaattcgccgcggaaagcgagtctcgtaaagctgattcgtcttccacacaagacattctccaaaagaggatatctgaagttagagataaggaaagacgtaaaactttagcagagatcatttactgtttagtggtacacagatttgtggaaaaaggaatctctatgattcctcggattaaaccaacttcagacccagcaggacggatagacttatggccgaatcaagaagagaagctcgaagtcattcactctgcggatgcgttcgagatgatacagagtcacttgtcttcagttcttggagacggaccagcagttggtccgttaagctctatagttcagataggcaaaatcaagctaggaaaactctatgctgcttctgctatgtatggatattttctcagaagagtagaccaaagataccaacttgagagaaccatgaacacacttccgaaacgccctgagaaaaccagagaacggttcgaagaaccttcgcctccttacccgttatgggacccggattccttgatcaggattcaaccagaggaatatgatcccgatgaatacgcgatacaaagaaatgaagatgagtcatcgtcttatggattgagatcatatgttacgtatttggactcggatacgcttcagagatatgccacgatacgttctaaagaagccatgactctgattgagaagcagactcaggcgctctttggacgaccggatataaggatactcgaggatggaaagctcgatacttctaacgacgaggttctgtctctgagtgtctctggacttgcgatgttggttttggaagctgtggcttttgggtctttcttatgggattcagagagttacgttgaatccaaataccatttcctcaaggcttgagtttagtcctccttgacatttgtacct

SEQ ID NO: 288 - DNA, 1538 bp, Arabidopsis thaliana
cgcaatccgaagattctcgccgccgccgtcgtcatgtcgccgtccgacgaatcgacgaacggttctcgttgctcatcatgcatctccagcgacaacgatggcaacgatttcggtaaatcggatgagtttacatgcaaacaatgcaaaaactccgattcgaaatcgaaatcaaaatcggtgaatgattcggataagcttcgaagaatcatcgtcgcttccgtcaaaggattcactataggtactggtttaaaaggtggtttagctattttctcaatcgtcgctcgtttcgctcgtcgtcgtagatcttctcctcaatctaggaaaaccggagagttttcgaatagtgaagctatcgctatggggattaaggagacgttaagatatggattgttcttaggaacttttgctgggacttttgtttctgtagatgaagctattgctgctttagcaggagacaagagaactgcaaaatggagggccctgtttgctggattggtggctggaccatctatgcttctcacagggccaaatacgcaacatacgagtttggctgtttatatattgatgcgtgctgcggttctcgcatcgcgttgcggtattaaaagtaaacgctttggtaccatttgcaagccacttacttggaaacatggagatttattcctcatgtgtctctcttcctcacagattttgtctgcttacattttgaaacaagaaagccttccttcatcgtacaagtctttccttaacaaacaaggtgggaaggatctttcaatcttacaaggcgtaaaagatatcgcaaccgcgcaaccgttcactaatttaagagcgattgagaaatattacaagtctgttggagttgatatcaaactggatcctaccatgaaagtcccctgtacgataatacatggaaatgagtcatgtgttaagcatggtgttacatttttccttcaagcttacaagagggcgttacctgtctatgtccctgtgtatttgattccagcgctaatagtccatcgtcaagacctgctaaaaaagcaatactctatacttggcaagggtcttctgggcacagcgagatcaagtttgtttctcgctacttactgctcttctgcctgggcttggacttgtctactattccgcacttttgagacatgcaacataccgcttgtggccatagcaacattcccaacaggtctggctttagctattgagaagaaaagcagaaggatagagatatcactatactgcttagcgagggcgatagagagcttctttacttgcatgacagaggcaggatacattcgaccgcccaagagtttaagaagagcggatgtggttgtgttcagcgtttcgacagccattataatgcattgttacgcacaagaaagagacgtatttcgatcaaaatacttgaacgtactagattgggtcttcggtgttcctcctccccctcctgctccttcttgcgaaacaacctagagacattcacttttaacctaaagatctttctgatgtgggacagaatttggtggtagaat

SEQ ID NO: 289 - DNA, 2184 bp, Arabidopsis thaliana
atcccgatttctccaagcagccatggctccgaaatcgaaagaaaaatccaaaacatcgaattcacaaccacctccagcaatcgaagatctcttcacttccctccaccaacatatcaaggatactaaatatgaagaagccgtcaaggtcgctgatcaagttttgtcgattgtacctaccgatgaggatgcgatccgatgcaaagttgtggctctgataaaagacgataagttcgatgattatctaatcaaagacgttaagatcaatggtgctctctccgtcattaactcgttccagaagcttccaatcgatctaggttttcacaaggcgtattgcttataccgtgtaaacaagctagatgaggctttggtgtgtttaaaaggtctcgagagagatacagatactttggttttggaggctcagattttgtaccgtttggggaaggcagatgcgtgtgtggatgtgtatcagaaactgaccaagtcccagattgagacgttagaggttaatttagtcgccgggttgatttcagctggaaaagcttctcaagtgcagaaaacattggagagtttgaagatcaaaccaactagtagttttgagttggcttataatactgcttgctctttgattgaaaacaataactatgctgatgctgaacaacttttgctcactgccaggagaattggtcaggaaaccctcaatgatgacgacatcgctttaaccgatgaagaaattgagattgagctggccccaattgctgttcaattagcatatgtccaacagatccttggacaaactcaagaatccaccagctcttatgtagatttcattaaacgaaatctggctgatgaaccttcacttgctgttgctgtaaacaaccttgttgccttgaaaggtttcaaagatatttctgatggcttgaggaagtttgatctgctgaaagacaaagactcccaaacttttcagctttctcaagcacttgatgcaaagctttcacagaaacataaggaggctatatatgccaatcgcgtccttctactcctccatgcaaataagatggatcaggcacgagaactttgtgctgcactgcccggtatgtttcctgagagtattattcctacattgcttcaagctgccgttttggtgagagaaaacaaggctgccaaagctgaagaacttttgggacagtgtgccgaaaaattcccggaaaagtctaagttggttctcttggccagggcacaaattgctgcttctgccagtcatcctcatgtagcagcagagtccctatccaaaatacctgatattcagcatttgcctgcaactgttgccaccattgtcgccctcaaagagcgtgctggagacaatgatggtgctgctgctgttcttgactcagcaattaaatggtggtcaaattcgatgaccgagagcagtaagcttagggtattgatgccagaggctgctgccttcaagctaaggcatggtcaagaagaggaggcttcacggctatacgaggaaattgtgaaaaaccacaatagcacagatgctctggttggtcttgtgactacacttgctcgtgtcaatgttgagaaagcagaaagttatgagaaacagcttaagcccctaccaggtttgaaggctgttgatgtggataaactagaaaagacctatggtgcaaaacccattgaaggcgctgctgcttcatcgagtcaggaagaagtgaagaaagaaaaggcgaagaggaagaggaagagaaagccaaagtatcccaaaggatttgatccggcaaacccaggtccacccccagaccctgaaaggtggcttcccagaagggaaaggtcaagttacaaacccaagaggaaggacaagcgagcagctcaaatccgtggctcgcagggtgcggtgaccaaggataaacaagaagcagctccttcaacttcaaagtcaaaccaagtggccagttctaaagggaatgcacctgcgccttcctctaaggcctcaaaaaagaagtctagaagatgaacgaaacaaccctttaagattgtttcatctgttctgagaaaacaaaaacaaagagtacttagccccaaaatttccattgttctttttctttttggattcatcaagttttagttgtcttgacccatttaagattttggttaatttctcgtttgcattgcctgaattct

SEQ ID NO: 290 - DNA, 1852 bp, Arabidopsis thaliana
taatctccatttcattccttcgacatcttcacacaaaccctaatctcatttctggtaaatccgattttgggaaactctaatttgatctcgagatcgctaacaacgatggaagaagacaagcaaatgcacgaggagaaatcatctctggttaaagaagaaccggttcgtggagaagagcccgagattgagaaattgacagtggcagatgtggacgcgccaccgaagagtaccggtggttggggttggggtttctctggcttctctgtgctttccgatctccaaaaagctgcggaagatatttctcgtaatgctgcagcggtggcagagaaagcagcgaaaagcattgcagagatgggagaagtggatgaagactctgaatcttctgctaaggaagaagagaaaactgaagaagctgatacagagcaggatagtgatgatgagaatgcgaagttaaagaagtcagctcttgagagattggagggtgcaagtgaagagtcacttcttagccagggtttgaaggttttcgatgattcagttgagagtttcacttctggagcttggcaagcatttggaaatgcgttaaaagggggcacaagtttggtgcaaaagcttgaaaacagtgtccagcaaggttcttcgcctagggaagctggatctggtgcaccgtctctactagagacaggaaaagcattaactgcgaaaggaatgcaagtacttgaatttgtgggcaaggaaactatggatttactgattacagagactggtattggagctgagaaggatagggtagactttaaggatcaagtacttgaggaggttacatttgatcgatgcttttacatttatggtggtcctgagcagcttgaggaattggaagcattggctagccactatactctgttgttcaacaggagaaaggggaaattgtcaccagatcaaaaatcgctgtatgacgggaagctcaaacaaatccagcaacttttcagctttgctgatgaaatgagtggaagtaaagcagagtctgacaaagggaagaaaatagatatcaaaactgaaggcaatgatgatgacatgaagaatctgcataactcaagtgtcagcaaagctgctgatatggctactgggttcacaaatgctttagcgggactacacgtaaatgatatgatccagcgaaccggtggcaggcttgaatctcttcactcagaaggagttcatagactttcagagatgtgctgttttgcagtcacacatctgcttatcctcggtaagtccatgatatctcatgccaacaaagttcaggatgaagacactgaggcattgaaaatcgagtgggcagaggatcctacagagaaagctaagctgattagaggcaaggcagaaacaatggctggatatgttgaagcagtttccaatagctttataacaggaatatcagatgtatctgaaacatactcagctgcgattaaaggagttgcagctgctgattccaaagatgatcttctgaaaacatcgaccatgcaggaaaaagcaagcaccttcaacgatagtcttcgctctgaccaaaccacagctatcacaaagatccaggaagggcttcagtacctgtcctatgtcgtgatttctacctcgatgccctctgcctaatataataagagtcagattggtcttatttgtggtttacatgacttggatttgatttagttttctttctagttgtagatatatctctttcgctagctgctcttatggtaagtctttcccacttgtgctctacttctttgttgtctggatcttgaaagttttattaaatctaggaaccaaagattgaaagcagggaagcgattagtacttt

SEQ ID NO: 291 - DNA, 1527 bp, Arabidopsis thaliana
gctacatccagatttcctcatcctctattagggaagaagaaccaaaaccctaatcctatcttctcctcttataaatcgcttcaacaacagtttctttctcttctgatttgatccatgatttctcatctggaaccctagtttatacatccatcgggtgttactgttctttatctgggcaatcagtggtgtttttgttccttttgtatatctgtcgagacttctaggtgtgaaatcaaagcttgtttggtttatatcgatcttggttttagctgaatcgttgttaagatggctggaggtggaaacaggagagatgaaggatcgatcacgatccagagcactaatttgtttgcagcattggacactcgtaagaagaagaagaagtctgacaaggcagggaagagcaaagggtcttctaagtcacgagagccagagaaggagcctgagcctcaggtctattgggctcctacgcctttgaaagttaagtcttgggctgatattgatgatgaagacgacgatgatgactattatgcaaccactgctcctcctcagtctggttggagtacttctctgccttcccatactgattccaaagacgttcatgttgaggaaagtgaaagtgaggaagatattcttgatgaaggtgatgatgatgtggaggaagagcaggaacaggaaacagaggtacaggttcatccagagcctgaggtgaagaaagctcctgaagttcctgcacctcctaaagaggcagagaggcaactttccaagaaagagaggaaaaagaaggaacttgctgagcttgaagctttgttggctgattttggagttgcccccaaggagaacaatggcctagaggaatctcaagaggctggacaagaaaagaaagaagatgtcaatggagagggagagaagaaggagaatgcagcaggtggggagtcaaaggcatcaaaaaagaagaaaaagaaggataagcagaaggaggtaaaagaatctcaagagcaacaagcaaacaacaatgccgatgctgtagatgaagctgctgggtctgaaccaactgaggaagaatctccaattgacgtcaaggaaaggataaagaagcttgcatccatgaagaagaagaagtcaggcaaagaggtggatgctgcagctaaagctgctgcggaggaggcagctgcaagacgtaagaagctggccgcggcaaagaagaaggagaagaatcactataaccaacagcctgtgcggtaaaatcctgaatcaccaccattttgatcttgatggaaatgcaaatatgaacatgtatttcgccgtatattgttcatatgagtctctgtcctaataaatcttttgaagggtctggttcttagagttaaagacattgaatcctttttctagtcttattacaatgaacaggctaaagacaaaactactctctggagattttcatttctttttgaaacacctttgttttcttaatatcagaccttttttaggttcattatgtcttcaatcagcttcttatgtatggttcga

SEQ ID NO: 292 - DNA, 2570 bp, Arabidopsis thaliana
aaagtcgacagaagaactaggcaacgcatcgccatggatcaatcatcctccatgcattgactttttttagatcggaggaaaaaagtatgcaaatttagttagggttttgaaattcgaaaatcgagatgcggtgggatttgatcacggcgattgtggctgcgctggtggtctcggttttggctgatgaatcgggtcaaatggcaccgtatcggatccacacgctcttctcggtggagtgccagaactacttcgattggcagactgttggtttgatgcacagcttcttgaaatccggccaacccggtccgattacccggttattgagctgtaccgatgatcagaagaagacttacagaggcatgaatctcgctcccactttcgaagttccctcttggagcagacatcctaagaccggtgactggtacccagcaattaacaaaccagttggagttctttactggcttcaacacagtgaagaggccaagcatgtggattgggtcgttattcttgatgctgacatgatcattcgaggtcctatcatcccttgggaactcggtgctgaaaggggaagaccctttgccgcccattacggctacttggtgggctgcgataacctccttgtgcggttgcacacaaagcatcctgaactctgtgacaaagttggcggtcttctcgctatgcatatcgacgatcttcgggtcttggcccctctctggctgtcaaagaccgaagacgttcgccaagatacagctcactggaccaccaatcttaccggagatatttacggcaaaggttggatcagtgagatgtatggttactccttcggtgctgcagaggcaggacttaagcacaagattaatgacgacttgatgatatatcccgggtatgttccacgagaaggtgttgagcctgttcttatgcattatggtttacctttttccattgggaactggtctttcactaaactggaccaccacgaagacaatatagtctacgactgcaatcgcctcttccccgagcctccatatccaagagaggttaaaataatggaacctgatccgtctaaacgaagaggtctaattttgagtttggaatgcatgaatacattgaacgagggactcatactgcgtcacgcagaaaatgggtgtccaaaaccaaagtggaccaaatacttgagctttctgaagagcaaaactttcatggagttaacaaggcctaaactgcttgcaccaggaagtgtacatatcctgccagaccaacacgagccgccacccattgatgaattcaaaggaacttatccaaagattcacacactgttttctactgagtgcacgacttatttcgattggcaaacagtgggcttcatgcacagtttccgccagagcggccaacctggaaatatcactcggcttctcagttgcacagatgaagctcttaaaaactataaaggtcatgacttggccccgacgcattatgttccttcgatgagcagacatcctctaacaggcgattggtacccggcaattaacaaaccagcagcagttgtccattggcttcaccacacgaacattgatgcagagtacgtagtaattcttgatgctgacatgatccttcgtggacccatcacaccttgggagtttaaggcagctcgaggccgaccagtttcaactccttacgactatcttattggatgtgataatgaccttgcaagacttcacacgcgtaatcccgaggcttgtgataaagttggtggagtcattataatgcacatagaggatctccggaaatttgcaatgtactggttgcttaaaacccaggaggttcgagcagacaaagaacactacgggaaggagttaactggggatatatatgaatccggttggatcagcgaaatgtatggttattcatttggtgctgcagagctgaatttgcggcatagcataaacaaagaaattatgatttatcccgggtatgttcctgaacctggtgctgactatcgagttttccactacggtcttgagttcaaagtcggaaattggagctttgacaaggcgaactggaggaacactgatttgatcaacaaatgctgggcaaagtttccagacccgcctagtccttcggcagtccatcaaacagacaatgatctacggcaaagagaccttctcagcattgaatgtggacagaagctaaacgaagctctatttctgcatcacaagagaagaaattgccctgaacctggatcagaatcgactgagaagatctcggtttcgagaaaagttggtaacattgaaacaaaacaaacccaaggaagcgatgaaacaaaagagtcaagtggttcgtccgagtctgaagggagattcagcacgttgaaattatgggtgattgcgctgtggttgatatctggagtagggttcttggtagtgatgctattggtgttctcgactcgtagaggcagaggaacaacaagagggaaaggttacagaaacaagagacgaacttcttactcgaacacaggtttcttggacactaaatgatcatttctgttagaatctgagcaataggagctcttt

SEQ ID NO: 293 - DNA, 1271 bp, Arabidopsis thaliana
aaaggatccaggagacagagctatttgttcgaaagatgcaacttttaaatagctgttgtggaaaaggatttgatgggaagaagaaagaaaaggaagagccatcttggagggtattttcactgaaggaacttcatgcagccaccaacagtttcaattacgataacaaactcggtgaaggtcgatttggtagtgtctattggggtcagctatgggatggctcacaaattgcagtcaagaggttgaaggaatggagtaatagagaagagatagattttgctgtggaagtcgagattcttgctcgtattcgtcacaagaatttgttgagtgttcgtggctactgtgctgaaggacaagaacgtcttcttgtgtacgagtacatgcagaatttgagcttggtttcacatcttcatggccagcattcagctgaatgtcttctagattggaccaagcgaatgaagatcgccataagctctgctcaggccattgcctacctacacgaccacgcaaccccacatatagtccatggagatgtgagagctagcaatgtgttgttagactctgaatttgaagctcgcgttacagattttggttatggtaagctgatgccagatgatgatactggagatggagctaccaaagccaaaagtaataatggatatatctcaccagaatgtgatgcatcaggaaaagaatcagaaactagcgatgtgtacagttttggtatccttttgatggtactggttagtggcaagagaccactcgagaggctaaatccaacaacaacgcggtgtataacagagtgggttttaccacttgtttatgaaagaaattttggtgaaatcgttgataagaggctgagcgaggagcatgtggcagagaaactgaagaaagtagtcttggtggggcttatgtgtgctcagacagatccagacaagagaccaacaatgtctgaagtggtggagatgctggtgaatgaatcaaaggagaaaatatctgaacttgaagctaatcccctcttcaagaatccatatagcagcaacgaaaacaatagagagcatgttgcagaggaaagctcagatgtgatcttagaagataaagatcatcaacaacaacaagaatagcaatggttaggcacagtaattcgtttggcagattatttttagaggtcttgcttattttttttagtgtgtttcttggttcataaaattgatttgatcattactgatactggagtttgtaaggtgtggtattggcacatataaggtaccttt

SEQ ID NO: 294 - DNA, 834 bp, Arabidopsis thaliana
ctagctcggagtaagctaatcgaagaaaacaagcttgttattgatcgatctttcggtttttgttttgacgttttgtgtgaacgagttacttttggatatgagctctgtctgtggtgggttggatttcaaagatgcagagagcagctctgcttccagtcccattatatgttctactggcgtaaagcatatctcttgtgttggatctgatgatgctcaagagtctgatggtgatgatagtggttatatacaccaaactgtgatcgaagaatccaaagacaaggcgatcagcgaacccatccctgagtctttacctctcaattctttggatgatgaaagtgaagataagaaccttgctactgcattgcaagacatgttctctgagagtatgagtgtggttactctgattcctgccattaaaggtggtcgagagaagcatggcaagtcactcgagaagctcagtgtgtcatgggctgaagatgtgtatgatcctcctccctccattgtctctcacacaagaagcaagaaacagcaaccgcagaaatcaaagagcaaagacaacctgaagaagaatggaaagaaaggacaaaagggaagcagcaattcccgcagcagcaaagacaagaagcagatttcttcacgcagcagcaaatacagtcgtgataagtttgattggacaacacaaatgtctgttctagctgcatcttcttgaatctgtgtggtatgaccaaggctcttgcgtcttccttgctcttgtctctctctctctctctttcttgtttataaataaaagatttgaagtgaaaacttttctcgagtttcagaacgactattgtt

SEQ ID NO: 295 - DNA, 1310 bp, Arabidopsis thaliana
gtacagccagtcctcgtcttgctggcctgcaataataatgtctctgatcggccgcctcaatcttggtcggcgcttctgcaccgccgtgccaagaagatcggaagacataatgtcaaacccagattgccgcccttctgatctatgcttgagggtctcgtacttgatcagatgcgttggggatctcgacacggcggcgaagtacgctcgtttggctgttttcaccagcatcaaatcggagtcaacaacaacaatatgtcaatccatcatcggaggcatgttacgggataaaaggctcaaggacgcttatgatctctacgagttcttcttcaatcagcataacctcagacccaacagccattgctggaactacatcatcgaatctggtttccaacaaggtcttgtcaacgatgctctgcatttccaccaccgatgcatcaattccggtcaggtccacgactacccaagcgacgattctttcaggatcttgactaaagggttagtccactccggtcggttggaccaagccgaagcctttcttagaggcaggacagtcaatcgaaccacctacccagatcacgtggcgtacaacaatctgattcgcgggtttttggatcttggaaattttaaaaaggcgaatctagtcttgggcgaattcaaacgcttgtttttgattgccctatccgagaccaaagatgatttgcaccattcaaactatgaaaacagagtcgcattcctgatggccacattcatggagtactggtttaagcaaggtaaacaggtggaagctatggagtgttacaaccgctgtgttctatcaaacaggttactggtttgtgccgaaacgggtaacgcccttttgaaagtcctgctcaaatacggtgaaaaaaaaaatgcttgggcattgtaccatgaactcttagataaaaatggaaccggtaagggttgcttggactctgataccattaagataatggtggacgagtgctttgatatgggttggtttagtgaggctatggagacctacaaaaaggcgagacccaagaacgactacctcagtgacaaatacattattacaaggttttgcgaaaacaggatgttgtcagaagcagagtctgtttttgttgattcacttgctgatgattttggatatattgatgttaacacttataaaacaatgatcgatgcttatgtgaaggctgggagaatacatgatgctataaaaacctccaacaagatgatcgatgcaactctaaaggaggtctcccatctcttttgaccattcctcgtcacttggtgatctttatttaatg

SEQ ID NO: 296 - DNA, 2583 bp, Arabidopsis thaliana
aaaggatccgatccagtagcagaagctgaagctaataaacccaatcatagagaaagctctctgaacaaaagacattttctgggtttgttttaattaaaaagaaatggccgattcgaccaaagtaaggctagttcgttgcccaaaatgcgagaatctcttatcagagcctgaagattctccctttttccagtgcggtggctgcttcaccgttcttcgtgccaaaaccaaggagcgtgaagcagattctgtttcagtcaagtccgttgaagatacagccaaaccggtttcagctagttccccagagaaagcaatattggattctagtgaaacttcatctgactctgatgttccatctttgagacaccaccataatgttgttcctgttgatgttgagagtgatccttgttcaaaaccttcttctcttgaacaaggtaacagatctatattattaggggataaagatgaccttaaatctcaatcagggagacaacaagattcgggttgggatcggtttaggaaaagaacaaccaagagatgtgattctcaaagtgtcatcaacagattatccacttctaggcatccttgtgatgaaggcacttcttcttcagcaaactactttccagattcactccttgaattccagaaacacttgaaagatcagagcaacgaagcaattgagcaagaccgagctggacttctgagacagttagaaaagatcaaagaacagcttgttcagtcttgcaatgtggcaactgacaagtctaaagaacaggctcctagttcttcgtccgcctcggggttgaacaaggcgcctccaatgcggtttcacagtacaggaaatcacgctgttggaggtccttcttattaccatcaaccacagtttccttacaacaacaacaacatcaatgaagcccctatgcaccacagtctgatgcatccctcttatggagaccctcataggttcccgatacacggaagaggtcctcatccctacttctcgggacaatatgttggtaataataacaacggtcatgatctctttgacgcatacccgcagcaaaacgggcattttcatcactcatcttgctcttgttaccactgttatgataataaatactggcgaggttcagcaccggtggtccctgatgcaccctataatgctggtttttatcctcatgagagcgttatgggttttgctccaccgcataatcctagaacttatggttctcgtggtctacagcctcatggaagatggcctagtaacttcagtgatgctcaaatggatgctctttctcggattcgtcctcctaaagttgtattatcaggcggatctcgtcatatccgccctttggcaggtggtgcaccgtttataacctgtcaaaactgctttgagcttctacaattgccaaagaaaccagaggctggtacaaagaaacaacagaaagtgcggtgtggagcatgttcctgtttgatagatttatctgttgttaataacaaattcgttctctcgacaaacacagcttcaacgagacaaggagaagcccgtgtagctgctgattacacttctgatgactatgatcttcttggttatgtatttcactcgttggatgatgaaccaagagatcttccgggattgatttcagacaagtctcaagatatgcaacacgttcattctcattccgccagcctttccgagggagagctaagctcagacagtctaaccgctaagccactagctgaagctcacgaaaactttgttgattactcttcgatcaatcatgaccggtctggagcaggcagccgtagctctcgttcagaacacgacaaggtcacactgagcaaggcaacagccatgagacagaactccatgaaagaggtttcacttgcaagtgagatggaagttaacttcaacgactactctcatcgtaacagtggagtatctaaagatcagcagcaaagagctaagaagagcggattcgcgagcattgtgaagaaaagcttcaaagatctgacaaaatctattcagaatgatgaagggaacaaaagcaatgtttcgataaatggacatcctttaaccgaacgtctgctgagaaaagcagagaagcaagccggagtcattcagccaggaaactactggtatgattacagagctggattctggggagtaatgggaggtccaggtcttggaatattaccgccattcatagaagagcttaattacccaatgccagagaactgctcaggtggaacaacgggagtgtttgtgaacggaagagagcttcaccggaaagatttggacttgcttgcgggtagaggacttcctccggacagagatagatcctacattgttgacataacgggtagagtcatagatgaagacaccggtgaagagctcgattgcctcgggaaactagccccaacgattgagaaattgaagcgtgggtttgggatgagacttccaaagagaactacgtgaaagaagataagaggagagatatgtatttagctgaatatcttttgtttagaaagagagagcttatgtatgtatttagaaattggtattatttgcttccactcgagttt

SEQ ID NO: 297 - DNA, 1151 bp, Arabidopsis thaliana
aaaggatccccgtaattgtgtctcttctcttcttctggacaaaaaaaaaatggaatggatacaatcactgcccaaaatcgagcttcatgctcatctcaacggttccattagagactccactcttctagagcttgctagggttcttggtgagaaaggcgttatagtgtttgctgatgttgaacatgtcattcaaaaaaatgatcgatctttggttgaagtcttcaagttgtttgatttgatccataagctcactactgatcacaaaactgtgacaaggatcacaagagaagttgtggaagattttgctttagagaatgtggtgtatcttgagttacgaactactccaaagaggagtgattcaataggtatgagtaaacgttcttacatggaagctgtaatccaaggtctaagatctgtcagtgaagtcgatattgattttgttaccgcatctgattctcaaaaactgcacaatgctggtgatgggattggaagaaagaagatttatgttagacttcttcttagtattgatcgtagggaaacaacagagtccgcaatggaaactgttaagctcgcattggaaatgagagatgtcggggtagttggtatcgatctttcggggaatcctcttgttggagaatggagcactttcttgcctgcattacaatatgccaaagacaatgatcttcacatcactcttcactgtggagaggttcccaatccgaaagagatccaagccatgcttgattttaaaccgcatcggattggacatgcctgtttcttcaaagacgaagattggacaaagttgaaatctttccggattccggttgaaatatgtttaacatccaacattgtaaccaaatcgatatcttccatcgatatacaccatttcgctgatctttacaatgcaaagcatccattgattctatgcactgatgattttggagtattctccactagcctctccaacgagtacgccctcgctgttcgttctcttggtcttagtaaaagtgaaacctttgcattggctagagcagccatagacgcaacatttgcagaagatgaagttaagcaacaacttaggttcatttttgattcagcctcgccagagcacgtttagtgagactgttgagtgcttcagatttctcgagttt

SEQ ID NO: 298 - DNA, 869 bp, Arabidopsis thaliana
aaccaactctgcagctaacatctctaaggtttgattttccgatgatgagggtgatggagcctccgcctatcgaggaggcagctttggccccagtatcggtcttctgggacataaaatcgtttccggttcccgatggctatgatgctcgactggtgggtccgtgtatcaaacggaatttgaggaagttaggctacacaggtcctatcaccatcactgccgttggcgtactatcagaggtccctcgtgacatccttaaagcagtgtattccactggaatctctcttaaggaggtcattaaaagtccgacaaacatgtatgctcttttccttgagtcctctcttcttcgtactccacctccagctaatatgatggtcatatcccgtccaccatcctacattcctcgacacttctcttctatacgtgacaaggaccgtgagaagggtcgctacactattttcccgtttccattcggagaaatgcctttgactcttgcaatcagcctctgggaagacttccttctggcagatccagtagctcttgaggaggagaagtgcagtgaaatgggtgatccagcctcctggttctgcgctgtgtgtcatcattttgctgccccagatcttgttactggccgggacttgatagtttcatcacgcatctctattctcgacaacatgcacaactgcttcaattccaaactgtcccctgtagccctggctctgtatgcaagcacgcagctctggctcccagcattaggtttatatgcgttaacaaaaaaattgaggaggaggccagagctgaggctccccgtgatacaactagtcaattaacttaaagttttacttactgtcattatgtggtgctgttagtag

SEQ ID NO: 299 - DNA, 3693 bp, Arabidopsis thaliana
gctcgatctgtgaaggtttctctgagttcttcaaaaatctcttctagagaaagacttcattagctcaattttagcaacttcctccacctccttttactcacactgtgcttcgatttcaacttcgcatttcacaatgatccccaacggagaattgagattacctgctctcaaggtccgtgaagaccgcgtgtcaccctcagctcctattccggtcaccagaaccctagtggctgatactgacgtcacttccgatgacgatatgagtacaaattccgaggatgtctctctcgattcgtctcccgagaacagtagagtgtccagtgccgttggtcgcagctacgggagaaattcttcttattatacttactccgaggtgagctcatcaagagagactttggtcggtgcgcgcgaacagacgggacctagatttgatggtgatacggaggaagatgaatccaccgattcagcttctagcacgcaattttctccgccgccggcagctgggaggattaacgacggcgtatctcaggtggaacaaactcacttccctaagacggacaggcgagcaactgtcgagaaggagtttgatgagacgttttcttctgaagaagtaagcgatattcccagtgcccctccattttccggggcagcagaggaatctgaagaaattaaaccagcaacttcaagcgttcaagtttcagaagtcaaaacaggagattgtgtagaaagtagaaagactggccactttactagacctagtgcagcttctgagtcatctgggccacctgatcaacatccagctcggcttcctacttttcatgcaagttctcgtgggccatggcatgctgtggtttcctatgatgcatgtgtacgactttgtctgcatgcgtggtcaaccggttgcatggaggctcccatgtttttggaaaatgagtgtgctcttctacgagaagcatttgggttgcagcaactccttttgcaatcagaggaagagcttctggcaaagcgatcttcacaagctccgcacgaaggagttgcaccaaaacccaagaaaaacattggcaaaatgaaggtgcaagtacgacgtgttaaaacagttatggatggtccaaccggctgtagtatatcatctttgaaaccatcgttgataaagtttgagaaaatccggattcacttttccaatatgtcaacacgcttattttctggatggcgggctctaaggaagatccatgtccgtgtaccagccaatggttcttctcttcctcgtcaaagtctggcatatgttcatgccagtacacagtacttaaaacaagtttctggtctcctgaaaaccggtgtcacaagtctacgtaataattcaacatcttatgatattgtacaagaaacatactcgtgtaagttaagattgaaaagcttagctgaagataacgccattatgatgcaacccggatctggtgaaagccatgttttctttcctgatagtcatggagatgatctgattgttgagatcctggatccaatggggaaggattttgggcgtgtacttgtgcaactagctaatatttctgaagattcggctgagaaacttcgctggtggtctgtttttcgtgagccagaacatcaacatgtgggaaaactccagctctatattgactattcagcaagttttgatgataacagccatttgaagtgtgcttctgttgcggaaacagtcgcatatgacctagtcctggaagtggccttgaaaatgcagcgatttcagcaaagaaacttgttgttatatggttcatggaaatggcttttggaagaatttgccacctactatgggatttcagatgtctacaccaagctcagatacttgtcctatgtaatggatgtcgctacaccgacttccgactgtctccatttggtacatgacttgttaacacctgtcatcatgaagggaaatggcaagagcgccttgagtcatcaagagaatcggatcttgaatgaaatcaaggaccagatcgagcagattctaaaactggtctttgagaattacaaatctcttgacgagtcgtcattttctggaatgattgatgtggtcaattctgcgtcaggtgttccagcgccagcactcattcctgctgtgaaattgtacacgcttctgcacgatgtcttatcacccgaggatcagactcatctttgtcattatttccaggcagcagcaaagaagagatctagaaggcacatgggtgagacagatgagtttgttgcaaacaacagcgagcccaatttttgggatatgtctgcaatgtcggctgcataccagaaaatgacaatggcctgcaagaatgtaaagaatgagatctatactgatattgagatccaaaatgaagatatacttcccagctttcttgaccttccaaacctgtcagcgtctatatatagcactgatctctgtaatagacttcgagcatttctcgttgcttgtccgccctctggcccttcaccaacagttgcagagctcgtgattgcaactgcagactttcaacgtgatctttccagctggaacattagtcctatccaaggcggtgttgatgcaaaagagttgtttcatctatatatcatgatttggattcaagataaacgcctttcattacttgagtcctgcaaacttgataaggtaaaatggtctggagtcaggacacagcattcaacaactccattcgttgatgaaatgtacaagaggctgaacgaaaccattcaagactatcaagttatcatttccagatggccagaatatatctttgttctggagagtgccattgctgatgttgaaaaggcaacagtggaagctctggagaagcagtatgcagatgtcttatcacctctcaaagaaaacttggctccaaaaaaactaagcttcaagtatgtccaaaaactgaccaaaagatctgtgattccatatgtagtcccggatgagctgggcattctattaaactccatgaagaggatgcttgatgttctacggcctaatatagaggctaaatttaaagcatggtcttcatgcattcctgatggtgggaatgcagctcctggtgatcgtctttctgaggtgacagtgatgctcagagccaagtttcgtagttaccttcaggctgtggtcgaaaaacttgtagaaaatagcaagctacaaaaaacgacaatgttgaagaagattcttcaggactctaaagaaagtgttggagaatcagacatcagaagcaaaatgaataacctcaaggagcagctcaccaacacagtgaatcatctacactcggtttgtgagacgcatgtcttcatcgcattgtctagaggatattgggatcgtatgggacagattgttttaagctttttggagaacaggaaagagaacagagcttggtacaagggttctagagttgctgtctcgatattagacgatacatttgcagcacagatgcaacagctgcttggcaactcgctaagagagcaagacctggagcctccgagatcgatcatggaggtccggtcgattctttgcaaggaccctgcagataataaagccaaatcgttctactactgagcaccttaacagctaaaaatgcttgaaagatttcagatctcatttgttcgtctgcttgaagcttcaagtattttacttggtggagcaaatcgtggaaaccttgagaa

SEQ ID NO: 300 - DNA, 1862 bp, Arabidopsis thaliana
gattagctcaagcctcaaggtgaagcttgaagcccatcaatggcggatgggtagcttctggtctccttgaagatgaatcggatttcagctatttctactcttgtcactcctctccctcttcttccgtcgtgctcctttgttccgacacgacggtgttatcctcgcagagctactccttattccaggcgaatcaatctcaagcctctcacttctcgcattgttctcctcacgcgccgtcgtcagcttggtcagatcgtggaggaggtagaagccgctaagaaacggtatgggaggctcaacacaattgtgatgaactcagttctcgaagcttgcgttcactgtggaaatattgatttggctcttcggatgttccatgagatggcggaacctggtggaattggagtcgactctattagttacgctactatcttgaagggattgggtaaggctcggaggattgatgaagcgttccaaatgctggagactatagagtatggaactgctgctgggactcccaaattgtcatcatctcttatctatggtctgcttgacgctcttatcaatgctggagatttacgtcgtgccaatggtctgcttgcacgatatgatattttgcttctagatcatggtactccgtcagttcttatctataacttgctgatgaagggctatgtcaactcagaatctccgcaagctgcaataaatttgctggatgaaatgttacgccttagattggagccagataggttgacctacaatactttgatccatgcctgcattaagtgtggcgacttggatgcggctatgaagtttttcaatgatatgaaggagaaagcagaggaatattacgacgattttcttcagccagatgttgtaacctacaccactttggtgaaggggtttggggatgcaacggatctgttatcactgcaggaaatttttttggaaatgaaattgtgtgagaacgtgttcattgaccgaactgcatttacagcagtagttgatgccatgctgaagtgtggttcaacaagcggggccctttgtgtatttggtgagatattgaagagaagtggagctaatgaagtcttgcgaccaaagcctcacttgtacctgtctatgatgcgtgcgtttgctgtccaaggggattatggaatggttagaaatctgtatcttcgcttatggccggattcttcaggatcaatctccaaggcggttcaacaagaagctgataatctcctgatggaagcagctctcaatgatggccagctcgatgaggccctagggattcttttaagtatcgtgagaaggtggaagacaataccttggacgactagtggaggcatggctgctgtccgcctagaaacattgttggggttttccaagtctatattgcgtccacatctacttagtaaggtgataccaagtgaaccaatagaaagcattatgattcgatttgaagccactcggccactgctaggcactctgcagttgaagaatgtggccatgcggtttttcaaggagcaagttgtaccaattgtagacgacaggggaagctgcataggccttttgcatcgggaggattgcaataaccttgatgcgccattggtctcaatgatgagaagcccgcccacatgtgtgagtacaacaacatcgattggtcgtgtggtagatctagttttggaaaagaagcttaagatggttatagttgttcactgcgggaattttagtgggagcggttatagctcaaaggcagtaggagcttttacaagagcacaattgtatcggctatttgaatcagaacaaaagctgctttagtgaatgtaagtaatattttatcgcttcttatatgatttagttctttc

SEQ ID NO: 301 - DNA, 3666 bp, Arabidopsis thaliana
aaagtcgacggactagctcaaattctcctgtgtctcttatatggtatggctcaaggcagggagcgaattcctgagcgatggacctatgatgtgtttgtaagtttccgtggagcagatgtgcggaagaactttctgagccatctttacgattctctcagaagatgtggtataagcacattcatggatgatgtggaattgcaaagaggagaatatatttccccggagctactgaatgccattgaaacctcgaaaattctcattgttgttttaacaaaggactacgcatcatcggcttggtgtcttgatgaacttgttcacattatgaaaagccacaaaaataatccctctcacatggtttttccaattttcttgtacgtggacccatcagacatacgctggcagcaagggtcatatgctaaatcattttctaaacacaaaaacagtcacccattaaacaagctaaaggattggagggaagctttaacaaaagtagcaaatatatctgggtgggacatcaaaaatcggaatgaagcagaatgtattgcagatatcactagagagattctcaaaagactgccctgccagtacctgcatgtaccgtcatatgctgtaggtctgagatcacgcctacaacacatttcttcactactgagcataggttcggatggagtccgggttatagtgatctatggaatgggtgggatcggtaaaacaacattagcgaaagtggcgtttaacgaattctcacatctttttgaaggatcaagtttcctagaaaattttagggaatattccaagaagccagagggaagaactcatctgcagcatcaacttctctctgacattttaaggaggaatgacatagagttcaaaggccttgatcatgcggtaaaagaaagatttcgcagtaaacgtgtacttcttgtagttgatgatgttgatgacgtacaccagcttaattcagcagctatagatcgagattgctttggccatggaagtaggataataattaccacaagaaatatgcatttgttaaagcaactaagagcggaaggaagctattcaccaaaggaacttgatggtgatgaatctcttgaacttttcagttggcatgcatttagaacaagtgaaccaccgaaagagtttcttcagcactcggaagaagtagttacatactgtgcaggactacccttggctgtggaagtcttgggtgcttttctcatcgagagaagcattcgtgagtgggaaagcacgttaaaattgttgaaacgaatccctaatgataacattcaagcgaaacttcagataagttttaatgcgctaactatcgaacagaaagatgtattcttggacattgcttgttttttcattggggtggatagttactatgttgcctgcatattggacggatgcaacttataccctgacatagtactcagtctgctgatggaaaggtgtctcattactatttctggtaacaatataatgatgcatgatttattacgagacatgggaagacaaattgtccgagaaatatctcccaagaaatgtggagaacgtagcagactgtggagtcataatgatgtcgtcggtgtactgaaaaagaaatcaggtacaaatgcaatagaaggacttagcctgaaagccgacgttatggatttccagtacttcgaggttgaagcatttgcaaagatgcaggagctgagattgttagaacttagatatgtagatctcaatggaagctatgagcatttcccaaaagatctacgatggttgtgttggcatgggttttctttagaatgttttcctataaacttaagcttggaaagtttagccgctttggacttgcagtacagcaaccttaaacgattttggaaagctcaatcgcctcctcaaccagcaaatatggtgaaatacctcgatctcagtcattctgtctacctcagagagactccagatttctcttacttcccaaacgtcgagaagcttatactgatcaattgcaaaagcttggttttggttcacaagtcaattgggattcttgacaaaaagctggtactattaaatctaagcagttgcatcgagcttgacgttctccctgaggaaatctataagttgaagtcacttgaatctctctttctctcaaactgctcaaaacttgagagactggatgatgctttaggggaattggaatccttgacaactcttcttgcagattttacagctctaagggaaatcccctctacgatcaatcagctgaagaaactgaaaaggttatctcttaacggctgcaaaggtttattgagtgatgatatcgacaatctatattctgaaaagagccattctgtttctctattgcgtccagtctcattaagtggtttaacctacatgagaattttatctctaggttactgcaatctatctgatgaactgatcccggaagatattgggagtttatctttcctccgggatcttgatttacgaggcaacagtttttgcaatttgccaacagatttcgctactctaccgaatctcggtgaactcctattgagtgactgctcaaaacttcaatccatccttagtttacctagaagcttattatttttggacgtaggaaaatgcatcatgttgaaaagaactccagatatttctaaatgctcggcattgtttaaattgcaactcaacgactgcatcagcctttttgagatcccagggatccataatcatgaatacctgagtttcatcgtcttggatgggtgcaaactcgcatctactgatactactattaacaccatgcttgagaattggcttaagaggaaccatgaatgcatatatatcccagtcgatcgtccaaacgtcattccaaactgggtttactttgaggaggagaagcgttcattctctattacagttcctgaaactgataactctgataccgtggtagggttcaccttatggatgaacttcgtgtgtccaatgggatacagctccatatacccccgggctatcatagtgaggaatcttaccagaggcagtgcatggatacatagccttaagaattcgaaaattcggattcagatgaatgccaaccttttgaccaacgattttcacatagtaacaggtgacgaaatagaagttgatgttgattgcgatgatagattcacgattctagcaacaggaattgctctttgttacaaagcaagagactcctcagattttagctttggtgatattaagtttacatacgaagaagatgatcttggctatgctagtaatggtatatatttagattgtcatcgatcaaagtatggacatgattcattacaggcagttgtacattggaaaattagttatccgatggatggggaaacgtcaaacctattcgcttgtagctttttcccgggaatctccaggtaccaagaaaataatcaaccagttgtagacgtggaggaaagcaatcacagacctcgcaggaaaatgagaatgagtctatggaaaattttgggagcaatcggcttcttgacacttgttgtggttcttgaagtatactttgaactcttgagctccatttttgccaattcgacaactgattacattatgttacccacttgattttgtggaactcaagttggtttctttctcggcttatatggttaggtcgacttt

SEQ ID NO: 302 - DNA, 772 bp, Arabidopsis thaliana
tcctgccgaaaagagagagagaaaacaaaacaaaaaatggctacccgaaaagctctgatcaacgttcaccggatcattcgctccaccgccgtggttggccggagctctatcattcctgccgccgctaaccggtcatatcctattatattccggaatggagttgatttgggggcgagattcttctgtgagaacactgcgtctgcccagaatttcgatattgatctctctaacgaagagaataagagaagaacgatcaacagattgttgtataggagcaagcaaagagggtttttggaacttgatcttgttttggggaattgggttgaggagaatgttaattccatggacgaaaatggtgttaaatccctaattcatgtcctcaatttggaaaaccctgatctctggaaatggctaactgaacaggaacagcctccggaagcagtgagttcaaatccggtgttctcggcgttacacgagaaagtcatgaagaatctgaacaagcatgcagcgccagagactcgtgcagcggctggacagccctgggtcagaggatgggacgatttcaagagaggccgtgatgctcccatttcagggaatcagtaaacataaactcctcttttcaaaaagtatcaaagtgaaaataagttatgatatgaaaatagataccaagtagtagcaaccattactttactattgtattaataaagaaccaggccgtgaagaaggtccatggcgttgagataattacagtgttgtgtcttgtttgttgaag

SEQ ID NO: 303 - DNA, 1083 bp, Arabidopsis thaliana
cgagcttctccctcctaaacaaaaaaaactctctctgtgctacctataatgaaccgcttctctcgtgctcgttcatacatttccttggtgctgtttaggaagtccagctatgtcacttcccacattccatggaatcagtgcttctatacatctttaaaatctagtttaaagcctgcaagtgtgagtgtatctagtgttcattgctattcctcaagatcaaagactgctaaatcaaagatgtcaaaaagctctgtttctgtttcggattcggataaagagaaagacgccttttttgttgttcgaaagggtgacattgttggaatttataaggatttgatcgattgtcaagctcaagttggatcttcggtttatgatcctccagttagcgtttataagggatactcgttgctcaaagacaccgaggagtgtctttctactgttggtttgaagaaaccactctatgtttttagagctttagacttaaaagaagatatgtttggagctcttacaccttgtctcttccaggatcaacttccttcagcttccatgtcagttgaaaagcttgctgagctagagccatctgctgatacctcatatgaaacttgcattattgagtttgacggtgcatcaaaaggaaatcccggtctctctggcgctgcagctgtactgaaaactgaggacggaagcttgatttttaaaatgcgtcaaggtttaggaattgccacaaataatgcagctgaatatcatggattaatcctaggattgaagcatgctatcgagaaaggttacacgaaaattaaagtgaaaactgactccaagctagtttgtatgcagatgaaaggtcaatggaaggtaaaccacgaggtactctcgaagctccacaaggaagcaaaacaacttagcgacaaatgtctctcttttgagatcagtcatgtacttaggagtttaaactctgatgcggatgaacaggcaaacatggctgctcgtctttctgaaggagaagttgaagtggcttaaaggatattatcggtgaactagatttggtcttttttgttgttgtccaggctacatccaaatctgaat

SEQ ID NO: 304 - DNA, 1008 bp, Brassica napus
tggaatgtgttaaagagtcttgcagaaactccacttggatctctcttacttactccattattttcctcttctctcccatctcattaaaataggaacagaaatggagagctctacgtctttagccatcgttcttcatcagtcttccaatcatgacgaactcttcatgcagcagactcttcaattctcacaaactctcaaggatttaaagaacttggggaaacagttatactcagctgctgagtacttcgaaacatcttatggcaaagaagaacacaaagaaacggtgatagagacgttgaaagaatatgcagccaaggcattagtgaacacagtggatcatcttggttctgtctctgataaattcaactcttttctctctgataactctgcccatttctccaccactcgtcttcgtttatcttctctcgaacaaaggatgaaactatgtagagagtacatgggaaagagcgggagttctcagcatcgctttcaagttcaatctcctcaccatcataagcgttatttcttccctcaacatggaagaggcacaagtttcgctgcaggagatgactcacatcggttcaagagtgctgttcgatcaacaatactagaaaaccacccaaataatgcaaggaaaaccaacaagacaggaagcttctccttcttacacaacaacatcagcaacataacaccaagtaaaataacaaagtctcctatgagatttcctctcatacgttcaggatctctactgaaacgttcaagctccccaagccagccaagactactggccttaccggaaccacaaagagcgatatctatgtcgacaagtagagagatagtggaaatacagcaaaaatcttcattgagaaaggggaagaagagtctgatgctcaaggcattgatgagtatgagcagtaagtccagaaactaaataaatcttgtattcttacgttaatatgtacaaaattaatatgtgaaatatgaagagagaagaaataatgctcaccc

SEQ ID NO: 305 - DNA, 1330 bp, Medicago truncatula
ccaaattattcttcacgactcttcaacttctcttcccttctcaccggaaaatctccgcgactgcgacggcgacggcggaaattatattcctcattcggcggcgctttttgtacatagtattatagtatgggcaaaaattggtggtgcttgatttttgttacctggttatgtctttttgatttttcagatggtagagaactcaagaccaggcatacgagtcatcttgcgcagtataatcatacacttgctaccatattagtggaatatgcttctgcggtatacttgtcagatttgactcaactttttacttggacgtgctctagatgtggcgacttgaccaagggatttgaaattatggagttggttgttgatgtcgagcattgcttacaggcatttgttggagtagccgatgatccgcgtgctattatcattgcattcagaggaactaatgaacacagtttacagaactggattgaagatttatattggaaacagcatgaaataaattatccagatatggacgatgcaatggtacatcgtgggttttatactgcataccataatacaacaatacgtcctgcagttttaggggctgttgaaagagcgaagaagttttatggagatattccaattatagcgttaggacattctatgggcggagcaatggctgcgttttgtggacttgatttaacggtaaataaacaagaaaaaaatgtccaggttatgacatttggacaacctcgtattgggaatggtgtttttgtatctctctacagcaaactaattccaaatacaatccgagttacaaatgaccatgatattgttccccatttgcctccatactattactatttaccacagaagacataccagcactttccgagagaggtatggctttataacattggattaggtagtcttgtgtacagggttgagaagatttgtgatggatccggtgaggatccatcttgcagcaggtcagtgagtgggaatagcatcaccgaccacttagtctattatggtgttgacatgggatcagatgatccacaaacatgcagaatcgttatgaattctgacgttccgagtactagcagcatcagagattcaagaggaaacttcatcttatctagagatcctacaagttcccttctcaaattgagtagagagtttgacaatcaggaaaaggccgttagcgtctattgaattggcatgagatatctcttgcaacataatcgtgggatgttatacttattcttttctttcttcacagtcctttcaaatgcggccgaagaattttatcagaattagctgtaactggaagaagattgtg

SEQ ID NO: 306 - DNA, 870 bp, Medicago truncatula
cgataacagaagaagaccagatcgtgaacgatgacggtggtgaggggcagtgtttttcaattaggaagacgattacgactaggaatcttaaattccctcaaaccagagactaatcacaataatctaaatacaaattgttctcgctgcctgggaacaagcacaacgccgtcgtttcaacctcgcaaccacaatgcctttttctcttcctccgcctcaccatttccttctccattttccaccggacaaaggaggactatgtttatccaaacacagtccactccaaatccagagtctcttatgtttcatcctggtaaacctgtcatggatgttggtagcgctgatttcccgaaccctcgttctgccatgaattctcctctcgctaaatcaattttcactattgatggaattactcgtgttttctttggatccgattttgtcactgttaccaaatcagaagatgcatcgtgggaatttctcaagcctgaaatctttgctgctattatggatttctattcttctggtgaaccgctgtttctagactctcaagcagcctcatccaaagacacagcaattcacgatgatgattctgaaacagttgcgatgatcaaggaacttttggagactcgtattcgaccaactgtacaagatgatggcggggacattgtatattgtggttttgatccagatacggggatcgtcaaacttaaaatgcaaggagcgtgtagtggctgcccaagttcttcagtgactctgaagtcaggcattgagaatatgctgatgcattatgtacctgaggtcaaaggtgtggaacaagaattggatggcgaggaagaggaagcagctttaagtggacaaactgagtagttgtag

SEQ ID NO: 307 - DNA, 5399 bp, Medicago truncatula
tgtcaccgacctttctctcttcctaaatcatcatcatcatcatcatcatcgtgaatcaattttcgtcgttgcgcgcgttcatcgattgttccttttcgaattttcaatttcaattttacactctcaatttctaccgtagtcgtttcgattttagggtctgaagtcgtagctgatttttttaagttatgtgaagaattgagatgaaactgaatcaagcaggttctcagttacctggactagcccaactcaatgggaacggacagatgccatctttaggcggtgtttcacgatcagcacttaatatggaccctgaatttcttagagcacgcgaatttattcaagagaagatctgtgagacgttatttcgacggcatcaacagccaattagtgaaatgcaaaaaaggaggattaaggatcttgcaaaacgcctggaggagggcatgttaaaatatgctgattctaaggaggagtacatgaacttggaaacactagagagtcgtttatctcttttcctccgacaagcaactatgaataatcgcagccaacagtatccccagcttgttagctcatctcctattggtacaatgattccaacccctggtatgtcgcatggtccaaattcaaacatggttgttgcatcttctatagatgcctcaatgatttcttccagtggcggtaatagcgtagtatcaacaactttcaatggtgtaaatatattaccaactggtggcatacatggaagctccttaaatagatctgatggtttatcaaatggatatcagcagtcttctaccagcttttctgctggctcagtggggaacatgtcatcaatgagtgtgccgagaccttcaagccagatgattcctacgccgggatatacagtcaacagcaatcactcacatatgaatgtagattcatctactaatggtaacgtcttctccagtgcagagtctactatggtaccactgtcacagcttcaacagcagaaacagcatgttagtcaccaaagccaggtattgccgaacattggcagccaaatgagtagtggaatgagatctggtttgctacataaacagtttacaaactcaaatggtgctgtgaatagtgggctaggcttgattggtaacaatattcaactcgcaaatgaaccagtcacctccgatggctatgcttcaagttatgctaattcccctaaacacatacatcagcactttgatcaaaatcagaaaccagtaatgcagggtgatggatacggattgaataatgttgacccttttgcttctggaaacttttattcatctgcaacatcttctgggtctatgatgaacactcggaacacaaattcagtacaattgccatcaatacccaaaactagctcgttgatcagcggtcactcaaatttgcatggtatgcagcagtctgctcacataaagtctgaagcaatcaaccaattggaaaagttgaattttcagtcttcatcaacttcaagagacgcccttctgcattctcaacagcagtatcagcaaaggccccatcaatttcaacagtcagagcagtatcctcaatcacagcaacaatttcaattgaaactacatagtcaacagcctcagcatttggtcaatgataatgctttcaatcagtctcagttgtcttccaatctagaaaaccaagtgaagtcagagcctggaattgagcatcataaagacgtgctcagttctcatgttcctgaacagttccacatgtctgagatacagaatcagttccagcagaactcatctgaagattgctctagagctcaatacctttcctttccatctggtcagcataatttatcctcatcagtacctcaaagttcgcaacaaatgttgcatccacaccaattggttgcagaatctcaaaataagttcagctgtcttacagttggggctcaatccaattccaaacaatggactgactcacaagatggtaacccaatgtctaacaatagttcacacgaccatcatctccatgtggattttcatcaaagaatatcagggaaggatgaagctcattgcaataatttatcatcagatgtatctatgggccaagccgttgctcctaggggcgcatctgagccgctagacccaggaagtactaccaaaaatgcacacaggaatcaacaacggtggcttttatttctacttcatgctcgacgatgttctgctcctgaaggacgatgccaagaacgcttttgttcttttgcacagaagctatgtaggcacatggatggatgcaccctgcgccattgtccgtaccctcgttgtcatcatactaaggaattgtttcatcattttatacactgcaaggatccatgctgccctgtttgtgtttttgtaaaaaaatgccggcgggcatgtcaacttaaggctcagattcagccaccatctgaatcgagtttgccaagtgtggtaaatggatcctgtaaatcttacaatattacagccacgtcatcaagattgatctcaaaacccacattagttgtggaaacatcagaagacctgcacccatctgtaaaacgcataaaaattgagcattccactcagtctgttaatcttgaaaaggacaactctgcttcatctgtttctgcaaattgtgattctctagtttccaaggacgctcagtcccaaacatatcccaatgcagagaagtctatctcaattaaatctgagattaccgaagtaaaagcagaagttttggctcatgccaagcttagtgaaatgaagatggattcgagtaatgcagatgataaaattcctgatggtgagccggtgaagaatgatgatcctggtaatttagctaggccagaaaatatgaaaaccgagaaagaagttggacaagataagcaagaacatgtgatgcagccaggtgaaaatgcagctggaacaaagtctggtaagccaaaaataaaaggggtctctttaaccgaattatttactccagagcaagtcagggaacatattactggtctcaggcaatgggttggccaaagcaaatcaaaggcagagaagaatcaagcaatggagcactctatgagtgagaattcctgtcaattatgtgctgtggagaagcttacatttgaaccaccacctatttattgcacgacatgtggggttcgcatcaaacgtaacaatatgtactataccatgggtactggtgatactcggcattatttttgcatcccatgctataatgatgctcgttctgaacacattgttgttgacgggactcccattgccaagtcaagattggaaaagaagaagaatgatgaggaaactgaggaatggtgggttcaatgtgataaatgtgaagcttggcaacaccaaatatgtgccttgtttaatggaagaagaaatgatggtggacaagctgaatacacttgccctaactgctacattgaagaggtagaacgaggagagcgcatgccattaccccaaagtgctgttcttggagccaaggatttaccgagaactattcttagtgaccatatagaacaacgattatttaagcggctaaagcacgaaagacaagagagagcaagatttcatgggaaaagctatgacgaggttcctggagctgattcccttgtcgtaagagttgtatcatctgttgacaagaagttagaagtgaaacagcgctttttggagatttttcaggaagaaaattacccaacagaattcccatataaatcaaaggtagttttgttatttcaaaagattgaaggtgtggaagtatgcctatttggcatgtatgttcaagaatttggagctgaaagtcaatttcccaatcagcgccgggtgtatctttcatatttggactctgtgaagtatttcaggcccgagattaaatcagtaactggagaggctcttcgaacatttgtttaccatgaaattctgattgggtaccttgaatattgtaagctccgtggttttaccagctgctatatatgggcttgtcctccgctgaagggtgaagattatattttgtattgccatccagaaattcagaaaacaccaaaatctgataagcttcgtgaatggtatctagccatgttaaaaaaagctgcgaaggagaatgttgtggtcaatatcaccaacttatatgatcatttcttcacatccaccggtgaatgtagggctaaggttacagctgcaagactcccatattttgatggtgactactggcctggggctgcagaagatttgatttatcagctacgccaagaggaagatggaagaaaacaaaataaaaaaggaacaaccaaaaaaactatcacaaaaagggctttaaaagcatctggtcattcagatctttcaggaaatgcatcaaaagatctgctcctcatgcacaaacttggtgaaaccatttccccaatgaaggaagattttattatggttcatttgcagcatgcatgtacccactgctgcattctaatggtgtgtggcaaccgctgggtttgtaatcagtgccagaactttgagatttgtgataagtgttatgaagcagagctaaaacgtgaagagagagaaagacatcctattaatcagagggaaaaacacagtctttatccggttgaaattactgatgtaccatctgatacaaaggataaagatgatattcttgagagtgaattctttgacactagacaggcatttctgagtctctgccagggaaatcattaccagtatgatacactaaggcgggccaagcattcctcaatgatggtcctatatcatcttcataatccaactgctcctgcatttgtgaccacttgtaatatatgctatcttgacatagaaactggtcaaggttggcgttgtgaagtttgccctgagtacgacgtatgcaattcttgttatcagaagggaggcattgatcatcctcataagttgacaaatcatccgtcagtggcggatcgtgatgctcagaacaaagaagcaagacaagttcgagtattgcagctaaggaaaatgcttgatcttctagtgcatgcatcccaatgtcgttctccacattgccaatatcctaattgtcgcaaagtgaagggcctcttccgccatggtatgcactgcaaaacacgtgcttctggaggctgtgttctttgcaagaaaatgtggtatttgcttcaacttcatgctcgtgcgtgcaaagaatccgaatgccatgtgccacgatgcagagatttaaaagaacatctgaggaggctgcagcaacagtctgattcacgacgtagagctgctgtaatggaaatgatgaggcaaagagctgcagaagttgctaacaatgctggatgagcaatttgtacatgtaaatacggggcgcttcaaagaaatgttctacacatctagacacctatgctccaa

SEQ ID NO: 308 - DNA, 963 bp, Solanum lycopersicum
ttctcgtcaggtaaagctcaagtaagagacaaattatagtagcattcaccatgtttcgtcgcaagaaccactctaatagtgaacaggggggtgaggaccagcagcacaaggttaaggagcttagggcttccctggggcaactctcaggccgcagtgcacagttctgcactgatgcatgtttaaaaaggtttttggaggcacggaattggaatgtagataaagcaaagaagatgttggaggagacgcttaaatggagattatcgtttaaacctgaagaaattcgctggaatgaagtagcgaaagaaggtgagactgggaaggtgtttaaagcaaattttcatgaccgccatggcaggacagtcctaatattacggccaggaatgcagaacacggcagcactagacaaccagatgaagcatttggtgtatctaatcgagaatgccatttttaatctgccagaaggtcaagaacagatggcctggttaattgacttcactggatggtctataaccaataatgttcctgtaaaatctgctcgcgagaccatcaatattttgcaaaaccactaccctgagagactcgctgcagcacttctgtacaatccaccgcgactttttgaaacattttggaggattgtcaaatactttatggatcccaaaacatttcaaaaggtcaagtttgtgtatccaaagaataaggatagcgcggaactgatgaagtcgtacttcgacgttgacaatcttcctactgagtttggaggaacagctacactgaaatatgatcacgaggagttctcaaggcaaatggctcaagatgatgtgaaggccgccaagttttggggttcggacaaacatccccctggtcctggtggtaatggtaattactctgcagtagaagttgctccagaaccttaatcacttactctataagccactgcctgagcttaaatgattgcaacactga

SEQ ID NO: 309 - DNA, 961 bp, Solanum lycopersicum
cacattcttctagagagatctgaccctttagaacaaaatggagcatgaagacagctacaagggagtttcggagccaaaatatgagtgccttctgtttgatgttgatgatacactttatccacttagctctggtatttctgcacaatgcacgaaaaatatcattgattatatgattgaaaagcttggcattgatgagactaaagttccagaaatgtgtataagcttatataaggagtacggaacaaccatggctggtctcagggccattggttacgactttgattatgatgactatcatagttttgtacatgggagattaccttatgaacttttaaagcatgaccatgttctgaggaatcttttgcatagcttgcctgttcggaaagttatattttcaaatgcaaatgaagcccatgtggcaaaagttcttagcaggctcggattagaggactgctttgatgatatcgtatgctttgagactgtgaatcctaccaacaacggcagtgcacaagacagcaacaatggtgtatcccctaggtctcttattgtttgcaaaccgttcaaagaagcctatgaacaagcctttaaaatagccaacattaaccctcagaagacgctgttctttgatgactcggtccgtaaccttcagactgctaagctcacaggccttcatactgtgtgggtgggtgcctcccatagaacagaaggcatagattatgcactagaaagcattcataacatgaaggaagcactaccggagttatgggaagatgttaaaccagacattcgctactcggaaaagactgcaattgaagtgagagcttagttgtgtaatttcacaataaagacaaccgtatagttgtagttatttaatctattgctttctctttttcttttctagtttcctcttttgcctgttaacctgaataacagttgttacattgatttcacaatccctaac

SEQ ID NO: 310 - DNA, 1655 bp, Solanum lycopersicum
ggatagctaaaaatggtgagaaataggagagaagaattatacgttaccgttcccccacttttccgatgtccgatatccatggacgtaatgaagtctccgataagtctctgcaccggcgtcacttacgatcggaattccattcaaacttggctttcacaaggtcataatacttgtcccgctactatgcaaatccttccgtctacggatttcacacctaacctcactctccggaggcttatcaacgtctggatacagcatcagccggcgagttcaccgggatctacaacgccgtcttcatcctctgttacaaaaacggaagttgttgaaattgttgaaaatctcaacggcgaggtcgataggttgagttccttggcgaagattggggaatttgttaaatgttctggtgaaaacaggagtttttttgtgaatttgagtgatgcgattgcgaatattgttggagttttggtggattgtgatgtggttgaggtttgtgaagcggttgttgcggttttggatttagttgtatcggagaatggagttaaggagcagttgaacaaagagattttgaagagctatcagaaatttctaccgaagtttcttttggttcttcgtaaaggaaagttgagttcgaggattcaaaccgctcggattctagaattcatcgcattagacgccgattcacagcgaaaaatggtcgaggagcaaggtttactctacgaattgcacgtattcactagcacggagacgaaccgattcgcgatcgaagtcggtttatcaactctaatcgcggtctcaaccaccagactggcgaagaaagagctagtccggttcggaattatacaaactatcggaaaaatccttagcaattcggaaaccgctcgggcggtggtagagaagtcattgaagctgttggaaacagtagcgacgtgtgcagaaggcaggacggcgataggtaaaggcgaagagtgcttgtcggcgatagttacaaggctgatgaagagctcgaaagcagcgacggagcacggggtgacagtactatggagcgtgtgttgtttgtttcgtcatacggcggcgcgtgaggtagtgggaaaggcaaatgggctaacaaaagtgttgctggtaatgcagagtgattgctccgcggcggtacggcagatgtgtggggaattagtgaaagcattgcgcgtggtgaatactttctcagtccggacggaggaagtaataaagataaagaattattcaaagtcgtgtttggcgagttatgatacccaaactactcacattatgccctactgaaaaatataataaatacccctcttaattggtgctgactaaccatccataccaaaagaatcaaacactatttttcttttttttgtcttttaataattattagtccatttgtttgtttatagaaatggaattaggtaagattcatgctgtaaatccaaaggaattctgctaatgatacaaatgacatcaaactgttagctaaacagtacatcataagatcgtgatatttctttcattaatatcattgttattggttttatagtgttgtcatgattgatcagtgttggttgtattaggtatttttattagtttacggatgatatgatgtgtttattatccattgacgtgtaaaaccatatgca

SEQ ID NO: 311 - DNA, 1295 bp, Solanum lycopersicum
aaaggatccgcgtttatacaatttgggtttgctatttcttgaattttttttcttaaagttgtgatttttatttggaatctttggatatgagtttagggggagaaaagaaaaatgtggttgtgattgggggtggagttgctggttctgttgtagcaaaaacccttcaaaatgaggtcaatgtttccctcattgatgagaaagagtattatgagataacatgggcaagcttaaggtgtatggttgaacctgaatttgcaaaaagatccgtcatttctcacgctgaatacctccctcatgcgaaaatcattccgtcagctgcagttgacatcacagacacttatgtattgaccaaacaaggcagccgaattgcatatgactatcttgtagttgccactggtcatacacaaagcggttttgagacgagaacggagaagatcagtcagtaccaagcagagtatgaaaagataaaggctgctgattccatattgatagtcggaggagggccaacaggtgtggagttggctgctgaaattgttgcagattttcctgctaagaaggtgacattggtgcatagaggatcaagattattggaatttattggagaaagcgccagcaaaaaggcgctgaattggcttacttcaaagaaagttgaagtcatattggagcaatcagtccttgttaactctcaatcagatggtgtttatagaacatctggtggagaaactatagttgctgattgttattttctttgcaccggtacactatttggttcagtatggttaaaacaaactatcttgaaggatagtttggacagtcgtggaaaggtaatggttgattcaaatttgaggatcaaggctcgcaaaaatatctttgctattggggacatcactgatgttccggaacttaaacaaggatatttggctcaagaacacgcaaaggtagtagccaagaacatcacgtcgttaataaagggagtggaagatgatcacaaattggctgtatataaaccagcaaccaaggcattggctatagtttctctagggagaaaagatgcagtggctcaatttccttgtttgtcaatcgctggacgcattccaggcatgataaaatctggggatctatttgttggaaagacgcgcaaaggacttggtctacagcccagcgtttagttgtcctgcttataatgcatgttagagaagttaacatctacgtacattgtaccattccattactccatttgtgggattgcacggtgtatgttgctgttggtggttatttgtggacatctcgagttt

SEQ ID NO: 312 - DNA, 778 bp, Solanum lycopersicum
gagaaaatcaacatcaatggctgctctaagtgtacaagaagttctaccagcaactctggaatctacttccgaacctccgtctctctttgatggaactaccaggttgtatatcaattatcaatgcccgtattctcagcgtgtgtggattaccaggaatgttaagggtttgcaagacaagatcaacttagttccgattgatcttcagaacatgcctgattggtacaaggaaaaagtttatccccaaaataaggtgccatccctggagcacaataacaaaatgataggagagagtttggatctggttaaatatgttgatagcaacttcgagggaccatcacttttgccggatgaccctgaaaagcggaaatttgctgaagaattgatagcttatagtgatatattcgtcccagaagtatacaaatcgttcttcagagatgcacagacactggctggtgcacaattcgattacctagagaaagctcttgacaaatttgacgatggacctttcttcctcggtcaattcagtcaggttgacatagcatatgttccatttatcgaaaggttccaaattttcatggaaaaggggattaactatgacatcacatccgcgaggcctaaactagccaaattgatcgaggaaatgaacaagcttgacggttacaagcaaacaaaagtcttggatccagagaaactggttgaatactataagaatctctttctgaaaaaggcttgaaacttcaaaaatgcatttgatctagttacatgggctagtacttag

SEQ ID NO: 313 - DNA, 632 bp, Solanum lycopersicum
tgtatccaattgagggcattagcaatcaatggccctggatttcatttgcaacaagcaaatagaagaaggtaagcccatagagaagttgaaaatggttgatgatgaacatgaaggcggcaatctctctcgtggttttgagtgtaacatttgcctagatcttgcacatgatccagtggttacctactgtggtcacttgtattgttggccttgtatctacaaatggattcacttacatagcatcccttgtgaaaatccagctcaacgccacccacaatgcccggtttgcaaggctcatgtttcacaaacaaccatggttccactctatggacgcgaccaagctacaaaaacatctcaagatgatggcatggccataccagaaagacctcaacaattccatcatcggtctagtacaagcacgattggtgaaacagctcatgcagaacgcgttgatgggaactcatttgttccatatccaaacgcgcatcatctagcagggaccgctagtttgaggatgagaaggcaacaactgcaagctgatgataaatcacttcgcagagtgcatttttttctcttctgttgtgtggtgttgtgtcttatcttgttatgataacaaacttctttccctgctgtaa

SEQ ID NO: 314 - DNA, 2023 bp, Solanum lycopersicum
ttatgtgtctagccgcagttccacagagtttgggttgattagattctttatattctctgtgactgaactttccttatatttttctgggttcacgcggtaggtaatctactaattccggttattttcttggatttttctacttcaaatcttgaaagccccattgttccaagttgtggatttgattaatcagaaaaagcaacaatattttatccaagattctcttcctttaatgcagaagacgacattgacttcaacaagactattggtatcactcccaaattggactttgatggtactgaaacggaatattaatcaggatagtgatgaaaactctgagtttccacctagggaatctaagcgccaacatccttctaatgcgtttttttcagggttaaggagttactcttctccacaagaacttgcacgaaagctggaacccttaatccgaagctgggtgcgtgaagagattgagcaaacacttcaatctaccctgagatcctcacttaatgatgacgagacttctaaatctagggatattcagttactttttgacgatgtatttccttcttcccttttcacgggcagcaaattatccatggaaaataggcccattaaagttctcttgtatgatgctagttccaaccagagaataacatctggaccgttatcttcggcaaaagtagatgtggttgtgcttaatggggaatttaatcctagcaatctagaagactggagtgaggaagagttcagcaaaatggttattcgtgcaagagaaggaaaacgtccattattgactggagatttaatcattcagctaagggatggtgtgggatatctgggtgatctcagcttcactgacaattcaagctggataaagagcaggacctttaggttgggagtgaaattaaataaccgttctggtgaatttagggtcagagaaggagttagcaagccctttactgtgagagatcatcgtggggaggcttataagaagcattaccctcccactttggatgatgaaatctggcggttgaaaaagatcgccaaagatggtgcatcacacaaacggttgagtaaggaaggaatatcatgtgtgaaagagttcctacggctgtttgtcactgatccatctcttttacgtaagatgctggcttgtgggaacaacatatgggagaaaataactgaacacgtgagcacttgtccgttagacaacagcgagtggtacgtatacaacgctggagaaagtattgtacttctgttcaactgcatctatgagcttgtaggtgcaattcttgatggacaaaatttccagtccattgacaaattagatatatttcagaagcggatggtggaagactttaagcgtagtgtttataaaaatttggattgtctagctccccttgaggaccattctttgattggccaagcaatccttacatctaatctgcagaatggccttaatcatattcctagttcaagccaacagaatatgaactactcagatgaacaaggtcaagtggagttccagagcaactctgatcatgccacaatttcatcaccgctagcctacacagctcaacaggatagtccaactacagtgtccatgcctgaaagctttaatggaatacaagcatttaattcgaccttggcaagcagtttcttggttggtgaaccttgctccagtatctaccctggtgattatgattggggttccaatggttcattggattcactagggatgactgattatctacctcctaacaacaattatcagtttgagacaccagtgtggcaagggaatgaattgttagcgagttcaagtgttcagccggtgtctcctaatattggctttcacatcacaagacgtggaaatcctagagccatatggtgcacaatccgtgctgttctgaaatggaaaacattggttaagagaaaatagctatttgaagattggaaaggcttttacaagtagatatctgaagtttgttcgagatataaccagcaaacttcacctccatctctc

SEQ ID NO: 315 - DNA, 1029 bp, Solanum lycopersicum
gggtttggatctgaattgacggcaacggtggatgctatggtgccatcgtcggttgattgtaccggcgaatctgccaccggggagaatcagagatctcttccgacgccatttttgacgaaaacttatcagcttgtcgatgatcctgctatggatgagttgatctcgtggaatgaagatggaacgacatttattgtttggaaacctgcggagtttgctagggatttgcttcccaaatgttttaagcataataatttttccagttttgttcggcagcttaatacttacggatttagaaaagttgtacctgatcgatgggaattcgcaaatgactgtttccgtagaggtgagaaaggactacttcgtgacattcaacgccggaaaatttcaccggcaggtgctgcggttgttgcaccagcagtagtaacggtgaatgctgcacaagcggtgacggtagcggtagcaccagcggtcagggtggtttcttcatcgaattccggtgatgagcaggcgttctcatcgaactcatctggtgccgcagctggagcggcgatgttaaggaccactacgtgtacgacgacgccggagcttatagaggagaacgaacggttgagaaaggagaacgcacaactaaatcaggaattgaatcggttgagaagtttatgcagtaacgtatacaatctgatgtccaattacacggcgaatccggcggatataccggcaggtatactaggaggacgagctttggaattgcttcgtacggggcaagttgacggcggcggtgcggccatcacagcggcggagagcagcggcttcaaggcggatgaagatatgagcccacggttgtttggtgtatcaattggggtaaagcgcgtgaggagaagcagcgaagaagaatctgaggatcaggatcaagtacaaccgcatggatcagacatgaaatcagagccgttagattcaggaagtgctcaacatgatgatcagccatggattgatcgattagatttagggtgttgatttcccttggagtga

SEQ ID NO: 316 - DNA, 680 bp, Solanum lycopersicum
gtaaaaatgaattctttgatgatcaagttgttgttttttctcgtccttatttccaatggatattcaacaaaattagattcatatcctccaacttgtaaaaaaattgaatgcccaaattatgatgtgattgaatctggaaaagactatgaaattcgtcgttacaattcccctatgtggatgtctactgaaccaattgatgatacgtcatttgtttccgccacccgaatcggtttcaccaggttatttatgtatattcaaggaaagaacgatcagcatgagaaaatggatatgacagcaccagttatgacacaagttaagccaagtgatggaccattatgttccacctcatttgttgtgagttttaacgtaccaaagaagaatcagccaaatcctccttcagctgaaggcctacatccccaaaaatggaaccaaagtagttatgccgcggtcaggcaattcagtggatttgttacggatggtgatattccgaaacaagctgctgcccttactgccagcatcgctgacactaaatgggcagcagctatcgaaaaaagcaggagtaaagataatagtacgatttatacagttgcacaatacaactctccctttgagttcagggctagagtcaatgagatgtggtttacttttgttatggacactgcaattgacatttgagagtg

SEQ ID NO: 317 - DNA, 629 bp, Solanum lycopersicum
acctccatttctttatatagcattctcctcctaaaataaacagataaaaaagaatggcgatttttggtgatccttttagaagattcttattgagtccgacgattcatcgaagcttttctggttctccagctcttctcgattggattgaatctcctaattctcacatcttcaaaatcaatgtcccaggatatagcaaggaggatataaaggtgcaagttgaagatggaaatgtgttggtggtgaaggcggaggggcacggcggcaagaaggacgaattccacggtaaagagaaggatatagtgtggcatgtggcggagcgaggaggagggagaggtggcgatttctcgagggagatcgagctgccggaagatgtgaaggtggatcaaattaaagctcaatgtgaaaatggtgttcttaccattgttgtaccaaaagatgcaactccaaaaacatctaaagttaggaacattaatatcactagcaagctataaagtcttggttatggtataataaaattaaaagtatagttttgtgtatgttgtcacaagttgtggaattgaatggatgtaacaaagtacttgtagaataaataaggctttttcttaatccaagcttaatgcacttcctat

SEQ ID NO: 318 - DNA, 902 bp, Solanum lycopersicum
gccaatgctttcacattacacaaattaaaaaatagtcaataattataatatgaataaacatcacattcttcaggaagatcatcaaaattcttctggcagttctttagccatgagttcctcttttggaacaactactccagaaagacattcttctttttctcaagagtctgaatctgctgttgctagcactcttcatagtccatcttcttcagattactcacccacaattactccaagtcatgatgattcagctgtaattattcagaagaggaaattggggaagaaggcaaaaagttatgcatatagaattcgtgagcatgtgaaattgggttcgaagttttcagaaacggtgaaggggaaattgacgatagtgaaagaaggagggagaagaaatatattcaagcatatgtttcatgtgaatgatggagagatattgcttaaggcatcgcaatgctatttgtacacaacagcaggtccaattgctgggattttattcatatcaactcataaaattgctttctgcagtgaaagacccatctctgttccttttccctctggaggaattctcagaacaccttacaaggtggttattccagtgacgaaaattaaaagagctcttcccagtgtaaacgagaacaagccatctcaaaagtacatagaaatagtaactgaagatgattttgagttttggtttatgggttttgtacgatatgaaaaagctttcttgaatttacaaagagctatttcgatgtcaaattaaatgttttagacatgtaatgtttaggattttaaagagtcattgttagtatctaagtttttctttttaaattttttgttgaatcggcggcattttaggactggttattctttgttcttttctgtcgatgatcataatttcaact

SEQ ID NO: 319 - DNA, 802 bp, Solanum lycopersicum
tcacatcacttcactcggtacgaagttttgactattataatagtcgcgactattttaaaaagaaataagcaatttcctcgagatgaatagtgatcactttagagttcaagatgaaggagtatttctactagcttcgagtcaacctaagaaacgcgcaggaagaaagaagttcaaggaaactcgtcatccagtttataggggggtgaggagaagagataataacaagtgggtgtgcgaggtgcgtgagccgagtgagcaaaaaagaatatggctagggacttacccgactcctgaaatggcggctcgagctcatgacgtagctgcattagcacttagaggtaacctagctactttaaatttcgccgattctagttggcgtttgactgtaccgatatcaaaggatcctgaagaattacgtaaggctgccatacaagcagccgaagaattagttggagtcggttatatgaatgaggaaatcaattatattgaagaaaatattgctattggtggggccaatggaagtgacaatagtaatttggtgggtaatgaagtgaataataataataacatacaaaatatggagatgggtaacatttcatgttataataattggggtgacaataatgaaatgttggaaattgagggatcaacatggcaagagaagatgagtgaggggcatttgttttcaccaactccccattatgatagttgttttagttgggatgatgtggaaagtgatggggaagtgtctttgtggagctataacatgtaattacgttgtttagaatcgagcatgaattag

SEQ ID NO: 320 - DNA, 1039 bp, Solanum lycopersicum
cttcgatttgcctaattctcaggtcatctttccagctccacttggttgtgtagtgaatttctttccaagaaaactttttatttggagatggctgaggacggtcacaaggttatcttaaacgtctatgacttgagtcaaggtttagctcgacagttatctactacttttctgggaaaagctattgaaggaatatggcacacaggagtagtggtttatggtcatgaatattattttggaggcggtatacaacatgctccagctgggacgacaccatatgggactcctattaaagttgtagatctgggtgtcacccacataccaaaggatgtctttgaaatgtatttgcaagagataagccctcggtatactgcagagacatacagtttgcttacccacaactgcaacaatttcagcaatgagattgctcaatttttggtcggtgcaaccattccagaatatattttgaatcttcctaatgaggttacaaatagcccgatgggtgcccttataatgcctatgatacaacaactggaatcaacgttgagggctaatgcagtaccacaagcaccccagttccgaccagctactgttgctcctgcttcccagccgacactttctgttgggaagtcctctagtagcggtattaatcaatccaaaaagcccgagagccaagatggagagaagaagaatgttaatgtgccctctgcggtcaaacctgtggaagagcaggagaagacgcctgctaatgcggttgtgaaagatcctcttggtgatgctcggaacaaggtacaagaggaaatcacccgtgaatttgctgcaatcatggctactgggacattgcgtgcaagtgaggctgctgctttagcaactaaaaaagttatgcaaagatatggagatacatttgctgctatgaactaatgacaacgaagttgtctttataaattcatctgtattggaaatttaatatccaactgatttgatgtaaggtagacttattggatgcttagtaggagatgagcaaacattcttccttgaaaga

SEQ ID NO: 321 - DNA, 966 bp, Solanum lycopersicum
ccacattcattagaggatggaagagataatagaagaaaaaaagatgaagattctttgtttgcatggatttagaactagtggaaatttcttaaaaaaacaattaagcaaatgggatccttctatttttgctaattctgaaatggattttccagatggaatatttgcagcaaagggtaaatcagatattgaggggatatttccaccaccatattttgagtggttccagtataatgaggatttcacagaatatgagaacttagaagaatgcattacgtacttgtgtgagtatataacaagcaaagggccttttgatggtcttctcggattctcccagggagcaactttatcaggccttttactagggtacatggagcagggggagattctgaaagagcatccaccaatgaaattatttgtatcaatatcaggtgccaaatttagggacccaaatatttgtaacattgcatacaaagatatgatgaaggttaaatcagttcattttattggagagaaagattggctcaaacttccttcacaagaacttacaacagattttgagaatcctatcatcataaggcatcctcaaggccacactgtgccaagaatagatgaagcagctgtggagacattgaaaagttggacaagggaagttgccttatcttccaatgagagttgtgttggtggaggaccaaatgaagcctgcaaacatgttaacattgaaaatggtgtggaacaaggcaaaaaactagagaagcctaatgaagtagagatccaaaaggctcaagaataatagtcaaaagctcttctctattatattctatttttgcattacaaaagctagtttaatataaatatattatgcatgtagagacttaacctagtatgtacctatttatatctatttaattttctgatcaattctctaatatatcataactagtggtgcaatgtgttctctcgcagtta

SEQ ID NO: 322 - DNA, 1074 bp, Solanum lycopersicum
ggtaggcttggtagatgaaatcgtttttttccgttaggcagtgatggagagttttcgcctccgcttccacaatttcttatctttccatctctccatcattgctaaaattttccggtggttattctcctctttgcctaccatcaaacgctttcctctcttcgttcctttcatcgacgcttatatatccctcttattccgatttgccaacttatcaccatgcaccctcgatctagacgaccaaaccaccatccatttctgggctcccaatcaccgccgttacgataaaccaaatctcgtcctcgtccacggttacggaggcgatgccaaatggcaatttatgtaccaagtcaaatcactggctgaatccttcaacctctacattccggatctgttattcttcggtaaatcgtatacaactcggaaggaacgaacggaggagtttcaggcgaaatgcgtggtgcaagggttaaaggaattgggagtgagaaattgttccatgtttgcaattagctatgggggatttgttgggtatcgaatggcggagatgaatccgcaaatggtggagaaagtagtgatattgagtagtggagtgggttgctcgaaagatcagaaggaagagcagttgaaaaagattggaagagatccggttgaattgctcataccggagaaaccagaggatctgcatgtgctcgtaaacttatcaatttacaagtacaatcatttcaagtgggcccctgattacttcctccaagaattcattgatatgataagtaggacttacctgaaggagaagcaagagctagtgcaccacttgctgtccaatcatacagattgcagattgcccatcctaaatcaggaaactctgcttatttggggtgacaaggacagagttttccctcttatgttcggctaccagttgcaaaggcatttggggcctagagcaaagttggaaattataaaaaacacaggacatgcagcaaacattgagtctcctgattctgtcaatgctttgattaaagcctttatcttgccgcaaagcaaagacttatagggttgacactgggattgatcttg

SEQ ID NO: 323 - DNA, 1114 bp, Solanum lycopersicum
caatcgaagcttcttctgcaagatcgatttcttctagaagattctgcaacagcggagaacttgatcaatcttcatcggctccacactatcaacgaatcactgaattctctcaactttgaagatttcagaggttatggctgatgacgatttccttcagctcctcaagagaattggggcatttcttactctcaagatttctaatctctcacaaacactggattcaagatgtgcaggagctatagcaggtcttgcatttgcaatagtatttatctggaaaataatgagatcacctagtggaccacagaggaggcatcctaagcaacaagctgttacacctggtagttctggtgtaagcagtcattttagtgaaaatgtaccgtcttcagaagttagccccccttcagagaattcaaatgcacaaaatgtcattgatgagttctttcagcctgtaaagccagctctcgggcaaatagttaggcaaagattgggtgaggggaggaaggtaacatgtcggttgcttggagtaatcctggaggaaacgagcccagaggaactacagaaacaagctactgttcgatcctctgcgcttgaagtgttgctcgaaatcaccaaattttgtgatctttatctcatggagagagtacttgatgacgaaagtgaaaaaaaggtcctactggctttagaagatgctggagtgtttacatctggtggcatggtcaaagacaaggttctcttttgtagcattgagaatggacgaacatcatttgtgcgacaactggaacctgattggcacattgatacaaatccagaaattgttttccaattagcgagatttatcaaatatgagctacacgttacgcctaccaagtcagaaagaacagctataaatgtcttcagttcaacgtctttggagcagttttttggagcagcttagacgcatttggtttgttgttttaggtctcaccgtcctcttcaagtttgggctgtgagagttcatatttttaactcaattacatctttttctggtacctgcaactgcataattttgaggttcaaggaaaaacttttgtatattacgctgttgtacgcagaacgtgtcacttcatcatcatag

SEQ ID NO: 324 - DNA, 738 bp, Solanum lycopersicum
ccttatactacactttgaaattttgcaaaaaaatatgaccacaaaagagatggaagtagtgaagaatttggatgttgaaaaatacatgggaagatggtatgaaattgcctcatttccatcaagaaatcaaccaaaagatggtgtaaacacaagagccacttacactttaaaccaagatggaacagtacatgtgttaaatgaaacatggagtggtggtaaaagaggttcaattgaagggactgcctataaagctgatccaaaaagtgatgaagcaaaacttaaagtgaaattttatatcccacctttcttgccaattattcctattgttggtgattattgggttttatatattgatgatgattatcaatatgctttgattggtcagcctagtaagaaatatctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacactaaaggattttggtggatcaaatcaatattgggaaaatagtcaatcttgaatatggtttttttaaaccaatagctaaataaattttacaatataaattatgaaaagttgtcttgtaaagaagagtttattattgtttatatttcaaatgttgtaattttctaaggtgtgtccttcttgtgttggta

SEQ ID NO: 325 - DNA, 806 bp, Solanum lycopersicum
aaaggatcctcaggcactagaaatcaagaaacaagatatggcgttggatcttcattttgaagaacagatagcagagagtacctttaacaaatgtcgtggtagccccttacagaaatggaagacgcttgatgatgagcgtgatgatgacaatcgcgctagtggttttgactgtaacatatgtttggacgttgtaaaagatcccgtggttacattttgcggtcacctttattgttggccttgtatctacaagtggattcaattccagggcgcctcggatcaccaaaagccacaatgtcctgtttgcaaagctaaagtttcacaaaaggagttgattccgctctatggccctggccaagcaacaaaatcatctgcagacggcgttacaagtaaaggcatggtcataccacaaaggcctctgaggccaacatgtagtggggatatagcaactacgacaaattcacttccatcgcaacaacttaaccatcgacaacagccacattcagggagctacacggcctcaccaaccgtgattggtgaagtggtttatgcaagagtctttggaaacgcatgtccaaactcgtataaccttgaaataaacacgagtttgagaatgagaaggcagctgttacacgcggatagatcacttggaagattatatttcttcctcttctgttgtgtattggtatgccttctcttgttttgatcacttttcgcgctacattgtgtgtaatttgtacatatgtttaccttattagatgctgaatatacgagcttcgctcaatgtaacatgtcttcgactcgagttt

SEQ ID NO: 326 - DNA, 1024 bp, Solanum lycopersicum
cgcgtacacgttctacataatcatcatctataaattattataattccaataactgtgtatctcttaagacaaaattcactcaaaattcaactactcaaagcaatttacaatcaatttctcgaatcatgacaggcacaggagacgaaaatcaacccaaatttaaaaaatcagagtctcaaataccttctgtttcttcatcatcttcagatccacaagcaccagaaatggatccccaaaaatggggtacccatattatgggtccgcctgcagttccaacttgtcatccagacaatcagaaagctgcttcatggagagctgaggatcaaagagaagagtttcagccacagccttatgttgtttattccccaattgataagcctagcaataacccacttgattccgttgttaatgtgttcaattcatggagtaacagagctgagaacatagctcgcaacatttggtataatctgaaagctggaccgtcagttacagaagcggcatggggaaaacttaatttgacagctaaggcgttgacagagggtggatttgagcctctttacaagcagatttttggagcagatcctaatgaacagctgaaaaagacgtttgcttgttatctttctactgcgactgggcctgttgctggtacactctatctgtcaactactaaagttgctttttgcagcgatcggccattatcatacaaagctccatctggtcaggaggcctggagctactacaaggtagcagtaccgttgggaaatattgggactataaacccaatagtgatgaaagagtctccaccagagaggtacattcagattgttaccatcgatggtcatgatttctggttcatggggtttgtgaattttgataaagcaaaacatcatctacttgaaactttgtcaatttttagagcacaaccccctcatctcaatctgcaacaaccagcagctacttactagaagcattgcctgtactctgttttagtgtgttttttttcctgtttgttcctgcattagat

SEQ ID NO: 327 - DNA, 2362 bp, Solanum lycopersicum
gggttctactgctgtctttgtgccgttcaagtatcggtttttggctaagttctagatttttccggcgacttatcggttttgagataaagggaggatttgggatttgaatatgaaatctgatcagtgtgttgcatgtggcttgagtgctggttaaacaactcaaaaggaatgtcagatttgcagttatacgggcttgacgatatatcttgggatgagttctgccacaatgatgatcatatagtgccacatccaagtagcggacgcaccaatgaaccactcccccagaatgatagtcgtaagaagcctcgccatgaagtaattggtttaacaggtaatgcaggtgatcaatctactggtaaatatgctaatcagcaaaaggagcaagtgttgagtaatagaagccccaaaatgctggaagaggactcgtgggccgatgcacctgatggtgcattctcttctccacgtcaaaaagccatagtcggagaagtttcaagtttaccatctgaaagtaccaggacatccgatcattgcatcaaaagtaataacatagactccattgagaacgagccttgtcctaatggttgcaatcttgatgacaagaatgcttctgtgggggagaactcttatagctatccacttggtcccatatctcaggctgataatgatctcagttttcttgataatagttgtgaggataaagactctaatgatctcttatattatagctggcctgagatagagaactttgaggatgttgaccggatgttcaggagttgtgattcgacatttggatttggacctggtagtgaagatgacctaggttggctttcatcatcagatgttattgaaggatctggagatggattgacgtctggttttaagtttccatgtccagcatccaatgcgcttggaagtacatccgccagttgtgatacttcaaagccaaaggaaacaaacatttcaacggataattctggcattgagaatcaatcacttggctataatagcagttcgtggtcctccgagaaaaatgaatctgtaaatctgggtcatatgccttttttaaatggatcaagtaatttacagtgcaagttagtacctgataagaaggctgaggtacatggtggtggagtccaggtcgagattatatctaataaccaaccaagaatcaacgataatatagtggatagcatgcaaaagaaacactccaagcaccagaatcgctctgagggtaaaagaaaatgtggttatctagaaaatggagacacactcaattacactgatagccttccagaggagcagaagctgccatctgggaccggaagcactcacgtgagtttcgcatctgcaggtgtcctgcagcaaaagcaagctcaagatcctgattttggctacttgggtggtagcttctcttacatggattcagattacggtcattccgatgggagtgctctccatccaactctaccaattttaaaatatgaaagtaacggtctcgtgtctctttcccccaaggactcttatgcatcaaatcaggtacagtccatggagggttctcctgatccttcttttcaggtggctgctatgacaagaaaggagaaggtggagaagttattccatccgtcaggagttaagattgaaaataaacgtgattttgaaggggttggcataagagctcccacagaattaggatcctcagttgtacaggagtgttcttctataaattctggcttggatgaaatttcagaagaagcagctagttttcatcagcttcaacgtgtcatggaacagttggatataaggacgaagctatgtataagagatagcttgtaccggttggctcggagtgctgaacaaaggcatagacatgctaatctcaatattgtctctggagatgatggaggtaccagcggaccactggttaccgaaggaacaaacaagtgcacaggatatgtggacattgagacagacacaaatcccatagatcgatctattgctcatttgctattccacaggccttcggattctgctgttgcccctgcccgcgattcctcgactttgaagtcgccttccatgattcacgggtcgttgtctagcacaccagtgatgagtgataacgtgatctctcatggagaaattgcacctcaaacagatggagaagttgctgattgaccataactatttaagaagtcaattccagtttgtggggggaatttcacatgcagaaatgatcaaagatcatacaaggaacctttatgttttgaatgttttctctggaactggtttctggtccatgtgagaacatatccttgtatgagctttcacaatcaaattatatttgtttcactctaacccttcctca

SEQ ID NO: 328 - DNA, 782 bp, Solanum lycopersicum
aatatatgaaaatgaataatctttcactcttatttctcactcatctcacactatttttcatttgtgtttgttcacaaaatatagcacaaacacaatttgtttataaatggtcagaaacttattgtaataaggatacccctgtgggatgtaagcaaattcctcctctcaaattcactctaaaaggtttttggggcacagattccaatggaaatattcaacaaggttgtaaagatccagtagaacgtgattggaacaaagtgtttgataccgtgatggtagataaactcaacgtattttggccctctcttactaaacaagatcccaaagacatgtggaaggaagcttggaatacatatggaacatgtacaatagaaaggttcaaaactccaatacaatatttcaatagggcttcaagattggatagtgaaattggagatttattacaaagtcatttaataaactcaaatggaattgtcccttgtgactctgctacatacaacaatgttgagatcttgaactcattcaaacaagttgcaaaggataaagatgtgtatttcacttgcaaagacattaacacaactcatgcttatttgaatcaagttacattttgctacacaaatgatgcaaagaattttgtgaattgtccaacttctctcattaacaaacgttgtcgtgttcaaaacattattgttcctcgtccttcacctccaaagcctatcaaacaacaggagaaaagcttggaccaaatagcttatggagattcttggtcaattgtgtgatga

SEQ ID NO: 329 - DNA, 1612 bp, Solanum lycopersicum
aagattaccagtgtccagtgtgcgtgtgtgtaatttataatcaacaaaattagcagtggccgagttatcttttagtttttcaaaaacaagaagaggtgcagagaacagggagggaggaagaagcaatggcggagtctcagttggttcaccctcctttattcacctatatctcaatgatcactctgctcactttagtacccccttttgttattctcatgtggtatacaaatgttcatgctgatggatctgtattgcaaacatataattatctaaaggagaatggcctgcaaggactaattgacatttggccaagacccactgcaattgcgggaaaaataataatttgctatgctctatttgaggctacacttcagcttttgttgcctggtaaaagggttgaaggaccgatatctcctactggacacaggcctgtctataaggcaaatggcatggcagcatatacagtgacactaattacctatctcagcctttggtggtttggaatattcaatcctacaatcgtgtatgatcatctgggagagattctctctacactaaattttggaagcttaatcttctgtctctttttatacataaaaggtcatgttgcaccatcttccactgatcacggttcatcagggaacataatagttgactactattgggggatggagttgtatcctcgcattggcaaacactttgatatcaaggtcttcacaaactgcagatttggcatgatatcttggggactcctccctattacctactgtataaagcagtatgaagaatatggaagtctctctgattccatgcttatacataccataataacgttggtgtatgtcacgaaattcttttggtgggaagcaggttactggaacaccatggatattgctcatgacagagccggtttttacatatgctggggttgcttggtatttcttccatgtatgtacacttctcctggcatgtaccttgtcaaacatcctgtaaatcttggacctcagcttgcaatttctatcctagtagctggtattctctgcgtatacataaactatgattgtgacagacagaggcaagagttccgcagaacaaatggcaaagcccttgtctggggaaaggctccttcaaagattgtcgcctcatacactactacaactggcgaaactaaaaccagcattctcctgacatctggatggtggggcttatcgcggcatttccattatgttccagaaatactagcttcgtttttctggagtgtgccagctcttctcaaccatttcatgccctacatctatgtaatctatctgacgggcctccttttggatcgagccaaaagggatgacgaaaggtgcaagtcaaagtatggcaaatactggaaaaagtattgtgaaaaggtgccttaccgggtagtccctggaatttattagtgattcttgagcttcaactgatgaactgtctttaatagtgctgcttctagtattgtagtagtatttagaccatgaaaaattttcttctttcaataaagcacttttagttgaaccaacatctcatttctatggttgtaagttgttacacgatgaaaaaatcagcttgaaatagatatgccgtg

SEQ ID NO: 330 - DNA, 1176 bp, Solanum lycopersicum
aaacaccgaaagcagttgggggagaggaagatgaacttcctccgtagagtaatttccccaggctctcgttctcaagtttctcaatttgcgaataggtccttcaaaattacacaaaagcattatgggtccattgctcaacccacctcaagctccttggttcatggcattcatcaatttcattgcccagatgtggttggaatccttgcaaaactatcggattgcatagcatcaagggaaggaaatattctcagtgctgatatttttgttccagacgacaatcatgtcttttactccagaagcgagtttctctttgaccctgctaaatggccaagagagcaaatggatgcagacttctctaatctagctaaaaagttcaatgcgatgaagtctgtcgttcgggtgcctgatactgatcccaaatataagatttcaattctagcttcaaagcaggagcactgtcttgtggacttgttgcatggttggcaggatgggcggtttcctattcacataacttctgtaataagcaaccatgaacgaggtccaaacactcatgtgatccggtttcttgagaggcatgggattccatactattatttgccaatgactaaggagaataaaagagaaaaagaaatcttggatatagttggggatactgactttttggttcttgccagatacatgcaggtattatctggggacttcttaaaaagctataagaaagatatcattaatattcaccatggcttgttgccatcgttcaagggtagtaatccatctaagcaggcttttgatgctggcgttaagttgattggggcgacaactcacttcgttagtgaagaactagattcgggaccaatcattgagcaactggttgaaagggtttctcatagagataatttgcggacatttatacaaaagtctgaggatgttgagaaaaggtgtcttgcaaaagcaatcaaatcatactgtgaactgcgtatttttccatatgaggcgaacaagactgttgtttttaggtcctgattgaaaaggaagctgtggtagctgcatcatctctttccattctgtccatcattcgggtgatcatcgatatcatcgttatcactcagttatccaagcaaaacttccacacaggccactccgagaagtaaagacacagaaggtgtttcatctgga

SEQ ID NO: 331 - DNA, 464 bp, Solanum lycopersicum
catcgaaaaaatgaaaacttttaattgcaatttttacatttttcttcttcttattcttcctcttatttttgaatcatgttgtttagcaagagttcaagttcatattatcaacaagcttcctgatggactggcaatgactctccattgtcaatctcatgacaatgatttaggacagttgagattgacgggaggtgacgaagctagttggacttttagtgttaatttttggggcaccactatgttttattgcgacgctcaatgggatgatagttccacaacatatcgttttgttacttatgatgccgctcgggatgcccgacgatgtcaaacggaatgctggtggatgatctctgaagaagaaacgttatatggttataatcaagagagtgaatactgggagttgtttcccttcaccagtgcataaaatctcttaatgatgcctattatcttcgtgtgtgtttaaa

SEQ ID NO: 332 - DNA, 632 bp, Solanum lycopersicum
aaaggatccattcttctaacattcgccggaaaattcaaaattatggaggtacataaacggaaatatatacacgacggagagatcgaagcaaaaaagcaaatgaaaacggaggaaattgatggaacggcggctccggtgacggcggcggcggtggtggaggacgacgaagtggaggagttttatgctatactgcggagaatacgagtggcggtgaagtatttcgagaagggaaacgccgagggcagtggcgccgggagaaatctgacggcggcgaagccgtggagtccgaatttccggcaggaggaattgaaacgggctgttgacggcgttaaagagagagaaaccgtggaagataatgcgggtttggatcttaacgccgacccggttactgatccgagttcttcagaagccaattaatttaattttttttttggcttaactattaggggatttcaagataagtgggagtaaaattattataattcgataatatgtttttctttttcattttaattggatcgagttattttttttttatttttttaaggttaattattaggatattttgactcttaatatgtttttcgcccattttaattgcctcggaggggctgtaattactgctcgagttt

SEQ ID NO: 333 - DNA, 1027 bp, Solanum lycopersicum
aaaggatcctgataatactccataaatggatgggagaggagggtgttgtattgctaggtatgcaggaggtgcgtacgatatgtcaaaagtggataggataatgcttaaattcagacctatagcacctaaaccagcagcagccggtgcttccgtttccggcacgactactccaccgcaaaaatctgaggttccggttcgtactggacggtggaagagaaggtatgttaaggacaataaaaatagtaataataacaagagatctagtagcggcgggtgtagtcctactcctagtcgtaggaaaaggaaagctcggtcggttgaagaaaatgattcaagcgcaaaatcagtgtctggcggagaaacggcagttactctgccgttgttatcggagattcctgaaaggaaggataattcagttgatatgatgaaaaaaaatgctccgatctggttgagttttggtggtaaccaagggaataataatgataacagtaataataataatggtcagttgcagggagtggctatggatcggtcagttgtgatgtttcctcagccagtacgtgtagtggggtcatgggtaaaggtggaaagcgtgacagacgcgtgggtggaagggtatgggttaggacgtacggatgaggaaaaacttataaatctggagcgggacagctgtccagggtttatatcagacggtttaaatagagttaggtgggccaacaaggcatacaaggggatggtgggtgatggggcaggggaagtggttgtttggctagtgatgaaagatgctgtacggctgccggagagcaaatctacggcggcgttcacttgccgggttagggttgtcaggtgcgggaaggaaaaaaattcattgattctgccgtgcgatgtgtggagaatggacggcggaggatttgcatggaggttggatacagaagccgctctctctttggggcggtaggtaggtaattgaagtaactccacctgaagggtaaagaagtaaatctgtatgccgaaccacctcgagaaa

SEQ ID NO: 334 - DNA, 354 bp, Solanum lycopersicum
ccagagtaccaattcatcatcacaaaaaaagacaaacatagtttttagaagtaagaagaaattaaataaaaatgagttcaagcaggagagcatggatagtagcagccagtgttggagcagtagaagctttaaaagatcaggttggattgtgcagatgggattatccattgaagtgtttggcacagcacacaaagaataacatgagatgttactctcaagctaaaaaactttcatcttcacttattgcaaagtgtgaaaagacagagcaatctgaagaatctctgagaaaagttatgtatttgagctgttggggtccaaattgaacattttagcatagtggtaaatgagacagaa

SEQ ID NO: 335 - DNA, 1060 bp, Solanum lycopersicum
aaaggatccttacaagaccataccgccattctcgtttcttataaacactctatttctcaaacaatttcaactcttattcccaattttcaactttaatttgtcaaagatgtggagaaattcctgtaatctattgaaacggacagttacattggttgcgaggacaaatacggttaacaatggggtgaggccgtttttgggtgtggattataagttcgggtgctattgtggcccgaccagaatggtgggtgggtactattttagctctgggtcaaatgggggtggggaaaacaagaatggggatagtattactcatgaggaagctaagaggttgatgagattggtgaatgttgaggagctgaagtggaaattggggatgaagaatacggaggttattgggtatatggatctgttaaaggcgtgtaagaatatgggtgtggctaaaacccatgatgaagctgttggttttgctagagttcttgatgaggctggtgttatattgctattcagagataaagtttatcttcatcctgataaggtagtggatgaaattagaaaggcagttcccttggcacttctacccgaaaatgaccccacaatagaagaactaaagattctgcaagagaagaaggataaaatagatgagcttgcccataggcatgtgcgtcgcgttttgtgggctggtttaggggctggccttttgcaggttgggctcttcttccgtcttacgttctgggaattctcttgggatgtgatggagccaattgctttttttacaacttctgctggaatagtaataggttatgcttacttccttgttacttctagagacccatcataccaagatgtgctgaagaggcttttcctctcaaggcagaggaagctgatcaagaagcatgattttgatattcagaggtttgtcgaattacaaaagaaaatcaaattaccagtgaatagtcaatcttccattaaacatcggttaggaatggagctggaacccgaggatcttttacatggtcactaaatcatgttggcctctgatcctcttctttagctcgagttt

SEQ ID NO: 336 - DNA, 1694 bp, Arabidopsis thaliana
cccacaaacacaaagtgtaatatctaaaaatccatatctccatctctcccctctatctatcgctccctctctctaattcttcggacacaaagcataagacttgaaggaagcaaaatgagtttgtggtatatcattgttgcattcgtcttcttttcaactataatcattgtaaggaacactagaaagacaaagaagaatctacctcccggacccccaagacttcctattattggaaacttgcaccaattgggatctaaacctcatagttcaatgttcaaattatccgaaaaatatggacctctaatggctctaaggtttggaagtgtgtctactgttgtggcttctacaccagagacagtaaaggaagttttaaaaacatttgacgcagaatgttgttcgcggccttatatgacttatcctgcaagacttacatacaatttaaaagatattggcttttgtccctacaccaaatattggagggaggtacgaaagatgacagttgttgaactctacactgcaaaaagggtacaatcatttcaacatacaagaaaagaagaagttgcatcactcgttgatttcatcacacaagctgcgtcattggagaaaccggttaacttgaacacgaagttaatgaaactatcaggaagtgtgatttgtagagttgtatttggtatcaatcttaaaggaagtaaacttgagaatctttatgaggaagttattcaaggaaccatggaggtggtggggagttttgcagcagcagattacttcccgatcattggtagaatcatcgataggatcacagggttacatagcaaatgtgagaagattttcaaggcaatggatgcattttttgatcaatctataaagcatcatctagaagatgagagtattaaggatgatatcattgacttgctcctcaagatggaaaggggagagattgaacttggggagtttcaacttactcgagacaacaccaaaggaattcttttcaatattcttaacgctggaatagacacttctgcacaagttatgacatgggtgatgacatatttgatttcaaacccaagagttatgaagaaagcgcaagccgaggtgagagaagttataaaaaacaaagacgatatcattgaggaagatatagaacgactcgaatatctgaaaatggtagttaaagaaacgtttagggtattaccgctcgttccacttctaattccaagagaggcttcaaaagatgtaaagattggaggttatgacattccaaagaaaacatggatccatgtcaacatatgggctattcataggaatccaaacgtttggaaagatccagaagctttcatccccgagaggtttatggataaccagattgattataagggtttgaactttgagtttttgccgtttggtagcggaaggagaatgtgccctggtatagggatgggtatggctttggtacacttgactcttatcaatcttctttaccgatttgattggaagcttccggaaggaatggaggtagaagatgttgatcttgaagaatcatatggacttgtctgtcctaagaaagttccacttcagcttatcccggtccttacccaatggagttgattttatattttcatagttctaaatgtaacccttaagaagtatcctaaagttcttatccttatcactagatgagtatccacgctatgttg

SEQ ID NO: 337 - DNA, 960 bp, Brassica napus
aaaggatccagaaacgttaatcaatggcgtcgagaccgtgcgattcgtgcagatccgcggccgcgactctgttctgccgcgcggacgcggcgtttctctgcggcgaatgcgacggaaaaatccacacagctaacaaactcgcctcgcgccacgagcgagtcttgctctgccaagtctgcgagcaatctcccgcgcacgtcacgtgcaaagccgacgcggccgcgctctgcgtcacgtgcgacagagacatccactccgctaacccactctcccgccgccacgagcgcgtccccgtcacgcctttctacgacgctccttcaaatgctgacgttagcatggaggctgcgtcttggctcttgcacaacccgagcgtcaaggaaggaggtgtagagatcccaaacttgtttgccgatcttgattactccggggttgatccgaagatggaggcgtcggagaatagctccggcaacgacggagtcgttcctgttcagaccagagctctgtttctcagcgaagattacttcaacttcgacatctcagcttccaaaacaactttcccacacggattcagctgcattaatcaaactgtttcgtcaacatcgttagatgttccgttggtgcccgaaggtggagctgtggtggagatgtcaagaacgacggcaacaccagccctgcagctatctccggcggagagagaggctagggttttgaggtatagagagaagaggaagaatcggaagttcgagaagactattaggtatgcatcacgtaaagcatacgccgaggtgaggccgaggatcaaagggcgttttgctaagcgaactgattcaagagttaatgatggaggagaggtcggagtctacggcgggttcggagtggtcccgagtttctgagtctttcttcagtgtcatgttgtaagaaacattgatgatggtagctaaagtaacggttctcgagttt

SEQ ID NO: 338 - DNA, 846 bp, Brassica napus
agaaagcaaacagagaaaatgtgtggcggtgctgtaatttccgattttgcccctaacgtcaccaaggctaagggtaggaaactcacggcggaggaactctggtcagagctcgatgcttccgccgccaacgatttctggggtttccattccacatccaagactcaatccaccaaccaacaagtgacgttgaaagaggaggcggcggagaaggagaaggaaaaggagccggtgacggagaaaaggaggaagaggaagaacgtttacagagggatacgtaagcgaccgtggggaaaatgggcgtcagagattcgagatccaagaaaaggcgccagagtctggctcgggacgttcaacacggcggaggaagctgccatggcttatgacgttgcggcgaagcggatccgcggcgataaagccaaactcaacttcccagatcttctccaccatcctactcgtagtcctgcgactcctctagcatcgtctccagtttcagaagttcagcctccggcgaagaagcactgcgttgtctctcagagcgagttgactcagccgagtttcccggtggagtacagtggagtggggagcggggacgagtttcaactggactacgatctgaaacagcagatatcgagcttggagtcattccttgagctggatggtgacacggtggagcaaccgagtcagctcgacgagtccgtctccgaggtggatatgtggatgattgatgatgtcttcgcgtcgtatcagtaataaacgtaatataagtagaaatattaaataaagtttgtaatataactgccgttacgttctaaggtttgtaatgtgatgacatgagcgactgatgtt

SEQ ID NO: 339 - DNA, 1429 bp, Medicago truncatula
aaaggatcctcttacaatggcttcatcaatcacaaaccttaactcaccaaaattactacccatttccaaagaacaaaccaacccattttcccattttccaccaaataccttaaagtttgcatctttgtcttcaagaacatgttcaaatgtgtcttgttctgttacaagagacacttcctctgttcttccattggaggttgaaaatgggtcggttgttcttcaacgacctgattcgtttgggagatttgggaagtttggtgggaaatatgttcctgaaactcttatgcatgctcttactctgcttgaagcttcatttcattctcttgctagtgatgaagattttcagaaagagctggctgggattctaaaggactatgttggtcgggagactcctctttattttgcggaaaggttgacggagcattacaagaacgctaatggtgaaggacctctcatttatctgaagagggaagatcttaaccacaccggggctcataagattaacaatgctgttgctcaagctttgcttgccaagaaattaggcaaaaagcgcattattgctgaaaccggagctggacagcatggagttgccactgctactgtatgtgctcggtttggtttggaatgcattatttatatgggtgcacaggatatggaaaggcaggcactgaatgttttcagaatgcgtcttcttggtgctgaggtgagaccagtccatgctggaactgctacacttaaggatgctacatcagaggctattagagactgggtgactaatgttgaaacaactcattacattttgggatctgttgctggaccgcatccatatccaatgatggtaagagagtttcatgctgtgattggcaaggaaacaagaaagcaagctttggaaaaatggggaggcaaaccagatattctgattgcatgtgtcggtggaggttcaaatgccatgggacttttccatgaattcgttgatgacagtgatgtcaggctaattggtgtggaagctgctggctttggcctcaacagtggcaagcatgctgctacgttgacgaagggagaagttggtgttttgcatggagctatgagctatctgctgcaggatgatgatggacaaattgttgagcctcactctattagtgcaggcttggactaccctggtgttggacctgaacatagctttttgaaagacttggggcgtgctgaatatcatagcatcactgatgatgaagcattggaagcttttaagagagtttcgagactggaaggcatcattccagctctggagacatcccatgcgttggcgtatctagagaaaatatgtccaacccttcctaatgggacaaaggttgtggttaacttcagtggccgaggtgataaggatgttcaaactgttaccaagtacttgaagctttgatgactcgagaaa

SEQ ID NO: 340 - DNA, 1168 bp, Solanum lycopersicum
gaaccttcaatatctgctaatggatctcaataatctcttcatttctctcactccatcatggacttcggtgtctatgttgatcggattttttctctatttagctaccgttggatctattctacccggaaaacttgttcctggggcgactttatctgatggaactcgactccattatcgttgcaatggtttattatcacttctgttgttggttttgcttcttggagttgggtcgcagatgaatcttgtttcacctactgctatagcagatagaggacttgagcttttgtccacaacacttatctttagtgttcttgtgacattgatgctttatttggttggcctgaactcacgtgcaaagagttcatcactgaaacctcatgtctcaggaaatctaatccatgactggtggtttgggatacaactgaatcctgaattcatgggcattgatctcaaatttttctttgttagagctggtatgatgggatggttacttatcaatctttcagttcttgcaaaatgtgttgtagaggctaaattgagccaatcaatgattctctaccagctattttgtgggctctacatccttgactacttcttctatgaagagttcatgacctccacatgggatataatagcagagaggttgggctacatgctggtttttggtgatctagtctttataccgttcaccttcagtattcagggttggtggcttttgagtaacaaagtggagctaacaacagcagcaataattgccaattgcctcgtctttcttattgggtactcggtgttcagaggagccaataagcagaagcatgtatttaaaaaggatcccaaggcacccatatggggtagtcctccaaaagttattgggggaaagttgcttgcttctggctattggggcattgcacggcactgtaattacctcggggatttgttgctggcatcgtcttttagtttaccttgtggtataagctctgtggttccatacttttaccccatatatcttctcattctactcatatggagggagagaagggacgaagctagatgtgcagagaagtacaaagatgtgtgggctgaataccgtaaacttgttccttacaggatcttaccttacgtttactagctcaatcgtttgtccacgttgcttgtgcattagagtcag

SEQ ID NO: 341 - DNA, 877 bp, Solanum lycopersicum
aaaagatggcttctaacacattgatgagttatggaattgcacctgtttacccctctattctctcttcttccaagtctaaattcgccaccgcgttgccggtatccaccggagttaccaacgacacgtcaaggttcagtatgtcggccaattggatgcccgggcagccccgtccatcctacctcgacggctcagaccccggagatttcggatttgatccacttggttttggagaagtaccagaaaatttggaaagatacaaagaatctgaacttattcattgcagatgggctatgcttgctgttccagggatcatagtaccagaggcattgggcttaggtaattgggtcaaggcccaagagtgggcagccattcctggtggacaagctacatatttgggccagcctgttccatggggaacacttcctactattttggctattgaatttttagccatagcctttgtagaacaccaaaggagtatggaaaaagattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattagagaacttggcaactcacttggctgacccatggcacaacaacattggggatgttattatccctaaaggcattttccctaattaaattatactatttatcatatagtatattagccaaaaaaaacaccttgtaaaactctcccatattgtactcatatagtcttgtaatgaaatggactctttgtgtatcctgtgtctatgcatgatatctctatc

SEQ ID NO: 342 - DNA, 1736 bp, Solanum lycopersicum
cgaacttgtaggatttcctgtcaaacattctcctcgccggagaaggaaataaacgtcgtcggtgttcaggttgattgaaggttctacgtttgatccgttcaattcttttggctccaagttgtagttgaaacaaatcggaaatggcttctcaaccgaagaatgttggaattctcgctatggagatttactttcctcctacttgtcttcagcaggaagtattggaggctcatgatggagcaagcaaaggcaagtatacaattggtcttggacaagattgcatgggcttttgcactgaggttgaagatgttatatcaatgagtttgacagctgtgaattccctactggagaagtattctgttgatccaaagcaaattggtcgactagaggttggaagtgaaactgttattgataagagcaaatctatcaagacattcttaatggaaatatttgagaaacatggaaatactgacattgaaggagttgactcaactaatgcctgttatgggggaactgctgcattgttcaactgtgtaaattgggtggagagtgcttcatgggatggacgctatggtcttgtagtatgcacggatagcgcggtctatgcggaggggcctgctcggcctactggaggagctgcagccattgctatgcttgttgggcctgatgctcctatagtatttgaaagcaagatcagggctagccatatgtcccatgtctatgatttttacaagcccatccttgacagtgaatatccagtggttgatggtaagctttcacaaacctgttatctaatggcacttgatgcttgctacaagagtttatgcaacaaatatgagaaattggaaggcaagcaattttcaatgtcggatgcagcctactttgtgttccattcaccatacaacaagcttgtgcagaagagctttagtcggttgctgttcaatgattttctaaggaatgctagctctattgatgagtctgccaaaaaaatcctggccccctttgaatccttgaccggtgatgaaagctaccagagccgtgatcttgagaaggcatcccaacaacttgctaaaccactttatgatgagaaggtgcaacctaccacattgataccaaaacaagttggcaacatgtacaccgcatctctttatgctgcttttgcatccctccttcacaataagcataacacattggctggtcagcgggtaatcatgttttcttatgggagtggattgactgcaactatgttttcgctaaagtttaacgaaggtcaacatccttttagtttgtcaaacattgcaagcgtgatgaatgtcacagagaagttagaatcgagacatgagttcactcctgaaaaattcatcgaaatattgaaactaatggagcatagatatggtgccaaggacttcgtgaccagcaaggattgcagccttcttgcaccaggaacctactacctaacagaagttgattccaagtacagaagattttatgcaaagaaggctcaggagaatgggctggtcaacggacactaggacagcaaacacggtccttgttgcacggtgtaaggccatatagtaggcgactcgtgctgtttaagttattgttagcgcatagaagaataactagtgctctggcagattcgattgttattacatgtagtttctttccagagtagtagatgtagatcctatgccttttttctttcttttttcagttcctgacgagttctaatgttgtgc

SEQ ID NO: 343 - DNA, 515 bp, Solanum lycopersicum
tttcttcaaacaacaaatgtctctgattccaagcttctttggtggtcggagaagcaatatcttcggcccattttcccttgacctatgggatcccttcgagggcttcccaattgccaacaccccatcctctgctcgtgaaatctctgcttttgcaaatgcaaaaattgattggaaagagaccccacaagctcacgtcttcaaagtggatgttccggggatcaagaaagaggaggttaaagttgaagtagaagaaggaaggattttacagatcagcggtgagagaagcagagagaaagaggagaagaacgatcagtggcaccgtatggagaggagcagcggtaagttcaaaaggagattcaggttgccggagaatgcaaaaacaggggaaataaaggcagagatggagaatggagtgctgacagtgactgttccaaaagaagaagagaagaagaaatctgaggtgaaggcaattgacatctctggttaaacaagtgtttgatgaaatttcctttctc

SEQ ID NO: 344 - DNA, 1442 bp, Glycine max
ggaagacggtttagacagagagtacttcaagctaagaaaatggaaagtggggttgtggctgtgaacaacaacatcaacaactatgaatccaaggcaacttccaccatcaccattaagggcattctcagccttctaatggaaagcattgatgatgagaattgtgatggtggtggaagcaagaagagagttatttctcttggtatgggtgacccaactctcaccacattgttccacacaccaaaggttgttgaagaggctgtcgctgatgctcttcaatctcgcaagtttcatggctatgctcccactgctggacttctccaggctagaattgcaattgctgaatatctatctcgtgaccttccttatcaattatcacgagatgatgtcttcatcacttgtggatgcacacaagccattgatgtttcggtggcgatgcttgctcgccctggtgcaaacatcttgcttccaaggccaggcttcccaatctatgaactttgtgctgcatttagaggggttgaagtgaggcattatgatctgcttccagagaaaggttgggaggttgatctagatgctgttgaagctcttgctgatcagaacacagtggcgttggcgatcataaaccctgggaatccttgtgggaatgtgtacagttaccaccatttggagaagattgctgaaactgcaaaacgggttggaacaattgtgatctctgatgaagtttatggtcaccttgcatttgggagcaagccttttgtaccgatgggagtttttggctctactgttcctgttctcactcttggctcactttctaagagatggatagttcctgggtggaggcttggttggtttgtgacaaatgatccatctggcacttttagagaaccaaaggtagtcgagcgtatcaaaaagtattttgatcttctaggaggtccagcaaccttcttgcaggctgctgtacctcagataattgcaaataccgaagaaattttcttcgagaaaaccattgataatttgaggcatacagcagatatatgttgtaaagagatagaggatattccctgcattttttgcccttacaaaccagaaggatccatggctatgatggtgaaattaaacctttcacttctggaagatattagtgatgatattgacttctgtttcaaacttgcaaaggaggaatctgtgatcattcttccaggaactgcagtaggcctaaaagattggcttcgtattactttcgctgctgatccatctgctcttggagagggtatgagaaggataaaatctttctatcaaaggcatgcaagaaaattgtaaagctatagtgaattcacttataagtaaaattactaaataaatggccctttactactagtatactacacaagaattgaagattttatttcaatatagcatacagtctctttaggaatggaccaatt

SEQ ID NO: 345 - DNA, 427 bp, Glycine max
cggtactctcaaattgatcctctcagtctgaggaaggaagacggtgcgttcgtaaaaagtgaaaaagaaatggcagaactgagtttgggaattctaattgatattgttgatgaggaatggatgagagacactctccctgatgatgatcttccactgcccccaacactggttgtaaggacagatgatactgaggactcaaatcaggagacgcaacaagttaatctggatgcttggcacgatcttgcctttggtcaagaatagaagtttcatcattaaccagtgttgtgttttgtacttagtgagtagatggtccctgttatttggacttggcatcttcctttctatttccccgatagattgtaacttatcaactactagtacctgttaaggttatattaaggaattgtggtgtcattgctgaatgtta

SEQ ID NO: 346 - DNA, 1477 bp, Arabidopsis thaliana
aaaggatccgatgctagttacggtggtgaagcagcggttagtgtactctcgccggagaaattggttatgaccggaatctcacctccgtgatcgaagaaactgttttcgtttttttatcgttacgaagaaatggaaaaacaggcgaagctaacgaggacacagtcgtcgttactccggtcatcgtcgaatctccgttcgtcatatcaaagcttatcttcaatcgtcgaaggcgagcaagatctagaagccggagagaaagaagagaaacagagaagaaaaccacctaaaccattcggttcaccaaatcctaaaaccggtttaaccagaatcaatcccggtttagctttcacaatggtatctctctctttcctaagtctctcatcgttcttcttcttcgtcgtcttctcacaaaccgatgagattctcacatcggagaatcttttactagctttaatcttcgtcgctgtagctctcttcttcgcttccaagaacatctctctactaaaccaaaccgtaatcgcaatcaaaaacttagggttccaaaacagagactcgaaatcaaaaccggtacaatggtacatcggagacgattcaaaaccggagaagaaggtaatcaagagattcgttaaagaaggagttcaattctacagtaatggagatttctacgaaggtgaatttaacaaagggaagtgtaacggaagtggtgtgtattactatttcgtgagaggacgttatgaaggagattggctagatgggagatatgatggtcatgggattgagagttgggctagaggaagtagatataaaggtcaatataggcaaggtcttagacatggttttggtgtttatagattctacactggtgattgttatgctggtgagtggtttaatggtcaaagccatggttttggtgttcaatcttgttctgatggtagctcttaccttggtgagtctagatttggtgttaagcatggtcttggttcttaccatttcagaaatggagataagtatgcaggagagtactttggagacaagattcatgggtttggtgtgtatcgatttgctaatggacactgttatgaaggagcatggcatgaaggtcgtaagcaagggtttggtgcttactcgtttagaaatggtgatgctaaatctggtgaatgggattcaggggttcttgtgacttcacttcctcttacgagtgagccagtttcaagagctgttcaggcggctcgagaaacagcgaataaggcagtgaatcggagacgagtagatgagcaggtgagccgagctgtggctgcagctaataaggctgctacggctgcaagagtggctgctgtgagagccgttcagaatcaaatggatggtaaattttgtcaaagttgaaaaaaggaaaatgtaaaaaaatctttttttttaccggtttctctgtaaccctgaatcgaaagtttgtttcagaggtttgtaacagggtaccttt

SEQ ID NO: 347 - DNA, 1136 bp, Medicago truncatula
cactcgatcatttcacctcagaaaacgaaactacaactgaattgcagcctctctgaattagggttttgttgccaaacgatgggaacaagatcgcagcaatcgtgtgtcgacgaagaggaggaggaatttatcggttgtggaactacgatttcgggacaatcaggctcaaccagcaggagtgctggcgggttagcgtctagccgaagcgagcagacgattgggacagccgccggtgataacactgctctcagattgaatcatcttgatatacaggatgatgatgctgcttcccaaggagtagttgctagcaagaagaaaaagagaggccaacagcgagctaccggaggtgataaaagtggaagagggcttcgccaatttagcatgaaagtgtgtgagaaggtagaaagtaaaggaagaacaacttacaatgaggtggcagatgaacttgtggctgaatttgctgatccaatcaacagtgttttgacccctgataagcaacaatatgatgagaaaaacattcgtcgaagggtctatgatgctctgaatgttctcatggcaatggatattatttctaaggataaaaaggaaattcaatggaagggtcttcctcgtactagtctgaatgatattgaagagctaaagacagagcgtcttgggctcaggaatagaattgaaaggaaatcatcctatttgcaggagctagaggaacaatttgtaggtcttcagaaccttattaaacgaaatgaacaattatatagctctggaaatcctcccagtggaggtgtatctttaccctttattctggtacagacacgtcctcatgcaactgttgaagtggaaatatcagaagacatgcagcttgttcattttgattttaatagtactccttttgagttgcatgatgacaattatgtgctcaaggcaatggaatttggtgatagaacacagagtgatattgttacacacaatgttacagatggaggggaaggttctagcatgtcaggcatgcatcagtcacaggttcctccttcagcttcaagcgtgtcaactagacctccaacatcacctccactccctggaatattaaaagcaagagtcaaacaagagcattgatctgcaagattatgatatcgtcg

SEQ ID NO: 348 - DNA, 1316 bp, Solanum lycopersicum
aaagtcgactagatctgaaacgaagctatgcaatcagattatgaaatgggtgggatccatcaagagtgtgaagatgagcctagattcatggtggaaaataatgcttccacttcttccccattttacccaaactatcacttccctccgacgtctcatcctattctccaacaaatccacagtttaccgattactcaacattttttcccttatcaacatgctcattacagatctatgtcagaagaaataagagtagatcagtctcagacggcggagttagtggcttttcctgcaagtgaaataagaggaggacaagaagatgctttgattcgtgggagtgagcgatactgtacacagcctcgacaaacttgtgtagctgtttggcaaaaccaagaagattctgctatgaaacaacctgtttggaaaggagaatattcaaatggaaatgcaattgagaaaaacaaacaagaagaagatgaggaattgtatagtttagaagaaactaataaacgtagagtagtattcggagagttagaagctatttgtattcgtggaattgcatctgaatctgctgataatttgccaaccaaccacaatgtcacttttcctgaattggctctcaatgaagccatggttaacaaaatggataatactatgggtaaatttcataaaaggaagagagggaaagatgaatggggaagatttttcaagtcattagtgaagaaactggcgaaccaccaagaagatctacaaagaagtttgatggaaacaatggagtgattagatcaagaaagaaaagaaagagaagaattatggagagagaaagaattagaaaaactccaaaatgaagaagctgctagagcccatgaaagaagattggcttcaactagagaagctgctcttgtttcttgcttagaaaaactcacaggtcagaaaattgattttcaaacattcaaaataaaggaagacgaaacctgagataacaagtaagtatggaaagaaataagtaagtcaatcaatgtctgcaatgggatattatgagccgcaaagagaagtgatgcacaagtgtagtctcaagaaaagatcacaagggaacagttgagaatagttgtactcaaggaaatgatactaatattgatggcgatgaaaacagacgtaacaaacaacaacaatgagtgataagctataagaacatcactgcttactttcttctttattattgtttattttctcatttctttttcatgtatttgttttgttcatcctgtcatttccttttcttccaacaatgatatcagttcccatgtcgagagctcaaa

SEQ ID NO: 349 - DNA, 1384 bp, Arabidopsis thaliana
cagattgaacccaatccaaatccaatcagggctacttcgatttgatctgtttcctcaaaaaaggattcgactttctctgagatggtatatttccagaactcaatctccctcgtagaccaatctccaatcatggctcactcaccagattttcatcatcattcaaaacaatcaagaaccagcagcagcaacagaaagtcatcatcgtcaagctgttcttcaaatttctctgtttgctgtgacggatctagatcagctgctatcgatgttgtgatcttaatcgctgtgatcacatcctccgggtttttaatcttcccttacatcaaattcatcactatcaaatctgttgaaatcttctctgagctctcttgtttagtgaaagaagagattttgcgtaaccctgatccaattgtctacggtttaatagctttgagtatctcgtgtactgcgttatctgcttggatgattgttatactactgtgtagtcgtcatcgatgtgggaaaccgaactgtaaagggcttaggaaagctaatgctgagtttgatattcagttagagactgaggattgtgttaagagctctaatagtggcaagagtgttagtaagaagggtttgtttgagttgcctcgtgatcatcaccgtgagttagaggcggagttgaagaagatggctccacctaatgggcgagccgtgcttgtttttcgggctaaatgtgggtgttcggttgggagattagaggttcctggacctaagaagcagcaactgcagcaaaggaaggttaagaaatgaagtataaaggttcaatctttttgaggtaaaggttattatgatgatgatgatgattactttgattagtttataaacaacctttttttcttttgggtttagttattttcagaagaacttcttacagaaactaatactatgttaaatctccatgtgtttaaataaaagctttacaaggatattgcaacagaaaatggttaacagtgaagaataaatgattttgttttttaagtttttgaatgtgttctttgatttcttgattctgttttctggctctcatggtcttatggtagctaccataagaccatgagagccagaaaacagaatcaagaaatcaaagaacacattcaaaaacttaaaaaacaaaatcatttattcttcactgttaaccattttctgttgcaatatccttgtaaagcttttatttaaacacatggagatttaacatagtattagtttctgtaagaagttcttctgaaaataactaaacccaaaagaaaaaaaggttgtttataaactaatcaaagtaatcatcatcatcatcataataacctttactgatccaaacccttgtatatgctctggattctggcgtttatgt

SEQ ID NO: 350 - DNA, 439 bp, Arabidopsis thaliana
aaggaagccaagcctagaaacactataaagataagacacaaaggaagtctgagaattgtgagtaaaaatgtgtttggaagttgtgtatcatgaagagaagacggagcttggtcggcaacaagcaccagggatgtgtccttattgcggcggaaaagtatcggcggtggatatagagacgaagtggttgttctgtttcttaccactttgtttcaaggtcaaacgcaaatactcatgttcttcgtgcgagcgtcatctcgtcttgtattattgaagaaacacgtagagagatgcgaaattgaagtaaagagaaaaaccaaaacagaaagaatgaagaaaagaaacagaggagaaactgaaaaagattgttttatctctttcatttatttggttgcttctcctctcaatgttgaggtttttgcagatttcctcttgtgacttc

SEQ ID NO: 351 - DNA, 306 bp, Arabidopsis thaliana
cttgaagcaaattcaacttctgcgtactgtttctttgttgaatcatggatccagcgcccgaacccgttacttacgtctgcggagattgtggtcaagagaacactttgaagtctggggatgtgatccaatgcagagagtgtgggtaccgtattctctacaagaagcgtacccgtagagttgttcaatacgaagctcgctgagaactactactcctgaaggtggttcatagtctgttaagatgggttgagactttttggcactgtttgtgatatatatatcgacatggttattgctacattgcctgtt

SEQ ID NO: 352 - DNA, 389 bp, Solanum lycopersicum
tatcgtccatagttcaatcaggatttttatttagagctatttatctttagatctgtgctttgctgttggagaatcaagaatgtctcgcgggaaccagagagatcgagatcgtgaaagggcacaagccaggggaaatcacaagtccaagacacctaaaaatgatggattaactcctgaacaacgaagagaaagggatgcaaaggcacttcaagagaaggcgaaaaagaaagcagcacaggcggaagatggatggaatatcaacaaatcggaaagccataacatcaagaagaaatagattcatgacgagtttcatggaactttttatcctcagtaattctggcatgtattgtttggcttttgtacctttgatttgtgtcttcatctgcaat

SEQ ID NO: 353 - DNA, 3735 bp, Arabidopsis thaliana
agtcgacctctgttcggttggtttcacgtaaaaaataaaactttgaggttcaatggtaggaggtggaacaaagagaagaagaaggagattacaactaagtaaactatatacactaacatgtgctcaagcatgttttaagcaagaccattctcaaatcggaggacctggtttctctcgtgttgtttattgtaatgaacctgattcacctgaagctgattctagaaactactctgataactacgttaggactactaagtatactcttgctacttttttacctaaatcactctttgagcagtttaggagagttgcaaatttctactttttggttactggggtcttggcttttactcctcttgctccttatactgcttctagtgctattgttcctcttctttttgttattggtgctactatggttaaagaaggtgttgaagattggcgccgccaaaaacaggataatgaggtgaataataggaaagttaaagtgcatagaggtgatggaagtttcgatgcgaaggagtggaagactttgagtattggagatatagtgaaggtagagaagaatgagtttttcccggcggatcttgttttgctatcttctagctatgaagatgctatttgctatgtagagacaatgaaccttgatggggagactaatctgaaagttaagcaaggacttgaagtaacttcgtctttgcgtgatgagtttaactttaaagggtttgaggcttttgtcaaatgcgaggatccaaatgctaatttgtattcgtttgttggaaccatggagcttaagggagctaaataccctctctcaccgcagcaacttcttctgagagactcaaaactcaggaacacagatttcatctttggagctgttatcttcacgggtcatgacacaaaggttattcagaattcaacagatcctccatctaagagaagcatgattgaaaagaagatggataagattatctacttaatgttcttcatggtgattactatggcatttattggttctgttatctttggagttacaacaagagatgatctcaaggatggtgtgatgaagagatggtacttgagaccagatagctccagtatcttctttgaccccaaaagagctcccgtggctgcgatctatcattttctaaccgcggttatgctgtacagttatttcattcctatatccttgtatgtctccatagagattgttaaagttcttcagagtatcttcatcaaccaggatattcacatgtactatgaagaagctgataagccagctcgtgcacgtacctctaacctgaatgaagagcttggacaagtggatacaattctctcagacaagacaggaacattgacatgtaactccatggagttcattaagtgttctgttgcagggacagcttatggtcgtggtgttacagaggtggagatggctatgggaagaagaaaaggtggtcctttggtgtttcagagcgatgagaatgatattgatatggaatatagtaaagaggcaattactgaagaatctacggtgaaaggattcaactttagagatgaaaggataatgaatggaaactgggtcactgaaactcatgctgatgttattcagaagtttttcagattacttgcggtatgtcatactgtgatacctgaagtggatgaagatacagagaagatctcttatgaagctgaatcgccagatgaagcagcatttgttattgcagcaagggagcttggttttgaattttttaacagaactcagactaccatatcggtaagagagctcgatcttgtgagcggcaaacgagttgaaaggttgtacaaagttttgaacgttcttgagttcaacagcacgaggaaaagaatgtcagttatagtgcaggaagaagatggaaaactcttattactttgtaaaggagcagataatgttatgtttgaaagactatccaagaatggtagagagtttgaagaggaaacacgggaccatgtaaacgagtatgctgatgcagggctgagaactttgatacttgcttatcgtgaacttgatgagaaagaatacaaagtattcaatgaaagaatcagtgaagccaagagttcggttagtgctgatcgagaatcgctgatagaggaagtcaccgagaaaattgaaaaagacttgattcttcttggagctactgctgttgaggataaactccaaaatggagtccctgattgcattgacaagcttgctcaagcaggaataaagatttgggttttgactggtgacaagatggagactgctatcaatattgggtatcattttctgggtttgcttgtagtttgctcagacaagacatgaagcagatcataatcaacttggagacccctgaaattcagtcactagagaaaaccggagaaaaagatgtcattgcaaaggcatcaaaagaaaatgtcttgtcgcagataattaatggaaagactcagttaaagtattctggagggaatgcttttgctttaatcattgatggaaaatcacttgcttacgcgttggatgatgatataaagcacatctttctagagctggctgttagttgtgcgtctgtcatttgttgccgttcatcaccaaaacaaaaagctctggtgacaagactagtaaaatctggaaacggtaaaacgactttagcaattggtgatggtgcaaatgatgttggaatgcttcaggaagcagatataggtgttggtattagcggtgtggaaggaatgcaggctgtaatgtccagcgacattgcgattgctcagtttagatatttggaacgtttgttgctagtccatggacactggtgttacagacggatctcgacaatgatttgctacttcttctacaagaacattacatttggtttcacactcttcttatatgaaacatacacaacattctcatcgacacctgcctacaacgactggtttctatctctttataatgtctttttctcgtcccttcctgttattgctcttggtgtcttcgaccaggatgtctctgcacgttattgtctaaagtttccgttgttataccaagaaggtgtgcagaatgttctgttcagctggcgcaggatacttggctggatgttcaacggattctacagtgcagtaatcattttcttcctctgcaaaagctctctccaatctcaagctttcaaccacgatggaaaaaccccgggaagagaaatcctaggcggaacaatgtacacatgcattgtatgggttgtgaatttgcagatggcattggctatcagttacttcactctaatccagcacattgtgatttggagctccattgtcgtttggtactttttcatcacggtgtacggagaacttccatcaagaatatcaaccggtgcatataaagtctttgttgaagctctcgcgccttcattatcttactggctcattactctctttgtagttgtagcgacgttgatgccatacttcatctactctgcacttcagatgagttttttcccaatgtaccatgggatgatacaatggctaaggtacgagggtcagtgtaatgaccctgagtactgtgatatagtaaggcaaagatcaataaggcctacaacagttgggttcactgccagattagaagctaaaaagagatcagtgaggatatctgagcctgcatcatgacaacgaaaactaaccaaacatcaacttgactcgcagaacgtaaatagcaccaagtagggtaccttt

SEQ ID NO: 354 - DNA, 3970 bp, Arabidopsis thaliana
aaacccgggagcttgacgacgatgaatatgatcgaccctttaaataaccttctcttctcgtcaacgcgtttccttcttcttctttcctcgtttttctcttgtcttccaactccaccacctcctctcctgttcatggtggatgggagtcggagatcctcttccacttccgccggaaaagaaccgtcgggaggttaataaaccgccggatattgcgtcgacttcctcctcctccgcttcggcggtgaataatgctcggttgtccgatgctccgattcttttgtttgtttatttccataaggctttccgtgcgcagctagcggagctccagtttctggccggtgatacagtccggtccggttctgatctggccgtggagctccgctctaagtttgagtttcttaagcttgtatataagtatcattccgcagctgaagatgaggttatattttcagcgttggacactcgtgtgaagaacattgtttttaattactcgcttgaacatgatgccacagatgatcttttcacttcagtttttcattggctgaatgttcttgaagaggaacaagggaacagagccgatgtacttcgtgaagttgttttatgcattggaaccattcagtcatccatatgtcaacatatgcttaaagaagaacgacaggtgtttcctttgatgattgagaacttctcctttgaagaacaggcatcgttagtgtggcaattcatttgtagtgttccagtgatggtgctggaagagattttcccatggatgacgtctttactctctcccaaggagaaatctgaagttgagacttgcttcaaagaagttgtcccaaatgaactctctttgcaactggtcataaactcttggctgattgatgacagtcaatcttctttgacggctcttacaaagattatgaaaggagttcagtctgtagaagtgtctgaaaatatgaccaactctcagacaaattcatcatcaagtggtgtgtttcaacgtttttggcagtggagtaaaaaaatgtctttttctagtccaaatacaggacacattttggttcatggtatccatctttggcataatgcaattagaaaagatttggtagacattcaaaaaggactatgccaattgacatttccaagcctttcattggacctcaatgttctggtggttcggctaaacttccttgctgatgtccttatcttttatagcaatgcatttaagacgttcttttacccagtgtttgaagatatggtggatcaacaacactcttcctcttccaaacaattcaccatagatggacatgtggaaaacttcaagaagtcactagaccttgaaactagagcagggagtgacaattttgtcataacccttcaggagaaactggagtctcttatattgacagtagctaagcagttctctatagaggaaacagaggtattcccgatcatcagcaagaactgcaacattgaaatgcagaggcaactactatatagaagcatccatttcctgcctcttggattgcttaagtgtgtcataatgtggttctctgctcagttaccagaagatgaatgtcaatcaattattcactacttaagctctgaagattcctttcccaacaaaccttttgcgcacctcttgttgcagtggtttcgcttcggttattcaggcaaaacaccagttgaaagtttctggaatgagctgtcctttatgttcaaaccaagatgttcttttgaagaggaactcactgaagaagcttctggatctttctttcaacaatcaccgcagaaactattcaaagtatccgatccctattctatggatccacctgctggttacatgaatgagacaccttactcaagtgcgatgaatcagcaaatacttatcccaggaaagctcaggccacttctgcatcttcctgatctttttggtgacaagactattggtgaacacttaactatggacttgaaaccaatcgatctgattttctacttccacaaggcaatgaagaaagatctagactaccttgtacgtggttcagctcggctcgcaacagattatagcttccttggagaatttcaacagcggtttcatcttataaagttcttgtatcagatacattcagatgcagaagatgagattgcatttccagctttggaggcaaagggtaaactacaaaacattagtcagtcatacagtatcgatcacgaactcgaagttgagcacctcaataaagtatcattccttttgaatgagttggcagaattgaacatgctggtactagaccacaagaatgtgaagtatgagaagttgtgtatgagcctccaggatatatgcaaatccattcacaagctattgtctgagcatctccaccgagaagaaactgagctttggtgtttattcagagactgcttcactattgaagaacaagaaaagatcatagcatgcatgcttggaagaataagtggagaaatattgcaagatatgattccatggctaatggaatctttgatccctgatgaacaacatgctgtgatgtccttgtggagacaagcaacaaggaaaactatgtttggtgaatggctaacagaatggtacaattctcatgctgtcgaggaggaaacagaggaagcaaataaggatccatctgagaattcagatccattagacgttgtctggagttatctctttgaaggagctgctgatgagtacaaagggagcatttgcagcaaacctctggaagagacagagttaaaaggtatcatgaataagcctcttggaaaggctgctcctaataacaaggtagaatttggaaacaaagaggagaatcatcttgagatctcaggaagtaaaaaggtgtgtacaggagctgatgaaacgaagtacaaagaacaaactgacagcaacgcgcaagcttttcagatgtcgcataatactagccaatctggccaagacagtagatatgagtgtctgttatcaatgagtcaagaggatgtggaagctacaattcgaagaatatctcgagattcttccctggatcctcagaagaaatcgtatatcattcaaaacttgttaatgagccgttggattgctacacaacggatatataatcttgaaccatccattctctcaagcaatagggaagcagttccggggcagaatccatcttatcgagatcctcacaaactgatctttggttgcaaacactacaagagaagttgcaaacttcttgctccttgttgcaacaagctctacacatgtatacgatgccatgatgaagaggttgatcacttattggatagaaaacagatcacaaagatgatgtgcatgaaatgcatgataattcagccagtaggtgctagttgctcaaatatttcatgtagttcatcaatgggaaaatattactgtaaaatatgcaagttgtttgacgatgatagggaaatctatcattgtccatactgcaatctctgccggctaggaaaaggactgagcatagactactttcattgcatgaaatgtaatgcttgtatgtcgcgactcatagtagaacatgtatgcagagaaaagtgcttagaagataattgtccgatttgtcatgaatacatatttacctcaaattctccggtgaaggctcttccatgcggtcacgtgatgcattcaacatgctttcaggagtacacatgttcgcattacacatgccctatttgcagcaagtcgctcggggatatgcaggtttactttagaatgttagacgcactgcttgcagaacaaaagatgccagatgaatacttaaaccaaactcaggtaatactgtgtaatgactgtggaagaaaggggaatgctccttaccattggctctatcacaagtgttcttcttgtgcctcctacaacaccagacttttctagttccttctccaattttccttctttgttttcttctttgtacatctgcaaatcttttagggtaccttt

SEQ ID NO: 355 - DNA, 556 bp, Solanum lycopersicum
cccaatctccaatggcaaaatccacaaaaattctctcatcaatcctcattctcttcttcattttcagtctattttcttcatcaaacgcattaggcggaaagctcggcggaagaacacaaatcaaagacgtgaaaacaaatcaggaaattcaagatctaggtaagtactgtgtcgaagaacacaacagagatttgcggcatatcaatggtgctttgagttctttattgagtttttctcaagttgttgaagcagaaaaacaagttgtttctggtgttaaatattatctaaaaatctcagctattgttaaatcatctagctcaccaaaattgttcgatgctgttgttgttgttaaagcttgggagaagaagaaggaattgcttacgttttctccttctccttcaccggctacaaagtgaattttcgatggttgatagtggctaaaagttaaaacttctagtagtgctaatgttgtttaatctaattttgaagtactttaatttgtagcctttttattttttttaacctattttgagttctcttgtgtactatgtgatgc

SEQ ID NO: 356 - DNA, 371 bp, Arabidopsis thaliana
aaccctaaaccctaattgatcggccagaaatggagggtttggagaagttttacagcaagatggtgaaagaagcgaaatcggcagcttcttcttcgtcgtcttctctatctgattttgcggataatctgatgcaagacaaacgagccgccgccggcaacttgactactacatacgacgcaggatccggcactctggtaaccagacctcccagcggagtttcggtctggacgtgttcaaagttgtgcgctgttttctttgtcgctggagtgtttgtgggttatacacttaagagacgggttcgacgctgggcttctaaattactgagaagaataaaggatgattaactccaacctcgtctcctactgcaatag

SEQ ID NO: 357 - DNA, 1111 bp, Arabidopsis thaliana
tccaactccaactaacaacactcttcttcattcttcttcaatcaatggaatctgaaatcgcctccgagtttcttcctttctgccggatttacaaagacggtcgtgtagaacgactcatcggcaccgataccatcccggcctctctagatccaacatacgacgtcgtttcaaaagacgttatatactcaccggagaataacctctccgttcgtctcttcctccctcacaaatcaacaaaactcaccgccggtaacaagctccctctacttatctacatccacggcggagcttggatcatcgagtcacctttctccccactctaccacaattacctcactgaagtagtcaaatccgctaactgcctcgctgtctctgttcagtatcgccgtgcaccggaagatcctgttccggcggcttatgaagatgtatggtccgcgattcagtggatttttgctcattctaatggatctggtcctgtagattggattaacaaacacgccgatttcggtaaagttttcctcggcggagatagcgcaggcggtaacatatcgcatcacatggcgatgaaagctggtaaagagaagaagctagatctcaaaatcaaaggtattgctgttgttcatccagctttctggggaacagatccggttgatgaatacgatgtgcaagataaagaaacgagaagcggaatcgcggaaatttgggagaagattgcgagtccgaatagtgttaatgggacggatgatccgttgtttaatgtaaacggatccgggtcggatttttctgggttgggatgtgataaggttttggttgcggtagctgggaaagatgtgtttgttaggcaaggattggcttatgcggcgaagctggagaagtgtgagtgggaaggtactgttgaggtggttgaggaagaaggtgaggaccatgtgtttcatttgcagaatcctaaatctgataaggctttgaaattcttgaagaagtttgtcgagtttattattggttgaaacttgaaagaatgttttttgtgtaaatgttcttcatgatcatgtaatcttgtttttaagaaataaaatacatgaatttcagactgtgtgagagttatatgaacctg

SEQ ID NO: 358 - DNA, 649 bp, Arabidopsis thaliana
ctcgagagagaagtagcatttgctactttacccaaaatccctaaccacataataaaccaaacccaacaaagaaaataaaatttcaaaccaaaaaaaaaaaaatgagaactttagaagaatcgaagatctctattgtcttcttgttgcttcttctcttctcaatcttcatcagttccagtcaccaggcaaatgaggtattaccagctgaaggagataatgagatgatgatggtgccattgggggaggagaagtttatggtaatgaatgaaacaagaaggaaacttggaagttttcagatatgttcagtttgtacttgttgtggtggtgctaaaggtctttgcttgccttctccttgttgctatgctattaactgcaatatccctaatagaccctttggttactgttctttcactcccaaaacttgcaattgctttggttgccatatctgagatcttctacttcattgtaatttgggagagaaacaagtgaatctaaatcttgattcatcttcaagtgtgaaagggaggaaaaaaagaagaatatctgttcttggtttgagtcttctacttattttttgtctataatttatttttcagtcttcattaaatttcattacctactatctcagcaacatcatcatcctcattaa

SEQ ID NO: 359 - DNA, 1525 bp, Arabidopsis thaliana
tgtgggagttgattgataagagttgttaagatggcaaatgatgcggctgcatgtgcagaaagggctacaaatgatatgctgattggtccagattgggctattaacattgaattgtgtgatcttatcaacatggatcctagtcaagcaaaagaagctgtgaaggtgctcaagaagcggttaggaagtaaaaactctaaagtccagattcttgcactttatgcattggaaactttaagtaagaattgtggcgaaaacgtgtaccagcttatcattgaccgtggtctattgaatgacatggtcaaaatagtgaagaaaaagccggaactgaatgtgagggaaaagatactaactttgttagacacatggcaagaagcctttggtggacgtggaggtcgatacccacaatactacaatgcctataacgatctcaggtctgctggaattgagtttccgcctcgaacggaaagcagtctatcgttctttactccaccgcagactcagccagatgaagatgctgctattcaggcttcgttgcaaggagatgatgcttctagcctcagcctggaagagattcaaagcgctgagggatcagttgatgttttgatggacatgcttggagcacatgatcccgggaatcccgagagtttaaaagaagaagttatagtagacttggttgagcaatgtcgtacttatcaaagacgtgtaatgactcttgtgaacactacaacagatgaggaacttctgtgtcagggattggcattaaacgataatttgcagcatgttcttcagcgtcacgatgatatcgcaaatgtcggctctgttccttcaaatggaaggaatactagagctcctcctccagttcagattgttgacatcaatcatgatgatgaagatgacgaatcagatgatgagtttgctcggcttgctcacaggtcttcaacacctacaaggagaccagtacatggtagtgattcgggtatggtggatatccttagtggggacgtctataaacctcaaggcaactcctcctcacagggagtaaagaagcctcctcctcctcctccgcatacttcttcttcctcttcttctcctgttttcgatgatgcaagtccacaacaaagcaaatcctctgaggtaattaggaatcttccacctccgccttcaaggcacaaccagaggcaacagttctttgagcatcaccactcgagtagcggctcagattcctcttacgagggacagacccggaacctttctttgacaagtagtgaaccgcagaaagaagagaaaccagaggatttgcttttcaaagacctggttgagttcgccaaaaccaggtcctccaaagccaacaataataataggtcgctctgagtcttttgtttgtggctttttaccattcaagttttttttttcttttgggttttcagagagtgatgatgatattagagtgtgccttattatttagagatagtatctgataataccaacaaccatatgttttacttctctaacttcactccaagga

SEQ ID NO: 360 - DNA, 321 bp, Arabidopsis thaliana
aaacatttagggttcctccttccttgagagttcaggtcaagctttctttccaatttcgccatgccagaagaagatgttgttgatcagaaaagatactttgaggaatcttgcaaaccaaaatgtgtgaagccactacttgaatatcaggcgtgtgtcaagaggatccaagatgatgagtctggccacaaacattgcactgggcaatattttgattactggcattgtgttgacaaatgtgtaagtgtgtgagtgctgtttttctgtatacacctaaagtttcgcgaaactaaaatgacaaagacagctacttggagtctatag

SEQ ID NO: 361 - DNA, 2004 bp, Arabidopsis thaliana
cagaagctatcgtaatcagttctcatctctatgaccggactatccgtagagaaaaccgggtcgacccggtccactgtcttcttcatcatctttaatctatccatttttagtttatcgattgaagcaaggtcgaggcaacaacatgctagctttcctccaagaggatggaattcgtacgattccttttgttggactatctctgaagctgagttcttgcagagtgctgaaattgtttctaagcgtcttcttcctcatggttatcagtatgttgtggtggattacctttggtatagaaagaaagttgaaggagcttatgtggattctcttgggtttgatgtgattgatgaatggggaagattgcatcctgatccaggtagatggccatcttctagaggcggtaaaggtttcactgaagttgctgagaaagttcatagaatgggtttgaagtttgggattcatgttatgggaggaatcagcacacaagcttataacgcaaatagtctcgttatggatagtgttaagggaggtgcttatgaagaatcaggtagacagtggcgagcgaaagatattgggatcaaggagagggcttgtgtttggatgtcgcatgggttcatgagtgtgaataccaagttaggtgcaggaaaagcattcttgaggtctctttatcgtcaatatgcagaatggggcgttgatttcataaaacatgactgcgtatttggcactgacttcaatatagaggagataacttatgtgtcagaggttctaaaggagcttgatcggcctgttttgtactccatatctccagggacgagtgtgacacctacaatggctaaagaagttagccaattggttaacatgtatagaataacgggtgatgattgggacacatggaaagatgtcacggcacattttgatatctcgagagatttatctgcttctagtatgattggtgcacgagggttacaaggaaaatcatggcctgatctagatatgttacctcttggatggcttactgatcaaggttcaaatgttggacctcatcgagcgtgtaatctaaatcttgaagaacagaagtcacagatgacattgtggtccatcgcaaagtcccctctcatgtttggaggtgatgtgagaaatctcgatgccactacttataatctgatcacaaatcctacactgctggaaataaactcttatagctctaacaacaaggagtttccttacatcaccgcgacaagagtttctaggaataagcacaaaggctatcctcatcatccaacgggcaagaacatttcaactaagcatgcttttggtctcactagctgcaaagaacaaaaagccaacacttggttcattgtagacaagaaccgtggacaaatttgttggaaccaacactctagtgaaaaattagagaagccattttgcttatacaacagaaaagctcttctagcttccgataagaagttaaaacacaaccagctttaccaaggtaagcttcatttgcatacaaatgataaagcacagtcttgtttagcagcttcctcgcagcaaaagctcacttcgaaagattatagtcaaggtgctttatcaccttgcaaactagatgcaaaccagatgtgggagctccacagtaatggaacactggaaaacagttattccggtctttgcgctgtgttaaatccagtgaaagcagccgaagctagctccaatggcgttcgttcttggattgccacgggaagaagaggagaagtatacgttgcgtttttcaacttaaatcaggagaagacaaagatatcagccaagatatctgacattgccacggctcttagaggcaagaagaatcttgtaggagcttcgtgtacgagccacgagctatggagcggcaaagatttcggaccaacaaaagattcagtatcgattcaagtcgaacctcatggtcctgctctgtttgttcttcattgtagcaacgcctgactatatcagatcaacaggcatttcttttag

SEQ ID NO: 362 - DNA, 1175 bp, Arabidopsis thaliana
agccactccactaattacaagctccaaaagctttctccttctttttctctctaatctctatttcgtacggatttctctaaccggagcgatggagattgacggtggagatcgtatttccggtgaacgaccgatcattatggtcaccaacgacgacggaatagacgcgcctggccttcgttctcttgttcgtgtcctcgtctccactaacctctacgatgttcgcgtttgcgctcctgattcggagaaatctgctgttagtcacagtataatatggagtagaccactcactgcaaaacgagtagagatcgatggagctactgcttattctgttgatggaactcctgcggattgcactggtttgggcttatcggaagcactctttccttctcgtcctgacctggttctgagtggtataaacgtgggtagcaactgcggttataacatcgtctattctggaactgttgctggcgctcgtgaagccttcctttatgatgtgccttctgcctccatatcatatgattttgattggaaacgtggagagatgaatgctaatgattttgccctttctgcccaagcctgcttgcccattatcaacggcatactcggtgcaatcaagaacaaaactcaccctatgcaatgctttctgaatatcgatttgccgactgatattgctaaccacaagggatacaaactaactagacaaggtaaaagcatgggtaaaatgggatggagacaagtggaagaggaagcacaagggccgaagatgttatcaacaatgacaatggatacagagtcaggagtagtctcatcagagaacgacacatctgctcatgcgggaaaagatagccgtttattcaaaagagagttaagggcaagcatcagtgaagaagggagtgattctcattacctaaaagaaggatttattacggtcacgccgcttggagctctatctcagactgatgtggattgccaaaactactacaaagaatggcttcccaagattacaaaccagtcatgctcctcctcatccctttgatgctacaacatgagagaaaataaaaactctattaggaaattacccattgtggaccacaatttgtggtagacctattattatatcagtaccagttctttagttttcttaagtcttgacttactattgttgtgagcagcaa

SEQ ID NO: 363 - DNA, 2377 bp, Arabidopsis thaliana
cctccatttctgatagcttacgcagcttcagactcgggttcttcttttcgatctagcctccgtcctctttcttcttaccacggatctcgcctgctctttttccgtacgacggtctgctttgtggatagtttggctgacgacgaggcgatttgaacattaacagttactgggtaattgccaaggatggagggtttcctaacggatcagcagagagagatgatgaaagttgcaactcagactgcagatgatcttccaccctcacaaaaacctcactcggttttacttgagcatctgcctaaaccatctggtggtgggaaagcttctggtgcgtcaaatgctgtgaagcacagaaggtctcatgcgggaaggtctattcgctctaagaaggatggaggtggtgggaaaggaaattggggaaaacttattgacactgatggagactatcacattgacccgaatgatcctaattatgacagtggagaggaaccattcgagcttgttggtgcaactctgtcagacccattagatgattacaagaaagctgcagcttccatcattaacgaatacttcagcaccggtgatgttgatgtggcagcagctgacctcattgaacttggttcaagtgaatatcatccctacttcatcaagcggcttgtctcggtagcgatggacaggcatgacaaagagaaggaaatggcctcggttttgctttccgcattgtatgctgatgtcattaacccgaaccagataagagatggatttgtcctgctgctcgagtcagccgatgactttgtggtggatatacctgatgctgtcaatgttcttgctttgttccttgcacgtgctgtcgtggatgacatacttcctccagcttttcttcctagggctgccaaggcacttccaataacttctaaaggttaccaggttgtccaaactgcagagaaaagctatctatcagctgcacaccatgctgagctagtagaaagaaggtggggtggacagactcgaaccactgttgaggaagtcaagaagaagattgctgacattttgaatgaatatgtggagactggagagacttatgaggcatgtcgttgcgtaagagagttgggtgtttctttctttcaccatgaggttgtgaagagggccttagttactgccttggaaaaccacgcagcagaagcacctgtattgaaactgctaaatgaagcagcttcagaaaacctgataagctctagtcaaatggtgaagggattttcaagattaagagaaagccttgatgatcttgctcttgacattccttcagctagaaccaaatttggtttgattgtgccaaaagctgtctcaggtggttggcttgatgcttcgtttggttatccctctggtgaatgtggacgacaacagaacgaggatgagaaactaaagcggttcaaggaagacattgtgaccatcattcatgagtatttcaactctgatgacataccagaactcatacgcagtcttgaggatttaggagcacccgagtacaacccaatttttctaaagaagctgataacacttgctttggacaggaagaatcacgagaaagaaatggcatctgttcttctctcatctcttcacatcgagatgttcaccacagaagatgttgcagatggtttcgtcatgctcctggagtctgcagaagatacagctcttgacattctggatgcgtccaacgaacttgctctgttcttagctagagctgtgatcgatgatgttttagcaccttttaacctggaagagatcagtagcaaactacgccctaactcaagcggaactgaaaccgtgaagatggctaggtcactcatctttgctcgacatgcaggagagaggcttctaagatgctggggaggtgggagcggttgggcagtggaagatgcaaaggacaagatatcaaatctcctggaggaatacgaaagctcagggctggtatcagaagcatgcaaatgcatccatgagctaggcatgcctttcttcaaccatgaggtggtgaagaaagcactggtgatgggtatggagaagaagaaggacaagatgatgctggatcttctgcaggagagtttcagtgaaggactcataaccacaaaccagatgaccaaagggttcacaagagtcaaagacggacttgaagatcttgctttagacatcccaaacgcaaaggagaaattcaacgactacgtggagtatgggaagaagaatggttgggtttcgtcgtcgtttttaacttccctaactgaagatgctaatgtaggctagagatcaagaggagatatcccaaatggtgtgtgaactaaaaaaaactgatagaatgtacaagtctctttctctcttgagcatccct

SEQ ID NO: 364 - DNA, 682 bp, Arabidopsis thaliana
aaaggatccaacttagggttcgttatcatcgccatctcgattctcctaaatcataagcgatgttatctccgattgagaatgagagatccgaaattccttcccctgagaagctgaagttagtggaggagccatccgacgatgaatctaagttctctaattatgattcggacgattgggaaactttgtcagatgatcttcgactgttagatgaagagtggggcaagagcgggggttttgatgtggacttctcgaaagtgcgtcacagatttggtcgcggagctgttcatctcgacgacgacaatatggttagcgagcctcatgagaccaacagagatttgctcaacaggttgtccaacatggctatctccttctacaacgacaagacggggataaaactggaacttgtcaaggttttgagagcaaattttcacccatctgctgcaatcacactctacatcacgtttgaagccaatgacccttcagatggtaaccagactaaacgttaccaagcagtggttcgatacttgtcctttgatatcgaagtttgctcttgcaatcctgaaccatcttcttcttgaattctcttctgaaagttttccaccggcgagtttatgcatctatctatctatctatctaggggaagcaaaagggcactagcaagtttcaatttgttctcgagttt

SEQ ID NO: 365 - DNA, 971 bp, Arabidopsis thaliana
ctaattccttgcggcttcttcttcttcctcctcctccattcctctgtaattatcaaatgtttggtgtttcgatgagaacattaatctcaccatctcttgctcccttctctcttcatctccataaaccctctctcttctccaccgctcttcgcttctccttctcaatcaacaacataacccccacaaattcacctccttccaccatttccaccagaaagctacaaacgaaagcgacgagggtaacatcatcatcatcatctcagccgctctcctcctcatctcccggcgaaatccacgtcgtagtcggtccaatgttctccggtaaaacaacaacacttctccgccgtatactcgccgaaagagaaaccggtaaaagaatcgcaatcatcaaatccaacaaagacacaagatactgcaccgaatcaatagttactcacgacggtgagaaatacccttgctggtcactccccgatctctcgtccttcaaagagagattcggattcgacgactacgagaatcgattagatgtgattggaatcgacgaagctcaattcttcggagatctttacgagttttgccgtgaagctgctgataaagagggtaaaactgtaattgttgctggattggatggtgattttatgaggaggaggtttggttcggttcttgatttgattccgattgcggatacggttacgaagctgacgtcacggtgtgaggtttgtgggaagagagctttgtttacgatgaggaagacggaggagaaagagacggagttgatcggtggtgctgaagtttatatgcctgtgtgtaggagtcattacgtttgcggtcaaaacgttttggaaaccgctcgtgccgttttggattcaagcaataatcatagtgttgtagcaagttcactttagtttgtaggatttgagagtgtttagatatttggtttattagctttgagatatttggaattttaaaca

SEQ ID NO: 366 - DNA, 1227 bp, Arabidopsis thaliana
aagcatctttcttgatagcaccaagtatgatttgatcatcaaaagggtttggatttgacaggtctctattttaggtttgtttttggttagaagttaaaaccaaaataaaatcttaacttttggaaatgggatctgttactgggttttactcaaatgaagtgtttgaattagatcctaaatgggttgttgatcctcaacatctctttgttggtcccaagattggtgaaggtgctcatgccaaaatctatgaaggaaagtataagaacaaaacagttgctattaagattgttaaaagaggagaatctcccgaagagattgcgaaaagagagagcagatttgcaagagaggtctctatgttgtctagagttcaacacaaaaatttggtcaagttcattggagcttgcaaagaaccaatcatggttatagtcaccgagcttttactcggtggtacattgcgtaaataccttgttagcttgcgtccagggagtttggacatacgtgtagctgttggatatgcccttgacattgctcgggcgatggaatgcttacactctcatggagtcatccatcgcgatctcaaaccagagagcttgatcttaactgcggattacaagactgttaaactagcagattttggtttagctagagaagaatcattaaccgagatgatgaccgcagaaactggtacatatcgttggatggctcccgagctttacagtacggtcacgttgaggcatggtgagaaaaaacactataaccataaggtagatgcatacagcttcgccattgtcttgtgggagcttatccacaacaaattaccttttgaaggcatgtcaaatctccaagccgcttacgctgctgcattcaagaacgtgaggccaagcgcagacgatttaccaaaggatttagcaatgattgtaacatcttgctggaaagaggatccaaacgatcgaccaaacttcacagagattattcaaatgcttctacgttgcctctccacagtctcatcaactgagcttgttcctccggccattaaacgtgttttctcgtcggaaaacacggtcttgccaccagaatcgccgggaacttgctcattgatgactgttagagacaaagatcagattcctaccgatgcaaactcggcgcagaatgaagttagaggaagcttcttcttcttctgctgctaatatttgatttattggttataaagtgaaacatgagagaatg

SEQ ID NO: 367 - DNA, 1476 bp, Arabidopsis thaliana
ttacaagatgaaccccaaaatcagaaaacccaataattcatcttcgaagaaggtcacagtttccgttctctctgttttcttagtgttcgtcttcgttaatactttcttctacccaagtttttactctgactctggctcaattcgacgcaatctcgttgattctcgagaaagtttccattttccgggaaattttcgtaaaacgaaggtttacatgtacgaattgccgacgaattttacttacggagttatcgagcaacacggcggagaaaaatctgatgacgtcaccgggttgaaatatccgggtcatcagcatatgcatgagtggtatctttactcggatcttacccgacccgaagttaaacgagtcgggtctccgattgtaagggtttttgacccggctgaggcggatttgttttacgtctctgctttctcttcgttaagcttgattgtggattcgggtcggcccgggtttgggtacagtgatgaggagatgcaggagagtttggtgagttggttagaaagtcaagaatggtggaggaggaacaatgggagggatcatgtgattgttgccggtgatccaaatgcgttgaaacgggtcatggatcgggttaagaatgcggttttgcttgtgacggattttgaccggttaagagcagaccaagggtcgcttgtgaaagacgtaatcataccttattctcataggattgatgcttatgaaggcgagcttggagttaagcagaggaccaacttgttgttcttcatgggaaatcgatatcgcaaagatggaggcaaagtccgagatttgcttttcaagctgcttgagaaagaagaggatgttgtgatcaaacgcggaacacagtcaagagagaatatgcgtgcggttaaacaaggaatgcatacgtctaagttttgtctacatctagctggtgatacttcttctgcttgcagattatttgatgccattgctagtttatgtgtcccggtgattgtaagcgatgggattgagctaccttttgaagatgtcatagattacaggaagttctctatattcttgaggagagatgccgctttgaaaccagggtttgtggttaagaagctgaggaaagtgaaaccaggaaagattttgaagtaccaaaaggttatgaaagaggttaggcgatattttgactatacacatctaaatggaagtgtgaacgagatctggagacaagttactaagaagataccgctaatcaaactgatgattaatcgggagaagcgcatgatcaagagagatggaagtgaccctcaatgttcttgtttatgctcaaaccaaaccgggatcatccatggtgtctagtaaggttaaatgcctagcaagctcatgctaagcaacaaaatgtgatcattattaatgatgaatcaaagactggaaaggaacaacaagagaaaccacatcactctctaattccgggtcaagggtttgatcaagaatgc

SEQ ID NO: 368 - DNA, 2279 bp, Arabidopsis thaliana
aaaggatccaattgtgttgttgcatagttccaataatggcaaagacgaatcaagccatcactatctgttcccttcttctgcttcttctactctctgaaacaacttctcaccttctttgctcagattcaaagactccagtcaacaacaacgagacactccagttctgcgattcctacaaagaaagatcttgctgcaattctaaagatgatcttcaattacagaatcgcttcaactccatgaacatctctgactctaattgttcttctcttctcaaatccattctctgttctaaatgtgatgaattctcaggacaattgtttggtgatgatgatagttctctagttccaattctctgcaactcaacatcacaagacttatgttcaaaactttgggattcatgtcagaacatttccattgtttcttctccttttagtcccactctacttggtggtgctacttcgccttcaacttcatcaaattcatcgacattaaccgatctttggaaatcccaaaccgaattctgtacagcctttggtggaccatctcaaaccaacaacaacaaaaccaaatgcttcaatggtgaaccggttaacagagacactagtgatgatgatgaggatgatgttaagacacctaaaggaatatgtcttgagaagataggaactggttcttaccttaacatggtcgctcatcctgatggttcgaaccgggcctttttctctaaccaacctggtaagatttggttaggtacaataccggatcaagactcaggtaaaccgatggaaatcgatgaatcaactccttttgttgatattaccgatcaagttagtttcgatacgcagtttggtatgatgggaatggcgtttcatcctaagttcgcagagaacgggcggtttttcgcgtcttttaactgcgataaagtcaaatctcctggatgctctggtcgttgtgcttgcaattctgatgttaactgtgatccttcgaagcttcctaaagatgatggcacgacgccttgtcgttatcagaccgttgtgtccgagtataccgcaaacggtacttcctcgagcccttcaacggcaaagattggtaaagcatctgaagtgaggaggattttcactatgggacttccgtattcttcatctcacggtggtcagattctctttggacctgacgggtatttgtatctcatgactggtgacggaggaggagtttcagatactcacaactttgcacagaacaagaagtcgttgcttggcaaaatcttgaggcttgatgttgatgttatgccaagcgtatctgaaatctctaagcttggtttatggggaaactactctataccaaaaaacaatcctttccaaggaaatgaaaatgagcagcctgagatttgggctttagggctacgaaatccatggcgctgcagcttcgattccgaaagaccagattacttcttgtgcgcagatgtcggaaaggatacatatgaagaagttgatatcataacaatgggtggaaactatggctggagaacttacgaaggaccatatgttttctcaccgttatcgccttttggagaaaatgtttcctcggattcaaacctgacattccccattctcggttacaaccactctgaagtgaacaaacatgaaggatctgcttccatcattggaggttacttttatcgatccaacactgatccttgctcttatggaacgtacttgtatgcagatctttatgcaaacgcaatgtgggcagcgatcgaatcaccagaagatagtggaaacttcacggactctctaataccgtttagttgcagcaaggattcaccgatgaagtgtaccgcagctccaggaggagctagctcaggacctgctcttggttacatttactcatttggacaagacaataacaaggacatacatttactcacgagctctggtgtgtatcgaattgttcgtcctagtcgctgtaacttagcttgctccaaggaaaacaccaccgcttctgccggaaaacagaaccctgctggttctgctcctcctcagcctttaccttcttctgcaagaaagctctgtttctctgtgtttttgttattgtcgttgttgatgatgtttttaacgttgttagattagaatgatgattgtttcagactctgttttgtaacagttcttatggatgttattcaaaaactattttgtgattgcttatattagacgaactcatatgtaataaaccattaagtttgagttcttttgtattgttatgtcgcagcaatgggtaccttt

SEQ ID NO: 369 - DNA, 1127 bp, Brassica napus
aaaggatccactccgaccactgttacatcacctctttctcctttcatggcggaagctaacaagacaagtagagaaattgcaagaagcaatagttgtgtgttcccaagagatctgcttcagagattcatctctaactcagccgaaggtgaagatggtgatcacgaggaagaagatgatgaagagatcgagttgaatctggggttgtctctcggcgggagattcggagttgacaaaagcaataagctcgtgagatcttcctccgttgtcgtgacgatgcctcttttccgggaagctcatcagccggagacgacgaagcctgcggagacagccgtagcgagaccgagacacacgggcttaacgagaacgacttcgttgccggcggagtcggaggaagagtggcggaaaaggaaagagatgcagactcttaggagaatggctgccaaaagaaggagaagcgagaagcttcgcaccggcggtggaaacagcaccaagtcaaccgaagctaataataatccgggagaagcggccaccacttcgaggcggcgaggtagaccgtcgtcgggacttccacggtggtcagcgacggctaacagtggtggactcttacggcaacatagcgctggtcatgagtcactacaaggctcccttgagtcccaaggcggcggcggcggtggtgtcggaagctcttcaagtgtctccgagttggaaaccaaatcccatcaagcatctagtgaagaagcaagaagcttaccgtcgacacaacaacaacaggaagcgatagcaaagccgaacactcggcttagaagattgagttcagtggacatgaagatagagccaccacaagggaaagggaaaaacgagatgccatgtgtgttcacaaagggagatggacctaacgggaagagagttgatgggattctttatagatatggcaatggagaagaagtgaggatcatgtgtgtctgccatggtgacttcttgtctcctgctgatttcgttaaacatgctggtggtcctcatgtagatcatcctcttaggcacattgttgtcaacacttcttctccttctaatctcttatagaaccccttcctaacccctctcctcatttgatccctttactcgagttt

SEQ ID NO: 370 - DNA, 1888 bp, Brassica juncea
gaattcgccctttcccttatttcttgaagcagcttggttaaaaacaatggttgtgtttgggaatgtttctgcagcgaatttgcctcatcaaaatggggttttgaaggcaatctcatccggaggttgtgatttaatgggacatcgcagcttcaaaatttcaacttcttttaagacaagaacaaggaggaggagtgctggtcctttgcaggtggtttgtgtggatataccaaggccagagctagagaacactgtcaacttcttggaagctgcaagtttgtccgcatctttccgtagtgctcctcgtcctgcaaagcctttaaaagttgtgatcgctggtgctggattggctggattgtcaacagcaaagtacctggctgatgcaggacataaacctctgttgctcgaagcaagagatgttcttggtggaaagatagctgcatggaaggatgaagatggagattggtatgaaaccggtttacatatatttttcggtgcttatccgaatgtgcaaaacttgtttggagaacttgggatcaatgatcggttgcagtggaaagaacattccatgattttcgccatgccaagtaaacctggggaatttagtagatttgatttcccagatgtcctaccagcacccttaaacggtatatgggctattttgaggaacaacgagatgctgacatggccagagaaaataaagtttgctattggacttcttccggctatggtcggaggtcaggcttatgttgaagctcaagatggtttatcagttgaagaatggatgagaaagcagggagtacctgatcgcgtgactgatgaggtgtttattgccatgtcaaaggcgctaaactttataaaccccgacgaactttcaatgcaatgcatattgatagctttaaatcggtttcttcaggagaaacatggatcgaagatggcattcttagatggtaatccgccggagaggctttgtatgccaatagtggaacatattagatcactaggtggggaggtaagacttaactcaaggataaggaagattgagctcgagaatgatggtaccgttaagaatttcttactcactgatggcaccactatccaaggagacgcttatgtctttgccactccagtcgatatcctgaagcttcttttacctgattcatggaaagagataccatacttcaagagattggagaagttagttggtgtgccagttattaacgttcatatatggtttgatcgaaaactaaagaacacatatgatcatttactctttagcagaagtaaccttctgagtgtgtatgctgacatgtcgttaacttgtaaagaatatcacgatcctgaccggtcaatgctggagctagtatttgcacctgcagaggaatggatatcaaggaccgactctgacatcattgatgcaaccatgaaagagctcgagaaactcttccctgacgaaatctcagctgaccaaagcaaagctaaaattctcaagtaccatgtcgtcaaaactccaaggtcagtgtacaagaccatcccagactgtgaaccatgtcgtccactacaaagatctcctattaaaggattctacttagctagggattacactaaacagaagtacttagcttccatggaaggcgccgttctctctggcaaattctgctcacagtctattctacaggattacgagctattggctgctgcgtctggaccgcaaaagttgtcggaggcgactgtatcaacataagacaggaaaagcttaaatatcattgccgttttgcctgtaagcactgttttgtgtacaaaccttatttcaatagcaaagttacagatttggcaaaaaaggaaacaagggtatattgccaggaaaatatgaatcacttagggtaccttt

SEQ ID NO: 371 - DNA, 1117 bp, Brassica juncea
taacctcatagtgtcgacatggcttgcaaaaacaatcttgttgtgaagcagatcatcgacttatacgaccaaatttcaaagctcgagtgtttgaaaccttcaaaaaatgtcgacactttgttcggacaactcgtgtccacgtgcttacccacggacacaaacatcgatgtcacaaagatgagtgatgaagtcaaagacatgagatctaacctcatcaagctatgtggtgaagccgaaggctatttagagcaacacttctccactatcttggggtctttaccagaagaccaaaacccacttgaccatttaaacatctttccttactacaacaactacctcaagctaggcaagctcgagttcgatctcttgagccaacactcgagccatgttcccaacaagattgcctttgttggctcaggaccgatgcctctcacatccatcgtcttggccaagtttcacctcccgaacacgacgttccacaactttgacatcgacgcacacgcaaacacactcgcttcaagcctcgtctctcgcgatccagacctctcaaaacgcatgatcttccacacaacggacgtgctaaacgctaccgaagggctagaccaatacgacgtagttttcttggcggctctcgttgggatggacaaagaggcaaaggtcaaagccatcgagcacttggagaagcacatggctcctggagctatcctcatgctgaggagtgctcatgctcttagagctttcttatatccaatcgttgactcttctgatctcaaaggtttccagctcttgaccatctatcatccgaccgatgatgttgttaactcggttgtgatcgcacgcaagctcggtggttcaagcatgaccggagtcaatggtactcgtggatgcatgttcatgccttgtaactgctctaaggtccatgcgattatgaacaatcgttgcaagaagttgatgatcgaggagtttagtgccatcgagtaatcaaagcaagtaattactgaacacatctcatctcttgagactatgtgttaatgttttgtcttatattaatttttctttttaatttcatgtgatcttgtgtgttttctgacgtgtgtggttcgtataagttggtgaa

SEQ ID NO: 372 - DNA, 1401 bp, Brassica juncea
gagagaaagaagtaagaaatggcgaccacccccatgtgcactgagtggcagttcagcgggagcgaggcagccaaagaagctgctgcggccgccctaggtgcctacacctctaaactcatgtctctttgtgatcctaatggtaagcccattttgcccccgagtaacaaggccgtggagaccagcaattcagccgaaaaagctgttgttaaagttattctctccggcactggaaacgcctatgctcctagcattggccttccgctcgccaaaagtgccgtagcagagtatctaaacagagatcttccaaagaaactaacagcagatgacgtgtttatgactgttggatgcaaacgagcaattgaccttgcggtggatattctggctaaaccaaaagccaacgttttgcttccgaggccaggcttcccgtgggatgtagtacgctccatctacaagaaactcgaggtccgttactatgatttcatccctgaacaaaactttgagatcgacttcgaaagcgtcaaaaaggtgacagacaagaacacgtttgctatatttatcatcaaccctcacaatcccaatggaaacacctactcggaggctcacctcaaacagctcgctgaattggctaaggaactctcgattatggtggtttctgatgaagtttttagatggaccgtcttcgggaataacccttttgttccgatgggaaagttttcttccatcgtaccagtggttacactcggatccttatctaagggatggaatgtcccaggatggcgaactggctggctcgcgctgcacgatctagacggtgtcttcagaaacactaagatattacaagctgcccacgaatttctccagataaatgccaaacctccgactgttattcaggcggctatgcctgacattttggagagaactccaaaacatttcttccatgagaggggaagttttctgaaacataaagtagatattggatattctaaggtcaagcacatacctggcctcacttgttacatgaaacccgaagcatgcacctttttatggaccaagttggatgtatcgtgctttgctgacattgaagacgatcaagacttctgcaggaagctcgctatggaagaaaatctcgtcgttttgccagggattgcatttaggcagaagaactggttgaggcattctatcgacatggagacgccaacagttgaggacgcatttgaaagattgaagagcttctgtgaacgccattccgttgaaggtggagcttcactcaaaaacgtcaatggcgtgaactaaaaggtcaacatgatttagtttacaaaaaaaaaggtcaacatgatgatctttgtctaagtctattaaaaataaatgggtgtttttggtaacgtgagataaatcatgaac

SEQ ID NO: 373 - DNA, 503 bp, Brassica juncea
ttggatccgtacgcggggaaagaaacattacttgcgaccaaaaattacagattcttgaaactattagtgttgatacttgatagataccatgggcttactagatcatctctgggatgataccgtcgctggtcctaggccagagaacggccttggcaagcttcggagacaccataccttcagtttccggcctagctccggtaatgatcaatcggacggtggtagcgtgagatcgtacggtgaagaatcgccggaggaggccgtgaaagtgacacgtagcatcatgataataaaaccaccgggataccaaggcggttcagctccggtttcaccagccggttcaactccgccagtatctcctttctctgagcaaacgcaggaggaaaggaaccctttcggtttaggagaaggtcgacgtcggacgcgttcgataagggagcaggatcagagaatggaccaaggaactctcctcctacttacggcctgtgatctctaataactcgagt

SEQ ID NO: 374 - DNA, 426 bp, Brassica juncea
acaaagacgagatttcaagacgcggaaaacatagagagaagaaacatatacctcaaaagcaccaaacacaaaccaaagaagaagaacacaatatggtgtctcaaaagctggagatttgcatcgaattagtgaagtttgccgtcgtttttgtagccaccgtggctgaatcagtagaaaaggctttccggaagcctttgccggcgcttccagcagttcatgatggtagccggaatacttactcggccgttcccattcctcttgttggattcatgtgatgagctttcttttgtttgtttattttatttttcttctcttttttgggttttgacctcgttaaagttaggagtggcgttttgaagttgttgatatgtgtatacgcataatcaaagtaatcatgaagagttgcagatgaatcaaaccgttgaa

SEQ ID NO: 375 - DNA, 518 bp, Brassica juncea
gaaaaatgagtggctccgttgcgcagcttcacaatgttttcgtctatggtagctttcaagagcctgaggtcgtcaaggtcatgcttgatcgtactcctgaaatcatccctgtaacactccctggctttaagaggtttaggcttaaaggacgtttgtatccatgtgttataccgtgtgaagatggagaagtcaaaggacagttactaatgggattaacggatgaagaacttgagaatgttgatgctgttgagggtaatgaatatgagagagtgacagttggtgttgtacgagaggacaattctgagaagatgactgtgaaaacatacatatggctcaataaagatgatcctgatatcggaggagaatgggatttcgaggaatggaaacgactacacatgaagctattcatagagaaattcaaagaaatcatggaatggaagaggaatcctcaaggaaagggaagggacgacttcaaccatgtcctacgcgatgctccatcggcttgaattgaatcttga

SEQ ID NO: 376 - DNA, 1718 bp, Brassica juncea
acgctacaacaatggcgtctctcgctctctccggctcctgctctctcgccttccccctcaaatctcgctccctcctcctccctcgtcctccctcctctctcaatctgctgaaaaaacctctccgacgcatctcctcagtgaaatctccactctccgtctctctcaccaactccaagagatcgactctcgtcagagcctcctccgtcgccgccgcagcttcctcctcctcctcctcatctccatcccccgccgccccagctccggccccgtggcaaggagccgcgatcaagcccctcctcgcgtcgatcgccaccggcgtcatcatctggttcctccccgtcccggaaggagtcacacgcagcgcgtggcagctactcgcgatcttcctcgccaccatcgtcggcatcatcacccagcccctccccctcggcgccgtggctctcctcggcctcggagcctccgtcctcaccaaaaccctgacgttcgccgccgccttctccgccttcggagaccccatcccctggctcatcgccctcgccttcttcttcgcccgaggcttcatcaagaccggcctcggcaaccgcgtcgcctaccagttcgtccgcctcttcggcagctcctccctcgggctcggatacagcctcgtcttcagcgaggctctcctcgctcccgcgatcccctccgtctcggctcgcgccggcgggatcttcctccctttggtcaaatccctctgcgtcgcttgcggtagcaacgtcggggacgggaccgagcaccgtctcggctcgtggctgatgctcacctgtttccagacctctgtgatctcttcgtccatgttcttgacggctatggcggcgaatccgttgagcgcgaacttggcgtttaacacgattaagcagacgattgggtggactgattgggcgaaagccgcgattgtgcccgggattgtgtcgttgatcgttgttccgtttcttttgtatgttatctatccgccgacggtgaagagcagccctgatgctcccaagctggctcaggagaagcttgataagatggggcctatgtccaagaacgagttgattatggctgccactttgtttctcactgttggtctctggatctttggagctaagctgagtgtagatgctgtgactgcagccattcttggattatcagtgcttcttgtgacaggtgttgtgacgtggaaagagtgcttagctgagtcggttgcatgggacacgctcacttggttcgctgctctcattgcaatggctggttatcttaacaaatacggtctcatcgagtggttcagccagaccgttgtcaagtttgtgggaggattgggtttgacatggcaactatcgtttggaatcctcgtcctcttgtacttctacactcactacttctttgcgagtggagctgctcacatcggagctatgttcactgcctttttgtctgtctcaaccgctctaggaacaccaccttactttgcagccttggttcttgcattcctctcgaacctgatgggaggactgacccattacggtatcgggtctgcgcctatcttctacggggctaactacgtgccgctggcaaaatggtggggctatggattcttgatctcgatagtcaacattcttatctggcttggtgtaggtggtgcctggtggaagttcattggcttgtggtgagtgggatcaccacacagtagcattctcatttag

SEQ ID NO: 377 - DNA, 732 bp, Brassica juncea
tggaagagaatacaaaatggcaacgcgaggagctgctgctgcgttcgtaatatggaagcaccgaaacaacccttctcttcgatcgatatcatcgcaccatttctatcccattttcaaacctcaaatgatcccaaaagggtgtagatatcaaattagggcaatacaaggagaaagtgttgatcgcggtacacaatcgaagaacaacgatgagccaaaaccaaaacctgagaattggaaaatcaaaatgctttacgatggggattgccctctctgtatgcgtgaggttgatatgcttaaggaaaggaatgaggaatatggaacgataaagttcgtcgacatcagttccaatgattattccccgcaagagaatcaagggcttaattacgaaactgttatggggcaaatccacgcgattcagtccgatggaaatgtggtaacgggtgtggaggcaattaggaaactatatgaactggttgggcttggatgggtttactctatcactaaatttgaaccaatagggaaggtagctgatgcagtgtatgatttctgggctaagtatcgacttcaggtcacagggcggccacctatagaagctattcttgaagcgagaaagaaaaataaggtggagacatgtggtgacagtaaggcgtgcaagacgtgatttttcttacaaattacatataccacaaccagtttgtagttacatatgctctgttttcccgcattatgtaa

SEQ ID NO: 378 - DNA, 867 bp, Brassica juncea
aaaggatcccttctatgttcgtctacgactcctatctaaccttaatcatcatcccttgtgttggcttctttaagaacttgctttccaagcaaagctcgaaaaaacaagaaagtaaaaggtatggcgtcgaacaacagcaacgatgatttgtatgctgttcttggtttgaacaaggaatgtacctcgaccgaacttcgcactgcttataagaagcttgctcttagatggcatccagatcgttgttcatcgatgggaaacttggagtttgtagatgaagcaaagaagaaatttcaggctattcaagaggcttactctgttctgtctgactccaacaagaggttcctctatgatgttggagcttataacagtgatgatgatgtcgaggaccaaaatggaatgggagatttcttgaacgaaatggctgcaatgatgaatcaatccaagcctaatgacaataattcaggggacagttttgagcagctacaagatttgtttaacgagatgtttcaaggagacgccgcggcattcccaccctcatcatcatccttctctgcttcaactttcgcttcctcttgtaactttgtctttgatacaaactatcagcagtcaccgtttgggatgggctcgatggggactagcgatcctttcggatttgactcaagatctcacaccttctctttaggggtggaacatcagcaggatttcaagaaagagaagaacaatggtggaagaaggaacagacggaagaacaatgctcaatcttctaacaactatggagtccctacttcatagcgcccttcagaccatattttttatttgtcgactagtcacaggactactggttatggtctcctctagctcgagttt

SEQ ID NO: 379 - DNA, 974 bp, Brassica juncea
cctttcggtttcgaaattagggtttcgctttgtcctctcctgtaatcctcagtttggaagatgcctaggtatgatgatcgttacgggaacactcgtctttacgttggacacttatcatccagaactcgtagcagagaccttgaacgccttttcaacagatacggaagagtgcgagatgtggatatgaagcgggactatgcttttgttgagtttagtgatccccgtgatgctgatgacgcgagacattacttggatggacgagactttgatggaagtcgcatcaccgtggagttttcaagaggggcacctcgtggctctcgggattatgatagcagaggcccacctcctggttctggtcgatgctttaactgtggtgttgacggtcattgggcccgagactgcactgcaggggactggaagaacaagtgttaccgctgtggggagagaggacacattgagagaaactgcaaaaacagtcccaagaagcttaggcggagtggaagctactccaggtcacctgtaagatcacgttctcctcgtcgtagaagaagcccaagccgtagcaggagtcttagccgaagccgaagctacagccgatcaagatcccctgtgaaaagaagagagagaagtgcagaggagagatctcgcagtccaaagcgaatggaggactctctgtcgccaagaggcagagaccgtagtccgattatggatgatgaaggtagcccaaggatcatagacgggagccctccaccatctccaaagcttgaaaagcaagaccatgatggtggtagccctcaagacaatgggaatggcaggaaaactaatgccagtcccgtggtgggacgcgacagtccgagagaggaccgaagccccgttgatgatgactacgaggccaaccgtgcttcccctagaggaagcgagtcaccttgactttgatggctcatggcctcaagtcacaggcacttagcatgttg

SEQ ID NO: 380 - DNA, 1433 bp, Medicago truncatula
taaacatggaactaagtatcatgttatgtttctttacttctattctcttcattgttctgttcagaatattcatcaaatcctttgtctcaaaaagacatgacttgccactcccacctggttcaatgggttggccttacataggagaaacttttcaactttattctcaagaccctaatgtcttctttgcatcaaaaatcaaaaggtatggttctatgttcaagtctcacattttagggtgtccatgtgtgatgatttcaagtcctgaagctgcaaaatttgtgttgaataaagctcaacttttcaagccaacattccctgctagcaaagagaggatgttgggaaaacaagcaatcttttttcatcaaggagagtatcatgctaatttaagaagactcgttcttcgtactttcatgccggaagccatcagaaatattgttcctgctattgaatccattgcagaagagagtcttaaatcaatggaaggacggttaatcactactttccttgaaatgaaaacgttcacattcaacgttgctctactctcgatttttggaaaagatgaagttaactacagagagcaattaaaacagtgttactacactctagaaaaagggtacaattcaatgccaattaatctaccaggaacactcttccacaaggcaatgaaagcaagaaaagagcttgcacagatcttagctcaaataatctcaagtaggagagagaagaaacaagattaccaagatttgttgggttcattcatggatgaaaaatcaggactaagtgatgaacaaatagcagataatgtaattggagttatttttgcagctcgtgataccacagctagtgtgcttacgtggattgttaagtaccttggtgaaaatatcaatgttctagaatcagtgattgaggaacaagaatctatattgaagagcaaagaagaaaatggtgaagaaaaaggtcttaattgggaagatacaaagaaaatggttataacttctagggttattcaagagactcttagagttgcttcaattttgtctttcacttttagagaagcagttgaagatgttgaatatcaagggtatcttataccaaaagggtggaaagtattgccactatttaggaatatacatcatagtccgaacaacttcaaagatccagaaaagtttgatccttcaagatttgaggctgccacaaaacccaatacttttatgccatttggcagtgggatccacgcttgtcctggcaatgaattagccaagatggagattttagtcctcttacaccatctgaccacaaagtacaggtggtctgtggagggtacaaagaatgggattcaatatggtccttttgctcttccccaaaatggtttgcccataacattatatcctaagaagtagatatcactccaacataagattgatcagccatag

SEQ ID NO: 381 - DNA, 1072 bp, Medicago truncatula
aaaggatccacatagaagagacacaccaacaagtttgaatcaagtgcaatcaacatcaactagagcaatggcaagtttcagtgcaaaatccatgactgtgttctttctcttcacaattatctttggttttggatttcttcatgcatctgcagaattgcaaagatttacacacacaccgaaaactgatggttctcttagtttcttggttattggtgactggggaaggaaaggtgaatacaatcaatcggacgttgctttccagatgggagtggttggagagaagcttgacattgattttgtaatttcaactggtgacaatttctatgatgatggcttaaccggtgaccatgatactaaatttgaggaatcattcaccaaaatctacacagcaaaaagcctgcaaaagcagtggtacagtgtgttgggaaaccatgactacaggggtaatgtagaggcacaattgagcccattccttagacaaattgataataggtggctttgtttaaggtctttcattgtagattcagagctggttgagattttctttgttgacacaacccctttttgtgaagactactttactgtaccagaacaccagtatgattggaatggaattaacccaccaaagacttatatttccaatttactaaaggatgttgaaatggcattgagagaatcaagagcaaagtggaagattgttgttggtcaccatgcaattagaagtgttggtcatcatggtgatactaaagaacttgttaacctgcttcttccaattcttcaggcaaatcatgttgatttttacatgaatggtcatgatcactgtcttgaacatatcagtgatacaaacagtcctattcagttcctggttagtggagcaggatcaaaggcatggagaggagacgtccgagaaaccggaaacgatgtaaatttcttctatgatggacaaggtttcatgtctgttcaattgactggaacagatgcagacattgtgttctatgatgtttctggcatggttttacacaaaaccacttcatcaaagcagctacattcttccatataataactcgagaaa

SEQ ID NO: 382 - DNA, 2051 bp, Glycine max
tgagcgaaactatgccatataccacaacacaacacattaatataccataacactcctattgttttgtttctgtgttccctacgttacacgcgttagtagttactcactttccttctcttcacaaacctacttgtttctctctcattttttccccactatagcatgtctctaagtctagccatcaaactacacctggcttcttcttctccttctttttccctccttaccctcaacaaccaccaacatgcaaacaagttaacaacttccgaaacttgttccaacaccaaggttcgtcccaaacccatttatagcaccaaccctttgatcattcccacgtgtaaagtgaggccaagagtgcaatactgtggcaccatgatcaagagttctttgatagagcctgatgggggggcattggtggatcttgtggtgcctgagggtgagaggggtgctaagatcaccttggctgagtcactgcctaaggtgcagctcacaaggattgatcttgagtgggtgcatgtggtgggggaagggtgggctagtcccttgaaagggttcatgagggaggatgagtatcttcagagtttgcatttcaattcccttagggtcaaggatggttctgtggtgaacatgtcccttcccattgttttggccattgatgatgagaccaaagagagaattggatcctcttcccatgtggggttgctcgggcctgatggagattgtgttgcaattcttcgaagtattgaaatctacaagcataacaaggaagaaagaatagctagaacttggggaacaactgctcctggattgccatatgttgaggaggtgattactccggcaggaaattggcttattggaggagatttggaagtgctaaaacctatcaaatataatgatggcctagataactacaggctctctcccaaacaactccgtgaagaatttgacaagcgtcaagcagatgcagtttttgcctttcagttaagaaaccctgtacacaatggtcatgccttgttaatgaatgatactcgtaagcgcctattggaaatgggctacaaaaatcccattttactgcttcatcctcttggaggttttgtaaaggctgatgacgttcccttggatgtcaggatggagcaacatagcaaggtcctagaagatggagttcttgatcctgagactaccatagttgccatatttccatcacctatgcattatgctggtccaactgaagtacagtggcatgcaaaggcacggataaatgcaggtgcaaatttctatattgttggtcgtgatccggctggtatgggccacccaactgagaaaagggatttgtatgaccctgatcatggaaagaaggtgcttagcatggctcccggtctggagaagcttaacattttgccattcagggtggcagcttatgacactaaggtaaacaagatggcatttttcgacccaacccgtgctaaagatttcctctttatatctggaaccaagatgcgggcttttgcaaaaagtggggagaatccgccagaaggtttcatgtgcccaagtgggtggaaggttcttgtcaaatattatgaaagtttgcaggcagaagagccatcacaacagcctgtgctatctacttagacattcttctaaaagtagaagcttagcatcaattgattccaatgggagagtgttaaaaacacatttctgggagtgccaatttttatgcctggtcttccagcttcatgatcaagatttaagcaatgcgctagcatatttgaattttttgtaccatattgaattgtccttttctttttaagttactatgactaaagaatttgttgtggtgcatcaagcataattgcagatgtagtcttctatctatggactcctgtaagaccagttcaataagggtgtgagaaattcagcagagccttggtgcttatggctatttagagaggggatatatgggatcaaggttttaaaaaacggttcgtaactgcaattgtagtcgcaacttgaaggattttgaggtatgtgtgaccacatcatgaccgtaattg

SEQ ID NO: 383 - DNA, 1702 bp, Glycine max
cgctctctccactctgtttccactgagagaaaaaaaaaaagcatgaagaaaatccgcaactcgatcctactcttatcattcgtgctggcagcctcggcggcggtttcatccgcagagcagattccttccgctgcttacgaccgcgtgctgttcccggaccgccggtgccagaagacggcgtcggagaacatgacgcggcgaggatcctctgcggcggcggcggagtgtgaggtgtggagtgagtcatgttcggaggcggtgctgagcgtggcgcggcggccggagacggcggagtggctgaagaagattcggcggaagattcacgcgaatccggagctggcgttcgaggaaatcgagacgagtggtttgataagagaagagttggatctgatggaagttagttatcgataccctctagccaagaccggtattcgagcctggatcggcacggggggtccgccttttgttgcgatcagagctgacatggacgcacttccaatccaggaagctgtggaatgggagtacaaatctaaagttgccggcaaaatgcatgcttgtgggcacgacgcacatgtggctatgcttatcggcgctgccaagattttgaaaactcgagagcatttattaaagggaactgtaattctgttattccagccagcagaggaagctggtaatggagcaaaaagaatgatgcaagatggtgctttggaggacgtggaggctatatttgcagctcatgtatcccatgaacatccaactggtataattggctcaaggcctggacccctccttgcaggttgtggattcttcagagctgtcattagtggcaaaaagggtcttgctgccaatcctcaccgttctgttgatccagttttggctgcttcagctgcagttatcagcttacagggtattgtctcccgcgaagcaaatccattggattctcaggttgtctctgtgacttcgtttaatggaggcaacaatcttgacatgatacctgactcggtggtcctattggggactttcagagcgttctctaacaccagcttttaccagctacttgaaagaatagagcaggtgattgtggaacaggctagtgtctacagatgcttggcagaagttgacttctttgaaaaggagtacacaatttaccctcccacggttaatgataaccgaatgtatgagcatgtgaaaaaggtgtccattgatttgctgggtcataagaatttcagggtagttccacctatgatgggtgctgaagatttctctttctactccgaggtggttccctcaggtttcttctacataggagtaaggaatgaaacactggggtctactcatacgggacactctccatatttcatgattgatgaagacgttctaccaataggtgctgctgctcatgctagtattgcagagaggtacctcattgaacatggttgatgttggaaaatagttgaaagaaccctgctcttgttgtcacgtcttctcaaattcgtacaaaattggtacacgagttcacccgtccccctcatgtttctcacacgagtaaattctcagtttagttcgtgatattgcaagtgtttgtcactttagttattaaattaataaaatctttactttagtctctacctttatataatcccattaactgtaaataacattttacaaagtcgaaagactaaattaaagatttcgagtggtc

SEQ ID NO: 384 - DNA, 1478 bp, Glycine max
cacagttgttctcatcgaagcagaagaagaagaaatggcgacttctctgcaactgttccaatgcaaactagcgagaccctttcggccattccctttgcgaaggtcaactccccctctgagtctgaggtgttgcgcttcgcccccttcttcctacagcatcactctcattcccggcgatggaatcggccccgaaatcatctccgtggccaaagacgttcttgtcctcgtgggttctctcgaagggatcaaattcgagttccaagaggttcttatgggtggagctgcattggatgccaccggagtccctttacccgatgataccctttctgccgctaagcaatctcatgccgttctgcttggtgctgttggaggttataaatgggataagaacgagaaacatctcaagcctgagactggcttgcttcagatacgtaaagagcttggagtatttgcaaatcttagaccagctaccgtgtactctccgttagtggatgcttcaactttgaagagagaggttgctgaaggggtcgatatcatgcttataagggaactcactggaggtatctattttggagaacccaggggctttggcaccaatgaaaatggtgaagagattggctttaatactgagatttacgctacacatgagatagatcgcatagctcactttgcatttaaggttgctcagaagcgttgtgggaaactttgctctgttgacaaagccaatgtactagaggcatcaatgttatggagaaagagatttttggcaatagcgcaagaatatcctgatgttgagctctcacatatgtatgtcgataatgcttcaatgcaactaattcgcgatccaaaacagtttgacaccatggtgacaaacaacatttttggcgatatattatcagatgaggcttcaatggtcactggaagtattgggatgcttccttctgctagcctaggggcttcgggacctggactttttgaacccatacatggttctgcacctgatattgccggacaggacaaggcaaatccatttgctactgttcttagtgctgctatgcttttgaggtatggcctaggagaagaaaaggcagctaaaagaatagagaatgcagtggtggacactttgaacaggggatttcgaactggtgacatatattctgcaggaacaaagctggtaggatgcaaacagttaggtgaagagatactgaagtcagttgaatctaacgttcatgctggtgctgctacagtgtgatctcgagaccaactcgccatagaactttggattctggtttttatcctagagatcactacgactgccaaagctgagaaaatctccctaatttggctcccttcgtgtttccactttcttcttttactaattttactggctaagacaagcattttttttaaataccttttagtatatctggattaatattttaaaagtattgaaaattgtagttggccgttaaacaagg

SEQ ID NO: 385 - DNA, 2171 bp, Glycine max
aaaggatccatttacatttcgtcaaacttagccttcttgtttcatctaaaagagtagcaaccatgtggtctgcagtaacagatcccattagagctttttttgcaaattttctccgccatttcatccacaaagacttccatgaagcagtggccagaatgaccataatagatgctttcctcttcgttattgtgcactccattgataagttggggatatggccacgcttgccggttttcttagggctattgtacctggcgattcggcggcggcttcatcaggagtacaacctcttcaacgttggaacaacaccggtgggggttaggtttaaccattctgattttccatacagaacagctgatggaaaatataatgaccctttcaacgaagttgctggcagccatgggactttctttggcagaaatattctccctgtggatcagaaaaaaaagctattgaaacctgatccaatggtggtagccacgaaactacttgctaggaggacatacaaggatactggaaagcaatttaatgtgatagcagcttcttggattcaatttatgattcatgattggatcgatcatcttgaggacacaaaccagattgaactcatcgcaccaagagaagttgcaaggcaatgccctctcaaatctttcaaattctacaagacaaaggaaattcccactggcttctttgagattaaatccggatcatcaaacatccgtacaccttggtgggatgcaagcgcagtatatggaagcaatggagaagttttacagagagtgagaactttcaaagatggaaagataaagatatcaaaggatggccaccttcttcataatgaaaatggaacagcaattgcaggtgacatccgcaatagttgggctggtgtttcaaccttgcaggcccttttcattcaagaacacaatgcagtttgtgacaatctcaagaaacattatcctcaattgggagatgaagaactttatcgccatgccagattggtgacctcagctgtgattgcaaaggttcataccattgattggactgtagagctccttaaaactgatactttacttgcaggcatgcgtgccaattggtatggattattagggaagaaatttaaggatacatttgggcatgttggtggagtcatcttgggaggattagtgggtcttaagagaccagaaaatcatggtgtcacatactctctaacagaggaatttgtgactgtttatagaatgcactcactcctacctgataacctacagctaagagacatatccgctactccaggacccaacaaatctcctccattagtcaaagaaattcctatgaagaatttgattggactgcaaggagaaaaaacattatctgaaataggagttgcaaggcaacttgtgtcaatgggtcaccaagcttgtggggcactagagctttggaactacccagagtggctcagagacctcgtaccacaaaacatagatggcacagataggcctgatcatgtggatctagctgctcttgaaatttatagagatagagagaggagtgtggctagatacaaccaattcaggagggcattactgttgatacctatatccaagtgggaagatttaacagatgacaaggaagcaattcaagtattggaagaggtatacggtgatgatgttgaagagctcgatgtactggtaggcctcatggcggaaaagaaaataaagggttttgcaatcagtgagacagcttttgttatattcctactcatggcaaccaggaggttagaagctgacaggttcttcacaagcaactttaatgaagagacatataccaagaaaggactggaatgggtgaatacaactgagagcctaaaggatgttattgatcgtcactatcctgaaatgtcacacaagtggttaaactcttctagtgctttctctgtttgggactcaccaccaaactctcaaaatcatatacctctctatcttcgtgttcctcactaatttgtttgccctcacaatatctctttgctattaatgcctttaatttaatcattgggtctattttgggtgtttgtatttcggtttatatccttttgttgtatttgagttaactcgtgtatactttatcttatctctatcccaaaattcagcccacttaggtgcttgtatctcgagttt

SEQ ID NO: 386 - DNA, 1355 bp, Glycine max
ggcgaagtttctccattaattcttcttgtgcgtttctcccacactttagatgtgaagatgaaggagttatctcagacccagagtgttgttgtccatgggattgctggtgctggttcagtggctttagccactgccttcacttatcctctcgacagcatcaaagtcctcattcaggttggttccagcaccggtaaagaattggaccctgcccaggctttgacgagactactctctgtgtccggcaatgcaggtttgtttaatggttttggctggttgttggctggaaggatttttggtctgggagcacgatttggggtttacgaaatcctgactgccttttataaagatggtcgggaaaataattatttgtttgcttctgaggctcttttggctggcgtggtagctggtgccgttgaggcagtcataagctctccattcgaactcatcaagcttcgtatgcaagttactgctgcttcatatgttccaagctccaactttgctttggaaaagggggctcgttcacctttaattgcaagattacttcatggccgttatccagacaagagggcattggacctatatgttggtctcatctccatcctaaaaaccaaaaatacaaacgtgaccagtgccttgctagagtatccatggacaatgacaggatctgggaggccaccatcagtttccaatgtcaggagaccatctgacattatatctttggaaggatggaggacattttggagaggactccgtcctggaattgtccgagattctgtgtttagcggcatatttttttcgacctggcaatttctgcaccaagcaatgctagattggaaggctgtagggatggatcctccacccaggttaaatgaagaagtcggtccattgtctcctttgattgttagtcttactgctggattctcagcttcagttgctgctactgcttcacatagttttgatactacaagaagtagatcacaatgtactgtgctgccgaagtacatctccatggagagaaagattctgaagtggaaacgaccaggaaccaagtttgaaagaattactggcatccatccttctgacagaggtgtcttgttccgtggtattggttggcgaatggctcgctctgggctggcatcattcattattgtaggaagttatttatttgttgctgatcagcttggttctagtttgacttaattaccacatattcataccccgattttggttaataagtaattgtaatgtttaatatatttttttctggagaagtcatgtaatttgggatgctgctctgtgctagttagtaaagaaaaatagagcggagacagtacttgatgtacccggattgtagt

SEQ ID NO: 387 - DNA, 2240 bp, Glycine max
tcatcttcttccagtgtctgtctacactacggatagagcttttttcacaccacagctaaaagtgctggaatagagcccttccccttcttcttcttctcctccaaatcctccttctttttctcttctctctaccacacaaaaacccttaccaagttctttctttctaattcccttgataatgtaaaatcacagaaaaagaaaaagctactaaaaacttggctctaaacctttctttttttgaggaaaacctgaaaagttccacacaatgtcttcttcttcttcttctagagctttcttcttcttcttcttctttcttatcaacgtctccttgctcctcacactctcttctgcagcggatccattcgtttcctacgaatttgaggtctcttacatcactgcctcccctcttggagttcctcagcaggtcattgccatcaacaacaagttcccaggtcctactatcaatgttaccacaaacaacaacgttgctgtcaatgttcggaacaagttggacgagagcctcctcattcattggtctgggattcagcaaaggaggacttcgtggcaagatggtgttcttggcacaaactgtcctattcctgcaaagtggaactggacttaccagtttcaggtgaaggatcaaattggaagctttttctacttcccttcccttcatcttcagagagctgctggtggatttgggggtttcatcataaacaacagacccatcattccgattccttttgataccccacatggggacatcgttgttttcattggagattggtacacccgcaatcatacggatttgaggaaggctcttgatgatggaaaagatcttggcatgccggatggtgttctcatcaacgggaaaggtccttaccgatataatgacacccttgttcctgatggcattgattatgaaacaattgaagttcatcctggaaaaacttaccgacttcgtgtacataatgttggagtatcaacaagtctgaatttcaggatccagagtcacaacttacttctagcagagacagaagggtcttacacagtgcaacagaactacactagcttagatattcatgttggacaatcttattcttttctgttaagcacagatcaaaatgcaagtacagattactacattgtagcaagtgccaggtttgtgaatgaatcacgttggcaaagagttactggagttgctatcttgcgctatacaaattccaaggggaaggcccgtggtcctctcccaccgggtcctgatgatcaatttgacaaaacttactcaatgaaccaagcaagatccatcagatggaatgtatcagcaagtggtgctcgtcctaacccacaagggtctttcagatatggttccatcaatgtgactgatatttatgtattaaaaaataagccactggagaaaattaatgggaagcagcgagcaacactcagtggaaactcttttgtcaatccttccactccaatcaggcttgctgaccagtacaaactaaagggagtatacaagcttgatttccccaccaagcctcttaccggatcacctcgcacagaaacatcaatcattaatggaacttataggggatttatggaagttatactgcagaacaatgatactaagatgcatacttatcacatgagtggatatgcattttttgtagtcgggatggattttggtgattggtctgagaatagcaggggtacatataacaagtgggatggaatagctcgcactacagcacaggtctatcccggagcatggacagcaattttggtttcccttgacaacgtaggagtttggaatctcagaacagaaaaccttgattcatggtatcttggtcaagaaacatatgtcagggttgtcaacccagaggtcaataacaaaactgagcttcccattccagacaatgcccttttctgtggtgcccttagcaaattgcaaaagcctcaaaaggtttcgtcagatgcaccatcaatcactgggaacaaactgaagctgctcttcacttggctcgttgtatgggcatggatccacattttccagtaaaaagcacattttgggtcatctactcttagttgcttcaagtggacttgtggcttgttggtgaggttttgtgattgagttattagttttgtaagtcttgtttataaattattgatcttttgcagtgattttgacttgtattcttcttcctattagctttatgcttgtggttccatgtttaatt

SEQ ID NO: 388 - DNA, 985 bp, Glycine max
catctagagttgagaatggaaggagggaaacgaggcacgattctggtcaccaacgacgacggaatcgatgctcctggcttaagggcattggttcactccatcgtcaacgccaaccttttcaacgttctagtgtgcgctcctgatagcgagaaatcagctgttagccacagcatcacttggctccatccagtagctgttaagcaagtacagatcgagggaaccaccgcatttgccgtttctgggactcccgctgattgtgcttctctagggatttccaaagctctctttcccacagtacctgatctggtggtcagtggcataaacaagggtagcaactgcggttatcacattgtttactctggcactgtagctggagctcgagaggccttcttcaatgatataccttctatctccatttcatatgactgggttaaaggaaagagtaacctacatgacttcacccttgctgctcaagtatgcatacctatcataagtgctgtgctggttgaaacaaagcatccaagttaccctagaaaatgttttttgaatatagacgtgccaaacaatgttcctaaccataagggttacaagctaactaagcagggtaaaagtatcatcaagattggatggaggcaagccacatctgagacagaaggaccaaaaatgtcatctgatatgaccaatacagatacagaaacatcaaagaattttgactcatcatctgtatcaccagaacatcttttgtttgcgagagaggtaaaaggttccgtacttgatggagatgatacggactacagatgtttgcaggaaggatatattactgttactcctcttgctggtctttctcatgcggaggtagattgtcaggcctattttaagaattggctacaaagtgtccctgaactcccctcgtcatcatctttataatacgtaagtcctatcacgtatttgtagtttatataacagccttgattgcaattcacca

SEQ ID NO: 389 - DNA, 810 bp, Glycine max
tcacgtagcaattttgaagatgtaagtgtagctctgactgatatcttgaagctacctctgatggataaaagcaatggctgcagcttctctagcatatcttcaattgctgtcttttcaagtgctgtttttgttgtctccttgattttggttcgtctcctttatgtcttatactgtagcagcaagcccttgagcaaaagggcttcaaaaccttttagtacccttattattttaggatcaggtggtcatactgctgagatgcttaatctactggcagtgttacagaaaggtaggtttaatccaagattctacattgctgctgctactgataatatgagtcttcaaaaagctcagttgttggagaattccctggctgctgagaatgcaacaagggtcactgatactgcacagttcatgaagatatatcggagtagagaagttggtcaatcatatataacctccgtttggactacttttgttgcaatggtgcatgcgctatggctaatgattaaaattagacctgaagtgatactttgcaatggacctggaacttgcattcccctctgtgctattgcatttatatttaaggtactgggaatcagatggtcattaattttctacgttgagagtatcgcaagagtgagaaggctctccttgagaggcctgctcctgtacaagttgcggatggctgataaactttttgttcagtggccacagctgcaacgacagtatccccgagctacctatgctggtcgactcatgtaaccaattggttcctttaatatcattaagcaaaagctgcattccatgtag

SEQ ID NO: 390 - DNA, 739 bp, Solanum lycopersicum
tttgtaatggcagcacttaaacttatcctgctagcagctttcctttttctgttcaatttcactgcaaattcaacggcactccccacaagttttatcaaaacttcatgcaaaatcaccacatatccacaagtatgcgttacttcgttatcagtttacgcaccaaccatcaaacgtagcccgcagcagctggcgcaaacagccttgtcagtaagtctggacagggcacaatccgctcacactttcatcaccaaactgaacaaatttaaaggtttgaaatcaagagaatacgcggctctaaaagattgtttggaggaaatgagtgagacagttgatcggatcaataaatctgttaaagaacttacacggatggggagttcacgtgggaaggatgttcagtggcatatgagtaatattcagacatggatgagtgcggctattacaaatgaaaatagttgtgcagatgggtttgctggaagggctttgaatggtaggattaagagttcgattagagccagggtgactcatgtaactcaggttacgagcaatgctttggccttaattaaccaatttcctgcaaaacattaagacctataaatagtttaattttatgttttcacattttgagtaatattcactttttttttttttttgtgtgtgtgtaagttttggtttgatgggaactatatatataaaagcgagaatgaaattttattcgtgtaaaatggagaactaaaggatt

SEQ ID NO: 391 - DNA, 2130 bp, Solanum lycopersicum
tcctcactttctcactctactttgctttctccgatggcgcacgatagcgatctcccttgtgacggcgatggtgtctgtatggcctgtaaagtgaagccatcggagaacgaatcgctcatctgtaagacttgtgctactccatggcacgtcagctgtctctctactcctcccgattccatgggagacgccgtcaactgggagtgccctgactgctctatgcctcccgccgctgttgttgtgcctgttaaacagaatgctgttgctacttcatcttctgaaggaagaggagatttgattgcggctattcgggtcattgaatctgattcgactcttaccgagcaggaaaaggctcagaaacgacaagaccttatgagcggaagttccaaagacgaagacgtggctgttgaaggggctaatcaggacaaggatgtgctgaatattctcgatggaagtttgaactgctctatgtgcatgcaactgcctgagagacctgttacgacaccttgtggtcataatttttgcctgaagtgctttcaaaagtgggttgggcagcgaaagagtacctgtgctaattgtcgtactcctattccagctaaaatggcaagccagcctcgaattaactccgctctggtcattgccattagaatggcaagaatgatgcggtctggtgcctctagcgggtcatcaaaagtttcacatttcgttcacaaccaaaatagacctgacaaagctttcaccactgagcgtgcaaaaaagactggaaaggctaatgcttgcagtgggaagatttttgttacaatccctggtgaccattttggaccaattacagcggaaaatgatccagagcgcaacgtgggtgttatggttggtgagacttgggaggatcgttttgagtgtcggcaatggggggctcatttccctcatgtggctggtattgcaggacagtcagattatggggcccagtctgttgcactttctggtggttacgaagatgatgaagatcacggtgaatggtttctctatactggaagtggtggaagagacttgagcggtaataagcgaacaaacaagctacaatcgtttgaccagaaatttgaaaagcttaatgaagctttacgtgtcagctgcctcaagggttatcctgtccgagttgtgaggtcccacaaggagaaacgctcttcgtatgcaccagacaaaggagtacgatacgacggggtctacaggattgaaaagtgttggcggaaaccgggaaaacaaggattcaaagtttgtcgatacctttttgtgcgctgtgataatgatcctgcaccatggaccagtgatgaacaaggtgaccgtcctagggccttaccttccatcaaagaactaaaaggcgccacagatatgactgagagaaaaggatctccagcctgggattatgatgaggaaaagagttgctggatgtggaaaaaggctcctcctcctagtaggaaaccagttcaatgtgaaaatgaagatggaacaaaagtgagaccagtcagaccaaagagacttacaatgtctgtaaagcagaggctcttgaaagagtttacatgtcatctttgtcgggaagtgatgaataacccgcttactactccatgcgcgcataacttctgcaaggcatgtttggatggtgcctttgcaggtcaatcctttacaagacagaggacgtgtgaaggcagacgtacattacgagcgcagaaaaatataatgaaatgcccatcatgcccaactgatatatctgatttcctccagaatccccagattaatagagagttgatgaatgtaatcgaatctctgaagcgccaaattgaggaagaaaatgcagcattgagtgctgatgtagatgatggcagcttagatggaaatgagattctagctgaaacagataaaagcatggaggatgatgaagaaggtgcacagcctgtcaatgagactgaagccaagcagactaacaagaggaagagatctggcagcattgacaatgcatcatcacccaagaaatccattgacaaatctgatgctgtgcataatcttgaggaagttgatcctgcccatacctgaagaagcaaaatggtggcaactgttggctctcatgtttattgttggtag

SEQ ID NO: 392 - DNA, 321 bp, Solanum lycopersicum
attaaggttgtggctgcagtagacttgcctcagagagttttggtttcgttataattgtcactagtgccccaaatatgtgtttggtgtttgtatgtgatgaagatgagagggtgttacaaagacaggcagctccaggagcttgtccttactgcggagggatggttcaagccgtggacatggagagtcagtggagattctgctttgtcccttattatttcaagactaaacgcagatactactgtaccctttgcaccagacgtctcatcatccaataattttacctaatcttatgatatagcctctttgtggtccttgaacttt

SEQ ID NO: 393 - DNA, 986 bp, Sorghum bicolor
cggatccgtagggtgttggcgggtgcaggtggtggctggttgccgatcgatcgagaccggtgaggatgttggcggtgttcagcggcgaggtggtggaggtgccggcggagctggtggcggcggggagccggacgccgtcgcccaagacgaaggcgtccgagctcgtcgccaggttcctggggacctgcccttccgccgccgtgtccgtgcgcctcgccgccgacctcggacacctcgcctactccaacgccaaccaggccctcctccgcccaaggtcgttcgcggcgaaagacgaggtgttctgcctgttcgagggggtgctggacaacctggggcggctgagccagcagtacgggctgtccaagggcgccaacgaggtgctcctcgtcatcgaggcctacaagacgctccgcgacagggcgccatacccggccagcttcatgctctcgcagctcgccggcacctacgccttcgtgctcttcgacaagtccaccaactccctgctcgtcgcctctgacccggagggcaaggtgcccctcttctggggcatcactgctgatggctgcgtcgccttctctgatgacattgacatgctcaaaggatcgtgtggcaaatcgcttgcgcctttcccacaaggttgcttctactctaatgctcttggaggattgaagtgctacgagaaccccaagaacaaggtgactgctgttcctgcagatgaagaagaagtctgtggtgcaaccttccaggtggaagggtctacagtgcttgcagcgctgcattaggagatcatcacatctccgtctccaggcgtggacggccgggggaggacaatgcaaagctctgtacatggagccatggtggtgtaatgtaacataacggcaaggcatgcaactgatgctgatctatctgtatcatctccctcccataaaagagaagtgcgtactgccggcatgcatggtcaggacttctgtgctagctgttggttg

SEQ ID NO: 394 - DNA, 1484 bp, Arabidopsis thaliana
aaaggatcctctttggctttaaacctttgtgactttgtgtacaaattccggagtgtctctctcccaaatcagcatcgcagattcgatttctcatcctaagagagctgaaaaatggaggttggattcaaggcattgctcgatgatcttgacgttctcgagaaatctctctcagatccggctctgatcaacaagctgcgatcacatgttgagaatctagccactctgtctaaatgtaatcctcaccggcgttccaaagtcaaggaactaagctcggaagtggtagatagtaatccttacagtaggcttatggcacttcagcggatgggcattgtggacaactatgagagaattagagagttttccgtcgccattgttggaattggtggtgttggaagtgttgcggctgagatgcttaccagatgtggtattggtcgtcttttgttgtatgactatgacactgtcgaactagctaacatgaacagactgttttttagaccggaccaggttggtatgacaaagactgatgctgctgtccaaacccttgcagaaataaaccctgacgtagttcttgaaagtttcacaatgaacataacaacagtgcaaggctttgaaaccttcacgtccagcttgacaaacaagtcattttgtcctagcaaagagggcggcagtggtgtggatcttgttttgagttgtgtcgataactatgaagcaaggatggctgtcaaccaggcatgcaatgagttacgtcaaacatggatggagtcaggtgtatccgaagatgctgtttcaggtcacatacagctcttggttcccggagaaactgcttgttttgcttgtgcacctcccctggtcgtggcatctggaattgatgaacggacacttaaacgggaaggggtctgtgctgcatctctgccaactactatgggtgttgttgcggggcttttggttcaaaactctctcaagttcttactaaattttggtgaagtttctccatacttgggttataattcactgaaggattttttcccaaccatgaaaatgagaccaaatccacaatgctcgaatgtagcttgtctagagcggcagaaagaatatatgcttgcaaaaccagaaagggatgctgctgctaaagctaagatggaagctgatgcatccacaactatcgatgaaggtccactccatgatgataatgagtggaacataagtgttgtcgatgatgaaaatgagaaggatactacaaaagctgcctcaagttcagatacattacccgaagggcttactcgggagcttccagttgcagatgagtatgagaaagcaatagccatagcctcagggtcaggagaaacagaggaggaagatgaccttgaagatctgaagaaacagctcgaagctctcaacgctgcttgagtctttatgagggagaaaaaatagttgttttagcatatttatacatgaaagaggctacaagtgcaattggtaccttt

SEQ ID NO: 395 - DNA, 3210 bp, Arabidopsis thaliana
aaagtcgacttgtaaccacagaactttgcagtggtcttgttccactaatattagcctcgtttttgcttactaaaagtttatctctattctcatcaccatggggagttgtttttctcttcaagttagtgatcaaacactgaatcgtatctttaattgcttaattggtaaaagttatattcgaaccctcgagaagaatctcagagctctgcagagggaaatggaagatctcagagcaattcaacatgaggtacaaaacaaggtagctagagacgaggcacgccatcaacgaaggcttgaagctgtccaggtatggcttgaccgtgtcaatagcgttgatatagagtgcaaagatctgctaagtgttactcctgttgagcttcaaaagttgtgtctatgcggtttgtgttcaaaatatgtatgttcaagctacaaatatgggaaaaaggtattcttgttactggaagaggttaagaaactaaactcggagggaaattttgacgaggtttctcagccgcctccaaggtctgaagttgaagagaggcctactcagcctacgattggtcaggaagacatgctcgaaaaggcatggaaccgccttatggaagatggagtcggaatcatgggtctgcacggtatgggtggtgtaggcaaaacaacccttttcaagaaaatccacaacaagttcgctgaaataggtggtacgtttgacattgtgatctggatcgtggtgtctaaaggcgtaatgatttcaaagcttcaagaagatattgcagagaaactacacctttgtgacgacctgtggaagaacaagaatgaaagtgataaggccactgatatacacagagttttaaagggcaagagatttgttttgatgctagatgatatatgggagaaagtggatttagaggccattggtattccctatccgagtgaagtaaataaatgcaaagtagcattcacgacacgttctcgggaagtttgtggggagatgggggatcataagccgatgcaagtcaactgtttggaaccagaggatgcatgggagctgttcaaaaacaaggtcggagacaacacattaagtagtgatcctgttattgtggagttggcaagagaggtcgctcaaaaatgtcgtggtctgccattggcgctcaacgtcattggtgagacaatgtcatctaaaactatggtacaagaatgggagcatgcaatccatgtttttaatacatccgctgcagagttttctgacatgcaaaacaaaattcttccgattctcaagtacagctacgatagcttgggggatgaacatatcaagtcgtgtttcctatattgtgctctgtttcctgaagatggtgagatatataacgaaaagttgatagactactggatatgcgaaggattcatcggagaagaccaagttataaaaagagcgaggaataagggttatgcgatgctcggtacccttacccgtgcaaatttgctaacaaaggttggtacatattattgtgtgatgcatgacgtggttcgtgaaatggctttatggattgcttccgattttgggaaacagaaagagaattttgttgtgcaagcaggagtcgggttacatgaaataccaaaagtcaaggattggggagctgtaagaaagatgtcattaatggataatgatattgaagagataacatgcgagtccaagtgttctgaacttacaactttgttccttcaaagtaataaattgaagaatctaccaggtgcattcattcggtatatgcaaaagctagttgttttggatctttcatataatcgtgacttcaataaacttccagagcagatatcggggctggtctcgttgcagtttcttgacttgtcgaatacaagtatagagcacatgcctattggtctcaaagagttgaaaaagctaactttcctggatttgacttatactgatcgactttgtagtatcagtgggatatcaaggttgttgagtttaagattgttgagactgctagggtctaaagttcatggagatgctagcgtattgaaggagctgcagcaattgcagaatctacaagagctagccataactgtatccgcggagttaattagtttggatcaaaggttggcgaagttaatctctaatctttgtattgaagggtttcttcaaaagccattcgatttatcattcttggcgagtatggagaatcttagttccctacgggtggaaaatagttatttctcggagataaagtgcagagaaagcgagacagaatcgtcttatttacgcatcaatccgaaaattccatgctttaccaacctctcacgactggagataatgaagtgccatagcatgaaggatctgacttggatattgtttgctccaaatcttgtcgtgctactcattgaagattcaagagaagtgggagaaataataaacaaagagaaagcaaccaatcttacaagtattacaccatttctgaaactagaatggttgattttgtataatttgccgaagctggagagtatctactggagtcctctcccctttccggttttgttgaccatggatgtttcaaactgtccaaagctgagaaagcttccattaaatgctacaagtgtttcaaaagttgaagaatttgaaatacatatgtatcctcctccagaacaggaaaatgagcttgaatgggaggacgatgataccaaaaatcgattcttgccttcaatcaaaccggtaatcatttcttttaatctcttatgcttgagttatttgtatttcttgctaatgtttctttcaaggttagcatgagatattgtccttctgcaaaatggatcacacaatagaatatactgtgcctctcaatttcaatgcattgttactaacattgtttcattttcttcttctttagtacaagtacttcgtctacccaggaatgagtttcctcactgtctaaaatcagaattcacgcttcttcttcttctattgctttatctatcttcttgtagtgctgcatttggattgtataattgatttgcattctgatacttctggaatgtgttgttgtgttgttcacttggattatgtttttcattttccttttgtattccctaaaacgttttgcatcctgttcaaactacatttttacacaatcaaaagtttatgcgtttaggtaaaatccatttgttggtttctctttcaccttgcagtgtcttggatccttt

SEQ ID NO: 396 - DNA, 1895 bp, Arabidopsis thaliana
agagaatggtggattcgaaaacccctgcgaaaaccaaattgttagattcgtcttcgatttctaatgtcagagtcgtccttagggttcgtccttttcttccccgggagatttcggacgagagttgtgacgggagatcgtgcgtttccgtaatcggcggcgatggaggagataccagcgaagtggcggtttacctcaaagatccagatagctgtcgtaacgaaagctatcagctggatgcgttttacgggagagaggatgataatgtgaagcatatattcgatagagaagtaagccctttgattcctgggatctttcatggtttcaatgctactgtgcttgcttatggagccaccggaagcggaaagacttttacgatgcagggaatcgatgagctaccaggtctgatgccattgaccatgtccaccattctgtctatgtgcgagaagacaaggagtagggctgagatttcatattatgaagtttacatggacagatgttgggatcttctagaagttaaagacaacgagattgctgtttgggatgataaagatggacaagttcatcttaagggactttctagtgtccctgttaagtccatgtctgagtttcaagaggcgtatttgtgtggcgttcagaggaggaaagttgcacacactggtttaaatgatgtctctagtagaagccatggagtgcttgtgatctcagtaacctcacaagggcttgtcactggtaaaatcaatctgattgatcttgcaggtaacgaagacaatagaaggacaggcaatgaagggatccgtttacaagagagtgccaagattaatcagtcattatttgcattgtccaatgtggtttatgcactgaataataacctccctagagtgccatacagggaaaccaaattgactagaatactgcaggattcacttggtggaacaagtagggctctcatggtcgcatgtctgaatcctggagaataccaagaatctcttcgcaccgttagcctggctgcaaggtcaaggcacatctcaaacaatgtttctctgaatcccaaggtagagacccccaaggttaagatagacatggaagcaaaactgcaagcttggcttgaatcaaaaggcaagatgaagagcgcgcatagaatgatggcaatacggtctccattgatgggtacaaaccagacttcaatttctcaaagctcagtcaagaaattactctgtcatagatcagccattgcagaaagtgctaagcttgccggcacaggacagagggacgcatttgtgaccgcaagaaacttatttggtgtggaaactcttgctgcttcacatttatgggaacctatacggaatctgcagttagcttctccaaccaaagaagatgagagagacacatctggcgaagagaatctattggtatcagaagcaagcttgagagataacacattggatgtcgagaagaaatatactgaactgagtcctcttcgagaagctctatctccaatagactccaatgcaaaaccaaattcagcacacggaagctctccttttctgaagccaatgaccccaaaaacaccttttctttctacaaaccctgaaattatgcagatggaaggcacttgccagaagttcaatgcatggagcaataatttaaagacctctctcataaaagagtacattcacttcttgaacacagccaacagagaggagctaagggaattaaagggaattgggcagaagatggctgagtacatcattgaactcagagaaacaagccctttaaaatcgcttaccgacttagaaaagatcggtttcacctcaagacaggtacataacctattcaaaaaagccactgaaggagtcctcgagaagccagtttctgcttcaacaacaccttagtag

SEQ ID NO: 397 - DNA, 2603 bp, Arabidopsis thaliana
cgagcctgactggagaaatcgagaatggaggacggcgaaatagaggaaggaatggtaactgccgacgaattcccgacgccggaagtaactaccatagagactatacaacctccccgagagccaggaaaatctccactcgagctacttcgagagagcaaaacctccgtagaagaaatcgtcgcgaagatgctctccatgaaaaaacaaggaaaccacaaatctgagattcgagaactcctcactcaaatgttcctcaacttcgtcaatcttcgtcaggcgaatcgtgcgattttgactgaggaagataaagtgaaagcggagacggaaagagcaaaggcacctgttgatttcacgacattgcaattgcataatcttatgtatgagaagagccattacgttaaagctatcaaggcttgtagagatttcaaatctaagtatcctgatattgaccttgttcctgaacaagacttctttcgtcatgctcctgaagctatcaaagatcaatcgctttcaagtgatagttctcatgttttgatgcctaagagactcaattttgagcttcatcagaggaaagaattgtgtaagcatcgagcgagattggagcaacagaagaagagtttattagaaaccattgcggagcgtaagaagtttttgacgagtcttcctctacaccttaagtctctgaagaaagcatcgcttccagtacagaaccacttgggtatacagcacacaaagaaactgaagcagcataatttagctgagctgcttcctcctccgctttatgttctatactcacagctcttggcacaaaaggaagcttttgaggagagtattgaattggaggtagttgggagtcttaaggatgctcaagcttatgctagacaacaatccagaaaggactcaggtatgtcgagtaatacagagagttctaggttggaggatgatggacctgatgacgatgatgatggacaaaggagaagaaaacgacccaagaaacttactagcaaagaaggttctgacaaggcaggattatatcaagtccaccctctcaaaattgtccttcacatatatgatgatgagataccagatacaaaatccttgaaacttgtcattctcaagtttgagtacttgctgaagttgaatgttgtatgtgttggcgctgaaggctctcaggatggaccagaaaaaaacatattttgtaacttgtttccagatgacgctggacttgagcctcctcatcagtcaaccaagctcatccttggtgatggtcagacgtttgatgagaacagaacttcaaggccttataaatgggtacaacatttggcgggaattgatatttcaccggttttattaggccaagaagctcataacactgacccagctaaaagtgatacgtttgtgcctgatctttcattgtatcgccagcagcatagagtgcaaacagttctgcgaagaatacgcttgcggaaaaaagcgcatctggctcttgcggaacagcttgatttgcttatgaaacatgagttaccagtggtgaactgcgaagatgctccttgggcactgcataaggttctctgtgctttggattcctggttacatatacaatcttcagctagtaagtcatgctctctgactctgaacagtgtggaacaagttccagaacctatggaaatcgatgtagatggaagatctatttctggaaaagaagattttgaaagtatacgggaagatggagaacttccctctttggtcacggcggctgcttcgttaaccagttccaatcataccccatcgaaagtatctaatcaagcacggtcaaggcagttggccttgatgacaaagaatctagattctccgattagcaaaggaaagtccccaagtttcaagaaatacgaagatgatttggatcttgttctggacgatgatagtgaaatagatgagccaaccggaagaactgaggcgcatgtggaagagttatgccctgagaaagctgataattcatgggtggattatggttcgagagagtttgcgcttgtgttctccaggaaaacagatggcggaaagttgtggaagttagaagcaatggtacaaattagcatggagtatcctcttcgacctcctttgttttctctgtctctccacgcatcttcttcatcaggaaatgaaaatgggacaaatgaaagtgaccattacaatgaacttcgagcaatggaagcagaagtgaaccttcatatgttgaagattattccttcagatcaagaaaactatctcctatctcatcaaatcagatgcttagcaatgttgttcgactattacgtggatgacccatctccagattccaaaagaggaacagccacaactgtggttgatgtcggtttgtgcaagcctgttgacggtaagcttcttgtgagatcattcagaggcagagatcaccggaaaatgatctcatggaagggcagaggatgtgcatcgggttatccatgctagagattacatcgccactcacttctctatattatctttctctggtggtacaagcaaaagtttttgcatgtaacatttttttatcgtataaaccgttattgaaacagcctacttgttgggtg

SEQ ID NO: 398 - DNA, 1067 bp, Solanum lycopersicum
ggaagtgctatattgcttcttcttcttcttcttcttgagaaattattctcaaaatgggtgccgaggtgtctaaacaaatcgaaagacgaaaagctatcgatactcagaagaaaaacctgtgtgatctcaaggagaaaaatggatgcaattttcctggctatgattataatgtacaggacagaaaaaattggatgtcaacacttggtcctgaaaagcttcatgtgaatcaaatagtttggccaggtacacatgattctgcaactgatgaaattggaatcccattcatttctcgccctttcggacaatgccaatcattgtctatttatgaacaacttgtacttggtgttcgtgttcttgacattcgtgttcaagaagatcgacatgtatgccatggcatccttctttgctatcacattgatgttgttatcaacgatgttaagaagttcctgtctgaaacacattcagagataataatcctggaaatccgtacagagtttggacatgatgatccacctaatttcgacaagtatttggaggctcagctaggggagtttctcatccaccaacatgacaatgttttcaacaacactgttgcagagttgttgccaaaacgaatcatatgtgtttggaaaccaggaaaatcacctaaacctagacaaggaagtcctttatggaattcgtgttacctaaaagatgactggatagacactgacttaccggaaaagaaattcgaaagcaacatgaagtatttgagtgagcaaccaccaataacatcacggaaattcttttacagggtggagaacacggtgacaccacaggcagataatccagtactgtgggtgaaaccagtgaccgaaaggattcatccgtatgcaaggttgtttataatggaatgtatttctcgaggttatgctgatcgattacaaatattttcatcagacttcatagaggaagattttgtcgatgcgtgcattggtctaacaaacgcaaggatcgaagggaagctctgaatctcaacatgtgtttaccagtataaatatgtgtttcgggaatttcaattatgttag

SEQ ID NO: 399 - DNA, 2026 bp, Solanum lycopersicum
tgcagtcagtctatttgttgctctcataaaaatggcgtccatcccttctcctcacactgcccgcctcaattctctcctctcttcttcttccgtcaatcacaacaaaccttcaaatctctctttcctccatgcctcctcaaatccatcttccatcaaactccttcactctgtttcaccatcaatttcttcttcttcgacgacggtgatttgtaatgtcctcaaaactgttgaatctgctgacatctccctctctagagatcttcacggcgttgtatccacttccaaaccaaccattctcgtatccgagaagcttggagaggcgggtctagatttgctcaagagtttcggcaacgtggattgttcttacgacttgtctcctcaggatctctgcgctaagatctctctgtgcgacgcgctcatcgtccgtagtggtaccaaggtgacccgtgacgtgtttgaggctgctcagggaagactcaaggtcgtggggagagctggtgttggtatagacaatgtcgatctgcaagctgcaactgaatttggttgcctcgtcgttaacgcacccacagctaatactattgctgcagctgagcatggaatcgctttgctcacctccatggcccgtaacgttgctcagtctgatgcctccatgaaagctggaaaatggctgcgcagcaagtatgtgggtgtttctcttgttgggaaaacattagctattatgggatttggtaaagttggttccgaggttgctagacgtgcaaaaggcctcggtatgcatgttattgcccatgatccttatgctcctgctgacagagctcgtgctattggagtcgatttggtttcatttgagcaggccatatctactgctgacttcatctcactccacatgcctctcacacctgctacgaacaaggtattcaatgatgacacttttgcaaagatgaagaatggagtcagactaataaacgttgctcgaggaggtgttatcgacgaggatgcattagttagagcccttgacagtggaatagttgctcaggcagcacttgatgtgtttactgtggagcccccaccaaaagatagcaaactagtgcagcatgagaatgttactgttacacctcatcttggagctagcactaaagaagcacaggaaggagttgcaattgaaatagctgaggctgttgttggtgctctaaatggggaactttctgctaccgctgtgaatgctccaatggtccctcctgaggttttgtccgagttggctccttacgtcgtgctcgctgagaaagtgggtagattagcagtacagctagtgactggtggcagtgggattcagagtgtgaaagtggtttacaaatcggctagggaccctgacagcttggacactagacttcttcgagccatggttacaaaaggcattattgagcctatatcggatacaatcatcaaccttgtaaatgcggatttcagtgcaaagcagaagggtcttcgcattagtgaagaaaggattattgttgattcatctccagagtaccctgttgagtcaatccaggtgcagattagtaatgtgcaatcaagatttgcaagtgcgttatcagagaatggaaacattagcattgagggtagagtgaagtatggagttccccatcttacacgtgttggaccatttagcgttgatgtgagcttggagggtaacctcatcctttgcaaacaagtggatcaacctggtatgatagggaaagttgggaacatacttggtgagagtaatgtgaatgtgagttttatgagtgttgggagaacggtgaagggaaagcaggcaattatggcaattggagtagacgaagaaccagacaaggatactcagaagaagattggagaggtgtctgcagttgaagaatttgtcttccttaaactatagtcaatattgctggctaatgggatggaatggaacttgttattacgtattattattaagtaaaagataaaaagggtgtaatgaaattttagctgtgtctgcttaatgtgttga

SEQ ID NO: 400 - DNA, 576 bp, Solanum lycopersicum
gagatacaaccaagcacaagagataaaaaaaaatggctagtatttcaggcaccataattagtacctccttcatgccaagaaaaccagttgtgacgagcttcaaggcatttccagctatccttggggttaaatatgcaaatggtggcaaaataacttgtatggctacatacaaagtgaaacttatcacaccttcaggagctgtagaatttgattgtccagatgatgtgtatattcttgatcaagctgaggaagaaggacatgaaattccttattcatgcagggcaggttcttgctcatcttgtgctggtaaaattgtatctggaagtgttgatcaatctgatggaaactttcttgatgatgaacaaataagtagtggatatgtgttaacttgtgttgcctatccacagtctgatgttaccattgaaactcacaaagaggaagaactcacaagctgaactaaatttggagaaaattttatgtttataatgtgctaaagtttatagtatatgtgagtgtgattttcttccattataatgtgtataattgtctgttttgtagatttgtttgtcgctcgtt

SEQ ID NO: 401 - DNA, 534 bp, Brassica juncea
agaaacatgactattgctttaacgatcggaggaaacgggttctcgggtttatccggatcttccttttcatcttcttcttcatcgtttcgattgaagaacagcagaagaaaagacacgaagatgctgaacagaacaggagtcgtctgttcttcatcttcagtaatggatccttataaaacacttcagatccgacccgattcttcagaatacgaggtcaagcaagctttcagacaactcgccaaaaagtatcatcctgatgtttgcagaggaagcaactgtggggtacagtttcagacaatcaacgaagcttacgatattgtgttgaagcaaataaagaatcagatggagggaacagaggaattcgagccattcgatgtgtatgacgagggattcaacggaatgaatgatccagattgtgacacgtgggaggaatggatgggatgggaaggtgcaggaaccagagactactcctctcacatcaatccttacgcttgaagaagcaataagtgagaattcataggccttggtaccatt

SEQ ID NO: 402 - DNA, 1355 bp, Brassica juncea
aaaggatccaccttctcttcagtttgctgagagagtgaactaacaattatggcgaagatgatgatgatgcaacagagccagccttctttatctctccttacttcttctgtctctgactttaatggcgctaagctccacttacaagtccagtacaagaggaaggttcaacagccaaaaggagcactctatgtatcagcctccagcgaaaagaagattcttataatgggtggcactcgattcatcggtatcttcttgtccaggctccttgtcaaagaaggacatcaggttacattgttcacaagaggtaaatctcctattgccaaacaactccctggcgaatctgaccaagactttgctgacttttcttccaagattcttcacttgaaaggagacagaaaggactatgactttgtgaagtcaagtctttcagctgaaggctttgatgtagtttatgatatcaacgggagggaggctgaagaagttgagcccatattagatgcacttcctaaactagaacagtacatctactgttcttcagctggtgtttacttgaaatctgatgtcttgccacactgtgaggtggatgcagttgacccaaagagcaggcacaaggggaagctggagactgagagcttactgcaatcaaaaggtgtaaactggacttccatacgccctgtctacatctacggtccgttgaactacaaccctgtggaagaatggttcttccaccgtctcaaagctggccgccctatcccagttccaaactctggaatccagatctcacagctcggtcacgttaaggacttggcaacagcctttctcgccgtgcttggtaacgagaaagccagcagagagatattcaacatctcaggagagaagtacgtcacctttgatggcttagcaagagcttgcgcaaaggctggtgggtttccagagccagagattgttcactacaaccctaaagagtttgactttgggaagaagaaggcgttccctttccgtgaccagcatttctttgcctcggtagagaaagcaaagcatgtgcttggatggaaaccagagttcgatttggtggatggtctcactgactcatacaaccttgacttcggtcgtggaactttcagaaaagaggcggatttcaccactgacgacatgattctaagcaagaaacttgttcttcaatagaaacatattgatttgtatggttgtgtgatctcacactgaagaacattctcaagtttattgtcgtctcaaatgtattttggtttcggattgtgttcgacttcttctaagaagcggcggtctggctcttgaagtttacttagtgaaggagagagagacatagactcgagttt

SEQ ID NO: 403 - DNA, 796 bp, Brassica juncea
ttggatccctctacagctaagatctacctcaccttttaatagtctttatttcatactttcttccgtattttattcaaacactaaagttttagaaatggcaacagcatcggttaacatgcaatcagtcttcgccggtgggttggccactcgcaagatcaacacaaacaagcttttcttcgccggaaacttcccaaatctcaagaggaactatccggtgggagtgaggtgcatggctgagggagaacccatgaaagatgagtctgcaccttcgacctccgcggctcagcctttgtctagttcatcaccgcccccacctcctccacgtcctactaaaccaaaggtgagcacgaagtttagcgacttgctagcgtttagcggtccagcaccagaaagaataaacgggcgtttagcgatggttggattcgtggcggccttggcggttgaactttccaagggtgaaaacgttttggctcagatctccgacggtggcgtctcgtggttcctcggtacgactgcgatattgactcttgcgtcgcttgtaccccttttcaagggcatcaccgccgagtctaagtccaaaggtttcatgacgtccgacgctgagctttggaacgggcgtttcgcgatgcttggtttggtcgccttggcgttcactgagtttgtcaagggtgggacccttgtctgaggaaaggaactttcttattggggagaatgttatattatagttttgcccctgaattctgtaaagtaatcttgtttgatgtgtgtttaagcctatggtgtgtttctcgagttt

SEQ ID NO: 404 - DNA, 758 bp, Brassica juncea
tagaaagcaagaaacttccaggatctggtgaaaaccatggaagaaggcgactttttcagttgcttcagcgaaattaatagtggcatgactatgaataagaagaagatgaggaagggcactaatcataagaggtttagtgaggaacagatcaagtcacttgaggttatattcgagtccgagacgaggcttgagccgaggaagaaggtgcagttagctcgagagctagggctgcaaccaagacaagtggctatatggtttcagaacaagagggctcgttggaagtctaaacagcttgagaaagagtatgatattcttagagccaattacaataacttggcttcacaatttgaaatcattaagaaagaaaagcaagcactagtctctgagttgcagagactaaatgaagagatgcaaaagacaaaagaagaaaggaatgaagagtgttgtggtgaacaaagagttgctctaagcagcagcacatggtcagataatggaaagtatgagccagaagtcaggctaaatcaagggattgttttgtgtaatgacgacattaagacagagtattttggatttgaggaagagtccaatcatgagctcataaacattgtggagcaagctgatgatagtggcttgacttcatccgataactggggaaatttcaattctgaatctctcttagaccaatctagcagcaattacccttggtgggatttttggtcataaataaaatagtgaagagaaagagtgtgtatagtttt

SEQ ID NO: 405 - DNA, 656 bp, Brassica juncea
gttaaaagatggctctcgaagtctgcgtgaaagccgccgttggtgcccctgatgctctcggcgactgccctttcagccaacgggttcttctcaccctcgaggagaagaatcttccctacaaaatgcatctgatcaacatctccgacaaacgtcagtggttcttagccattagtcctgaagggaaagtaccagtcctcaagaacgacgacaagtgggtgtctgattccgacgtcatcaccggcatcctcgaggagaagtatcctgagccatctctcaagactcctcctgagttcgcctccgttggatccaaaatcttcggtactttcgtgactttcttgaagagcaaagactccagcgacggatccgagaaggccttgcttgatgagcttgaagctctggagactcatctcaagactcatgacggtcctttcatcgccggagggaaagtcagcgccgtggatctaagcttagcaccgaagctttaccatctcaaggtggctcttggccactacaaaagctggtctgttcccgagagcttgccacatgttcatggctacatgaaggctttgttctctcttgactcgtttgagaaaacaaagactgaggagaggtatgtgattgcaggatgggaacacaaggttaacccctaaaactaa

SEQ ID NO: 406 - DNA, 1749 bp, Brassica juncea
aacaaccatcggtaacaccaccgaaacaaaacaaaacacataccctttaaaaacaaagtttagtttcttcttcttctactaaatggagaaaggttccaacggttccgcggcgttggagatgcagacgtctgagcttgatcagccggcggctctccgtaagatcatttcggtgtcctccatcgccgccggtgtacagttcggttgggctttacagctatctctgctgactccttacgtgcagctactcggaatcccacataaatgggcttctctgatttggctctgtggcccaatctccggtatgcttgttcagcccatcgtcggttaccacagtgaccgttgcacctcaagattcggccgtcgtcgtcctttcatcgtcgcaggagccggtttagtcaccgtcgccgtgttccttatcggttacgccgccgatataggtcacagcatgggtgatcagcttgacaaaccgccgagaacgcgagctatagcgattttcgccctcgggttctggattctcgacgtggcgaacaacactctccaaggaccatgccgcgctttcttggctgatctatccgcggggaacgcaaagaaaacgcgaaccgcaaacgcgtttttctcgttcttcatggcggttggaaacgttttgggttacgcggcgggttcttacaagaacctctacaaagttgtcccgttcacgatgaccaagtcctgcgatctctactgcgcaaacctcaaaacgtgttttttcctctccataacgcttctcctcttggtcacgttcatgtctctatgttacgtgtcggagaagccatggacccctgagccaaccgcagacgggaaatcctcgagcgttccgtttttcggagagatcttcggagcgttcaaggagctgaaaagaccgatgtggatgcttcttatagtcactgcactaaactggatcgcttggttccctttcctcctcttcgacactgattggatgggccgtgaggtgtatggaggaaactcagacgcaactgcatccgacgcctctaaaaagctttacaacgacggagttagagctggtgcgttggggcttatgcttaacgcgattgttcttggcttcatgtctcttggtgttgaatgggtcggtcggaaaatgggtggagcaaaacggctttggggagctgttaacttcatccttgctatttgcttggccatgactgttgtggtgactaaacaggcggagaatcaccggcgagatcacggcggtgctaaaacaggaccgcctggtaacgttaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccacagatggtggtatctgtgggaggtggaccattcgatgaactattccatggtggaaacattccggcgtttgtgctaggagcaattgcggccgcggtgagtggcatattggctttaaccgtgttgccttcgccgccaccggatgctccagctttcaaaactggggctatgggatttcattaaagttttagcagtgtttcagtggctatgtaactctcataaaactgtagtgttattgtgcaaatcctacataaagagaaaaaaggaaattcatcttcttgggttgttggtttatattgtacctaaacccattgtgttccttt

SEQ ID NO: 407 - DNA, 672 bp, Brassica juncea
ttcgtattctcatcaacaaagcaaacaaaacttttctcgataaccatggcagaggaaaccaagaacgttgaggtgccaaaggtagagtcggaggaatcatcagcagcggccacagaggttacagatcgtggactgttcgatttcttggggaagaagaaagatgaaacaaaaccagaggagaccgccatagcgtctgagtttgagcaaaaggttcacgtctcagagccggcgcctgaggttaaacacgaggaagaagaagaagagaagaagcatcatagtctcctcgagaagcttcaccgcagcgacagctcttcaagctcctcaagcgaggaagaaggcgaagatggtgtgaagagaaagaagaagaaggacgagaagaaggtaacaactgaaggagaggtgaagacagaggaggaggagaagaaagggtttatggataagttgaaggagaagcttcctggacacgggaagaagcctgaagatgctactccagccgcaccggttgtcgctcctccggtggaggaagcgcatccggcggagaagaaggggatcttggagaagataaaggagaagcttccaggctaccatcccaagactgtagaggaggaaaagaaggataaggatgatcattaaagatatgaaatcatgatgtgttcttgtgttgaatgataa

SEQ ID NO: 408 - DNA, 479 bp, Brassica juncea
agaacaaccacaaaggtgtttcaaaaaaaaagaacaaccacaaagacagagaaacaaagaagaagtaacatggtaaagatgatgtggggttccagtttagctctcgccgcagcgcttctcctggtgacggtggcaaacattccggtggcggagggagtgacgtgctcgccgacggaactgacttcatgttcgtcggcgtttatgtcagcttcgccgccgtcagcaacgtgctgcgccaagctgagagagcagaagccatgcctttgtggatatctgaggaaccctgccctcagccagtacgttaactctccaaacgccaagaaagttgccagcagttgcaatgttgcaaccccgaaatgttaatcatgattaattagtgacaagtttcgctgatcatgagtgtttaattactagttaaaataggtctggtcttcgacactactgtttagaataatagtgtggtggtgattatgatgctc

SEQ ID NO: 409 - DNA, 507 bp, Brassica juncea
atcataaaactcacctcttcccagatgcagtactacgaaacccgtgcgaaagaatactacgatgtggctcaaggtcagagccgccaaagctatggccagaaccaccagggatatggacagagccaaagtcgcccagtatatgggcatagtccgactctaaactaccgtagccacggtgggtttcttgatgggttattcaagggtaaaaatggtcaaaagggtcagaacggcttagggtcgtttatagggaaacacaagaaccaagatactaacaaggaccatgaacatgggaagctcttaggacagcacgagaagaaaactcaagagacaaacaaaggtgttaatggcctaggaatgtttataaactgtggagagaaaaaacttaagaagcaaaatgagcacaagaagaagaagaacaaggatgggcatgccagtggcaatgagagtggaagcagcagcggtagcgacagcgactaaatcaaatacttccataaacatgatgcttaa

SEQ ID NO: 410 - DNA, 681 bp, Brassica juncea
aaaggatccaaaacagaacagagatgggtttggtcacagaggaggtgagagctaaggcagagaagtacactggagatgagatatgccgagagaagacaaaagtcttcctcaaggaaatatctatgcctaatggcttactaccgttgaaggacattgaagaggttgggtacgacagagagtcaggtgtcgtgtggctgaagcagaaacagagcatcacccacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagtccccaaccacactttccaggactttcccagtctcagcttttgtagtcccagaggaagtggaacctgccaaggaagaacctgccaaggagaagagcagtgaagccgccgccgaggtcaaagaggctgttgcagtcaaggaggcctaatcaaagcttttctacagttaaaagagaccaaaatctattgaagtgtacttcaacaatgtaaacagactattgagagttagtgtttctcactgctcttactctcatgtattacctacccctcgtttctgcatgttttatactcgagttt

SEQ ID NO: 411 - DNA, 601 bp, Brassica juncea
aaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttctcactacttcatttgcgctatcccaggccactgtgccggcggcatgaagctctctgtcaacgtaggtgcagcagcctcttcagacggtggcggtgacagtggtgatggtaacacccccaaaactacaccttctccaaccgtagagggcaggaaggctgctccttccgcttctgccactgctatgttgaagccgttcaaagctttggttgtgacttgtgtagctgcattattatatgctttggctctttcttagttgttttttaatttcttgttgatttggtttggctcgtttgaaaatccaggctagag

SEQ ID NO: 412 - DNA, 968 bp, Brassica juncea
aaaacatggggttcttgagtaagagtgtattggtgagtctcattgcactttggtgcttcacttcctctgccttcactgaagaagtgaaccatgtgactcaaacaccttcctctgctcctgctccagctccttaccaccatggccaccaccacccacaccctccccatccccaccatcctcacccgcaccctccggcaaaagcccctgttaaaccaccggtttctccaccagctaaacctccggttaagcctccagtttaccctccagccaaagccccggtcaagcccccaactaaacccccggttaaaccaccagtttctccaccagtcaaacctccagttaagcccccggtttaccctccgaccaaggcccctgttaagcccccagttaaacctccagttaagccaccagtttcaccaccagccaagcctccggttaagcccccggtttaccctccgaccaaagcccctactaagcccccaactaaaccctccgttaagcctcctgtctctcctccagccaagccaccggtgaagccgccggtttaccctccgaagtttaacaggagcctagtcgccgttcagggtacggtcttctgcaaaagctgcaaatacgcttcttacgattcactcactggcgccaaaccggttgaaggtgctgtggtgagactactgtgcaagggaaagaagaacatagtcgcggagaccacgacggacaagaacggatacttcttgttgttggctccgaagacggtgactaacttcggtttcagaggatgtcgtgcgtatcttgtgaaatcaaaggactacaaatgcaacaaagtctccaagctcttcggtggagatgtcggtgccgaactcaggccggtgaaaacgcccggaaaatctgcagtggtcattaacaaactcacctacggtgtctttaacgtcggtccgtttgcgttcgaccctgtctgccccaaataataa

SEQ ID NO: 413 - DNA, 785 bp, Brassica juncea
gattgatctcaaatctggttggtctttagattgttaataaagaggcactgtctgataacagcagcagctgttgtttttcagttgtagcgatgggttctgaaggaccaacggcagtgacaatcaacatcacaggcttcaagaagttccatggagttgctgaaaacccaacggagaaaatggcaaacaacctgaaagaatatttagctaagaatcctcagtcgaaagacgttgttcttggaagctgtaccgtgcttgagacagctggtcaaggagctctcgcttctctctatcagttactacaatccgcaattaacacgaaagaatcagagtcagtgacctgtggaaaaaccatatgggttcactttggagttaatagtggcgctacgaaattcgcaattgagcaacaagctgtgaatgaagcgacgttccgttgccctgatgaattgggttggaagcctcagcatttgcctattgttccctctgatggtccaatctcaactgtaagaaagactactcttcctgttgaagagataacaaaggccttggagaagaagggctttgaggtgataacatcagatgatgcaggtcgttttgtgtgcaactatgtctattaccactcactgagatttgcagaacagaacaagacctattcactctttgttcacgttcctcttttcgtcgctgtggatgaggagactcagatgagattcactgcttctctcctggaggtactcacttctgtttgcaagtaatgttgtcccaattgtggctgattcttgttcatg

SEQ ID NO: 414 - DNA, 713 bp, Brassica juncea
agaaaatgttgggaattttcagcggagctatagtatcgctgccggaagagctggtggcagctggcaaccgaactccgtcgccgaagacaaccggagcggtccttgtgaacaagttcgtcgagaaaaatccctccgccgtgtccgtacaggtcggcgactatgtgcagcttgcgtacagccaccacaaagagagtcctcttcgaccaaggtcatttggggctaaggatgagatattctgcttgttccaaggctcccttgacaacctaggaagcttgaagcagcaatatgggcttgcaaagaatgcaaacgaggttctattggtcattgaagcttacaagactcttcgtgacagagctccttacccggctaaccatgttgtgtcacacctaagtggcgatttcgcctttgtggtctttgataaatcaacctccactttgtttgtagcctccgaccaagttggtaaggttccattgtattgggggataacagctgatgggtatgtggcatttgctgatgatgttgagttgctgaaaggtgcttgtggcaagtctcttgcttctttccctcaaggctgcttttactcaactacgttaggtgggctaaggagctttgagaaccctaagaacaagatcactgccattcctgctaaagaggaagaaatttggggagccaccttcaaggtggaaggagcaacagttcttgcagattgatga

SEQ ID NO: 415 - DNA, 534 bp, Brassica juncea
aaaggatccacaattcacaatcttctttagaatccaaaattattgttcgaagaaaaaaaaccgaagatggcaacaacgtcaacatccacgggagatatcaagaaaaccaagtcagtagaagtgaagaagaaacttaacgtgttgatcgtcgatgatgatacagtaattcgtaaacttcacgagaatatcatcaaatcgatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacgtctatgattattggggtgacgacactggctgacaatgaagaggaacgtaaggctttcatggaagctggacttaaccattgcttggcaaaacccttaagcaaagccaagatcctccctctcatcaacaatctcatggatgcttgatggatggatgaattgtcgccactatagctcgagttt

SEQ ID NO: 416 - DNA, 771 bp, Brassica juncea
accgtaagcgaactattgaatccacgaagaaacctcgatccgtcgatactatggcaaccaacgaacccgagcacgagcacagatacgcggaggaatccggagctaacgaggatgaggacaccggagctcaggtcgctccgatcgttaggcttgaggaggttgccgtcactaccggtgaggaagacgaagacgccgtcctcgatctgaaatcgaagctgtatcggttcgataaggaagcgaatcagtggaaggagagaggtgctggtactgtgaagctcttgaagcataagagcactggcaagattaggctcgttatgaggcaatcgaaaactctcaagatctgtgctaatcatttcgttaagcagggcatgagtgttcaggaacacgttgggaatgagaagtcttgcgtgtggcacgctcgtgactttgctgatggggagctgaaggatgagcttttctgcatccgttttgcttcaattgagaactgcaaagcatttatgcagaagttcaatgaagttgctgaatccgaagtagagaaagaagagagcaaagatgcctctgacgcagctggtcttcttgagaagttgaccgtggaagagacgaaaacagaggagaaacctgtggagaaggtaaagaccgaagtggaaccagaggaaaagacaaaaaccgagccagagaaagctgatgaagaaaagaaaaccgaagaggctgttgctccctcaacttaagatgcatcaatgtttaagctcctttggcgaggtattattaagc

SEQ ID NO: 417 - DNA, 954 bp, Brassica juncea
aaaggatccaatcgttcgcgttgagacggtgaatttaaattaaataacaaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaagtgaaggccgaagaaccggccaaaactgaagaaccagtcaaaaccgaggagccagccaaaactgaagaaccggtcaaaaccgaagaaacaagtggcgagaaggagaaggagattgttgaagagactaagaaagaagagatcgttgcaacctcggccgttgaggagaagaaacctgaagtagaaaaggaggaggagaagaagcctgtggtcgaagaagtgaaaaaggaagaagctgcttcagctccagcggtggttgaaactccggttacggcaccagaaacaacgacaccagcgccagtggctgagccaccaaagccttgattcgtttcaagatggtatgattgctttctcttgtatgaaaacatctttgttcgtaacaaaaagaaaaaaaaaagaaactgaaaggaaccaaaaaacttattttcattctttttattttatatggtttgtctttgtgtggagaaatggtacc

SEQ ID NO: 418 - DNA, 324 bp, Brassica juncea
tcccgggtggatccgtattcttatcgagatgggtggaggaaacgcacagaaatcgaagatggctcgtgagaagaacttggagaaggcaaggcaggccggaaaaggcagccaactggaagctaacaagaaagctatgtccattcagtgcaaggtttgtatgcaaacattcatctgcacaacatctgaagtgaaatgcagggagcacgctgaggccaagcatcccaaagccgatgttgtcgcctgcttccctcacctcagcaagtgatagaaactatcatttctcaccaaaaaaggattccagtgtaaatgtatggatcctcgagt

SEQ ID NO: 419 - DNA, 867 bp, Solanum lycopersicum
aaaacaaatcaaagtaatggctgagaagaatggtgaagttcaagaaatcaaacaccaagaggttggccacaaaagccttttgcaaagtgatgctctttatcagtatatacttgagaccagcgtatatcctagagagccagaatccatgaaagaacttagggaggtgactgctaaacatccatggaatctaatgacaacatcagcagatgaaggtcagtttttgaacatgttgttgaaattgataaatgcaaaaaatacaatggagattggagtatatactggctactccctccttgctacagcccttgctatccccgaagatggaaagatattggcaatggatattaacagagaaaattacgaaattggccttcccataattgaaaaagctggtgtatcacacaagattgattttagagaaggccctgctttgccccttcttgatcaattacttgaagataaaaacaatcatggcacatatgatttcatatttgtggatgctgacaaggacaactacatcaactatcacaaaaggattatagaattagtgaaagtaggtggtgtgattgggtacgacaacaccctatggaatgggtctgtggctgcaccagctgatgcaccaatgagaaaatacgtaaggtactatagagactttgtattggaacttaacaaagccttagcagaagatcagagggtcgagatttgtatgcttcctattggtgatggcattaccctgtgccgccgtatcatctgatcattttacatatttttctgcttttttttcttttattttaattcaactatcaaaaaaaaaagtgtctttctttgtattttttttttctggttattattattgaacgggagtag

SEQ ID NO: 420 - DNA, 3294 bp, Zea mays
aaactcgagacttcgttacgcggacagtgggaggagccacagccattataatagcacgccatacgccaaaagctccactggagccgagcagctactcctcccagtcccaggctcaccgtcgctcctcccaagaacccgcccaaagaatcctagaaatccaagaaaggcagcaactaaaacaggaggaggtctgcaggaggagcagcaggaggaggtggtgctggaggggaagatctcacaggtgtgtgaagaccacacagtctcgcgcactcgcaaacccagtgcgcgctgcggtcttcctcttcgcccaccttcttggagcggggaggttggccatgaggaggtggtggccggctgccctgctgggctgcgcagtggcggtgtccgttctggtggccgccgtggaatgcgctgtgacttacgacaagaaggcggtgctgattgatgggcagaggcggattctcttctccggatccatacactaccccaggagcacccctgatatgtgggaagggctgattcagaaagctaaagacggaggcttggatgtcattcagacctatgtcttttggaatggacatgagcctacgcctggaaattactatttcgaggagaggtacgatttagtcaggttcataaagacggtccagaaggctggcctgtttgtacatctccgcatcggtccctacatttgtggcgagtggaacttcggtggcttcccagtttggttgaagtatgtaccgggcatcagcttcaggacagacaacgaacctttcaagacggccatgcagggtttcactgagaaaattgtgggaatgatgaagagcgaaaacctctttgcatcccaaggtggcccaattatcctctctcagattgagaatgagtacgggccagaaggcagggagtttggtgccgcaggtcaggcatatatcaactgggcagcaaagatggcagtcggattgggtactggtgtgccgtgggtgatgtgcaaggaggaggatgcacctgatccagtgatcaatgcatgcaatggtttctactgtgatgcattttctcctaacaaaccttacaagcccacaatgtggactgaagcttggagtggctggttcacggaatttggtgggaccatccgccaacgaccggttgaagatcttgcatttgctgttgctagatttgtacaaaagggtggttcttttatcaattactacatgtatcatggaggaacaaattttgggcgcactgctgggggtcccttcatcacaacaagctatgattatgatgctccaattgatgaatatggacttgttagagaaccaaagcacagtcatcttaaagaactccacagagctgttaagttatgcgagcaggctttggtttctgttgacccagcaattactacccttggtaccatgcaagaggcccgcgtcttccaatctccatctggttgtgcagctttccttgcaaactacaattctaactcctatgcgaaagttgtgttcaacaatgagcaatacagcctaccaccttggtcgattagcatccttcctgattgcaaaaatgttgtttttaacagtgccacagttggtgttcagacatctcagatgcaaatgtggggagatggtgcctcatcaatgacgtgggagaggtatgatgaggaggttgattctctggcagctgctccattgctcaccacaactggtttgcttgagcagcttaatgtcacgagagacagcagtgattatttgtggtacatcaccagtgttgacataagctcatctgaaaactttctacaaggtggcggcaagcctctgtctctcagtgtgcagtctgctggtcatgccttgcatgtctttgtcaatggacagcttcaaggttctgcatatggtactagggaagatcgaagaatcaaatacaatggcaatgctaaccttcgagctggtactaacaaaattgcactgctgagtgttgcctgtggattgccgaatgttggagtgcattatgagacgtggaacactggtgttggtggtcctgttgtgcttcatgggctggatgaaggttcacgagaccttacttggcagacttggtcctatcaggttggcctgaaaggcgaacagatgaatctgaactccatagaaggctcaagctcagttgaatggatgcaagggtcattgatagctcaaaaccagcagccattggcctggtatcgggcttacttcgagactcccagcggggacgagccattggctttggatatgggtagcatgggcaagggccaaatctggataaatgggcaaagcattggacgctactggacagcatatgcagatggggactgcaaagaatgcatttacacgggaaccttccgggcacccaagtgtcaatcaggctgtggtcagcccacacaacgttggtatcatgtgccgaagtcctggctgcagcccaccagaaacctgctggtagtctttgaggaacttggtggggattcatcgaagatcgccctagtgaagaggtcagtctcaagtgtctgtgctgatgtatctgaggatcacccaaacatcaagaactggcagatcgaaagctacggcgagcgcgagtaccacagggccaaagtgcacgtacgatgtgcgcgtgggcagtccatttccgcaatcaaattcgcaagctttgggacacctacgggaacctgtggagatttccagcaaggagattgccactcagctaactctcacacagtcctagagaagaaatgcattgggctccaaagatgcgtcgttgccatctcccccgagagctttggaggagacccctgcccgagcgtgacgaaaagggtggcggtccaggcagtatgttctcccgccgcttagccttacttctccaagcaatggatttggaatgtggtcgaccaaaaaaaaaggccgaaaccagtgcagggtgagtggaactgtaagtatcgtcgactttgattattagatgtggctggcttgagaggttagcagcattcattgtcggattccagattaggatttgtagtctgctgcatctccatgaattgttcaaagcggccggctggataatgttgtagctggtccaggaatgcagctgtagagagagagagaggagtggaggcagaagagtgactgattatgcattcttttgctgtggtgttagtagctgtgtacccgtgacacatgtcgtctttcttggaacggagaaagatgcaggtgaagtgtgcattgtgcccttttgttctactgctagtggtaaggcaggagccttgcaattgtggaattcttt

SEQ ID NO: 421 - DNA, 2350 bp, Arabidopsis thaliana
acatacacacccacatgcttacacacatgttcgaactgtaatcagtaaaagaaacatcagagaggaagagaaggagaagaaaagatggagatgggtcgtctggtcttcgggttgtgtttgattcttattgtgggtacgtttcttgaattctccggcggtgctacggcggcgaagggagtaacgtacgacggacggtctttgataatcgatggacagaggaagcttctcttctccggttccatccactatcctcgcagcacacccgagatgtggccgtctctgataaaaaagacaaaggaaggaggcatcgatgtgatccaaacgtacgttttctggaacctccatgagcctaagcttggacagtatgattttagtggaagaaacgatttagtgaagtttattaaagaaattagatcacaaggtctctatgtctgtctacgtattggacccttcatcgaagccgagtggaattacgggggattgccattttggttacgggatgtacccggtatggtataccgaaccgacaatgagcccttcaagttccacatgcaaaaattcaccgctaagatcgtagatttgatgaaatctgagggcttatatgcttctcaaggaggtccaattattctttctcagatcgagaacgagtatgcaaacgtggagggggctttccatgagaaaggagcatcgtacatcaagtgggcaggtcaaatggcggtcgggcttaagaccggagtgccatggatcatgtgcaagtcgcccgacgctcctgatcccgtgatcaatacctgcaacgggatgaaatgcggcgagacttttcctggaccaaactcacccaataagccgaaaatgtggactgaggattggacttcattctttcaggtttatggaaaagagccttatattagatctgctgaggatattgctttccatgccgctcttttcgttgcaaaaaatggaagttacatcaactattacatgtaccatggtggaacaaactttggaaggacttcatcttcgtatttcattacaggatactatgatcaagctcctctcgacgaatacggtcttttaagacagcctaagtacggtcatttgaaggagcttcacgctgcgataaaatcctctgcaaatcctctgcttcaaggaaagcaaacgattctctccttgggaccaatgcaacaagcttatgtctttgaagacgcgaacaatggatgcgttgcgtttctggtaaacaatgacgctaaagccagtcaaatacaattcagaaacaatgcgtatagcttgagtcccaagtcaattggtattcttcagaactgcaaaaacctaatttatgaaactgcaaaagtgaatgtgaagatgaatacgagagttacaacgccggttcaagtgttcaacgttcccgataactggaatttgtttagagaaacaatccctgcattcccaggcacatctttgaagacaaatgctttgttggaacacactaatttgacaaaggacaaaactgattatctttggtacacttcaagctttaagctggattcaccctgcacgaacccgtctatctacacagaatcatcaggacatgttgtccacgtgttcgtcaacaatgcactagcaggatctggacatggaagcagagacataagggtagttaaactacaagctccggttagcttaatcaatggacaaaacaatatatcgatcctcagcggcatggttggtctaccggactctggagcttacatggagaggagatcttatggactaaccaaagtacaaattagctgtggcgggacaaaacccatcgatttgagtagatctcaatggggttactcggtgggtttgcttggagagaaagttaggttatatcaatggaagaatttaaatagagtgaagtggagtatgaataaagctggactaattaagaaccgccccctcgcttggtacaagacaacgtttgatgggccgaatggagatgggcccgtgggcctacacatgtcgagtatgggtaaaggagaaatttgggtgaatggtgaaagcattggtcgttattgggtctcgtttctcacccctgctggacaaccttctcaatctatatatcatattcctcgggcgttcttaaaaccatctggaaatttattggtggtatttgaagaggaaggtggtgatcctcttgggatatctttgaatacaatatcggttgttggttcgagtcaagctcaatctcaattctcctgaagattatttttttaaaaatggtttttgggtaattgggggtgttttataaaccaaacaatacattatattgaaatgatacaatacacaaattgaatgaaatatacaggtt

SEQ ID NO: 422 - DNA, 1243 bp, Brassica juncea
aaaggatcccgctttaaggctcaactctgagttcatcgaagttttcagacagaagcgagagatggaagtttccggcgttgttctccgacagattccgtgcgtttcaggctccgtcaccgatggccgttactccggtctccgattttccggcaacacgaggacaacggtcgggtttcggacgaggagattcagagggatcatgtgtaataacgagtttgcggataaagggcacatgagttactattctgggacggcgagatgcggcggtgaggggaaggataaggttaaggttatggagaaggagaagaagaaggacatgaagaagaaggctaaggttcttaaagctctttccaagaacttgaacatgttctcaagcatagggtttggtcttgatccagatgccggtttggttgctgagattcaaaacaagacaatctcggaagcaacagagattctggttaagcagctggatcagttgaaagcagaggagaagctattgaagaaacagaggaaagaagagaaggcaaaggctaaagctttgaagatgatgactgaaatggactctgaatcttcttcttcgtctgaatcaagtgacagtgattgtggcaaagggaaagttgttgacatgagctctttgagaaacaagccgattctcgaaccgttagaaccagaatctagcgtagcaacccttcctagaatcgaagaatatgcagattcttgcaagaacaccggtgaagcattgaagcttgctctgctacaatcagctgctgcatccacagcttttccctccattgttaatcctggattgccattgaagacggtggaagcagttccagttgttggattgccgtcgaagagaatagaagtctgtatgggaggaaagtgcaagaaatcaggaggagctgtgttgttggatgagtttcagaaggcaatgacggggatggaaggatctgcagtgggttgcaagtgcatggggaagtgtagagatggtccaaacgttagagtggtgaacgagactgaagatgctgtgatgactgattcagttagaacaccttccaagaccgtttgtgtaggagttgggttgcaggatgtggaaactattgtcacaagtttttttggtgaataatgtagcggagaaggtcttgattatgtaacatattgaaagagcttataatgatcaaagtggtatatgcatagttgtgatgttttttctcattgtacatatctgtcttcgctcgagttt

SEQ ID NO: 423 - DNA, 748 bp, Brassica juncea
gtggttgggaagatcgagtagcgagtgatcatcatgttcgtgattgattggttctacggcgttctcgcttcgctagggttatggcagaaagaggctaagatcttgttcctcgggctcgataacgccggcaaaaccaccttgcttcacatgctcaaggacgagagattggtgcagcaccagccgacgcagcatccaacatctgaagaacttagcattggtaaaatcaagttcaaggcttttgatttgggtggtcatcagattgctcgcagggtctggaaggattactacgctaaggttgatgctgtggtgtacctagtggatgcttacgacaaggagagattcgcagaatcaaaaaaggaactggacgcacttctctcagacgaatctctagccaccgttccgttcctcatcctaggaaacaaaatagacataccatacgctgcatcagaggacgagctccgttaccatctcggcctctccaacttcacgacgggaaagggtaaagtgaacctcgtggactcgaacgtaagaccattggaagttttcatgtgcagcatcgtcaggaagatgggttatggcgaaggcttcaaatggctctctcagtacatcaagtaaccaagccccaccaagactcctctccaacacatggcgttattattgttaaaacatcaagtaagtttctataaatcccgttttgtattttgtcttgcgttttcttttctttttgcatgtttgtaagaaatgtcgt

SEQ ID NO: 424 - DNA, 629 bp, Brassica juncea
tgccatacgtcctaaagatagcacacaaaagttaataaaaatccactaagagagctctctctttaccattttcccactttcctttgagacaacagagcaaaatggcactgagaatgtgggcttcctctacagcaaacgctctcaagctctcttcttctgcctccaaatctcaccttcttccagctttctccatctccagatgcttctcctcagtgttggaaggactcaagtatgcaacttcacacgagtgggtgaaacatgatggctcggtggctaccattggcatcactgaccatgcccaggaccatctaggagaagttgtgtttgtggagctgccagaagagaaaagctcagtgagcaaagaaaagaactttggagctgtggagagtgtgaaggcaacaagtgagattctatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggttcaaaggaatacaccaagttctgcgaagaggaagatgctgctcactagagggtttcacctgtctatgtttcgtag

SEQ ID NO: 425 - DNA, 1930 bp, Brassica juncea
aacaatggctacgaaaccaggcatcctcaccgattggccttggacaccccttgggaatttcaagtacatagtaatagcaccatgggcggtccatagcacatacaggtttgtgactgatgatccggtggatctcggatactccctcgtattacccttcttgctcttcagaattcttcacaaccaggtttggatctctctttcccgttactatacaaccaagggaaagaggcgcatcctggacaaaggtatcgacttcaatcaggtcgacagggagaccaactgggatgaccaaatattgttcaacggattgctgttctatatagggatcatgctgctgccgcaggcgaagcaacttcccttgtggaggacagacggagtgttgatggcggcgatgcttcacgccgggccggtggagttcctctattattggctccacaaagctcttcaccaccactttctttactcccgctaccattcccaccaccactcctctatcgtcactgagcccatcacttcggtgatacatccatttgcggagcatatagcatacttcattcttttcgccataccattgttgacaacgttgttaacgagaacggcatccatagcgtctttcgccggatatgtaatctacatagacttcatgaacaacatgggacactgcaacttcgagctcgtccctaagcgacttttccacctctttcctcctctcaagttcctctgctacactccttcattccactcactgcaccacacccaattccggaccaactactccctgttcatgcccttgtatgactacatctacggcacaatggatgaaacctcggatacattgtatgagaaatctctagaaagaggagaagatagagtggacgtcgtgcacttaactcacctgacgacgcccgagtccatataccatttgcggattggcttggcttcatttgcctcctaccccttctcttatagatggttcatgcgccttttgtggcctttcacatctctctccatgctcttcactctcttctacgccagcctctttgtctctgagagaaactctttcgagaagctcaacttgcagtcttggatcatacccagatataatctgcagtacttgttaaaatggaggaaagacgcgatcaacaacatgattgagaaagcgatactggaggcaaataaaaaaggagtgaaggtgcttagcctgggtctcatgaaccaaggggaggagctaaacaggaatggagaggtgtatattcacaagcatccagaaatgaaagtaagagtggtggacggcagtagattaacagcagccgttgtgatcaatagtctacccaaatcaacgacaaaaatagtgatgacaggcaatctcacaaaggtggcatacaccatcgcctctgctctttgccagagaggtgttgaggtcttgactctattaccagaagagtatgagaaactaagatcacttgttccacaagaatgcagagaccgtttggtccttttaacctctgaaacactcgcatcaaacaaggtatggctgatgggagaaggaacaacgagagaggagcaggaaatggccacaaaaggaacgttatttatcccattctcacagttccccctcaagcagttacgaagagattgtatctatcatactccaccggctttaataattccaaaatctctggtcaatatccactcctgtgagaactggttaccgagaaaggcgatgagtgcaactagagtggctggcatattgcacgccttagaaggatgggaaatgcatgagtgcggcacatccaatattcttctctcggatttggaccaagtgtgggaagcttgtctcacccacggcttccagcctctgctgcttccacatcacttccaatacccctgattccctactttcagatgatgaatattgtttccgtaattg

SEQ ID NO: 426 - DNA, 971 bp, Brassica juncea
aaaggatccgacgtcactctttctcccttcccttcgataatgctatctctcgtcgcctctcctccggtaatctccgccgcgtctctctctaaacctctccagtctctctccaaagctgcactctctctatccaaaagagccaaacccacttcccctttccccaaaaccgctagatccatctccgtctataaatctccgatgaacaacctcttcaccaggctcggattcgggtctcgtccccaacccgacccggcttccgccgcaatcgcgcaaggacccgacgacgatgttccgtctccaggtcagcaattcgcgcaattcggcgccggttgtttctggggagcggaattggcgtaccagagggttccaggcgtgacgaagacggaggttgggtatagccatggattcgtcgataatccgagctacgaggatgtctgttcggagacgacgggacataacgagattgttcgggttcagtacgatccgcaagaggtcagcttcgagagcttactcgatgtcttctggaaacgtcatgatccgaccacgttgaatcgccaggggaatgatgtggggacgaggtacagatcaggcatatacttctacacagacgagcaagagaagttagctcgtgaagcaatggagaaacagcagaagaacttaaacaggaagattgtgactgagatacttcccgccacgaaattctacagagcagaaaactaccaccagcagtacctggcaaaaggtggtcgcatgggtctcagtcaatctgctgagaaaggttgcaacgatccaatccggtgctatggctaagtaactagtcagtctctctggagaagataaaaaagtgagttatctcatgagaatacaataatactctgtagatcacatgttgtgtcttgtctcgttcaggtggtatttataaatttatagtgatgatgcatcatatggagtgtaatttacgtctcgagttt

SEQ ID NO: 427 - DNA, 579 bp, Brassica juncea
ggagagagagagacaagccacagagaaaaacatggcgagattcacggtgttgattgcggcagtggtactggcctttgtagtggcggtgccggaagtgacggcgaagaagtacacagtcggcgagaacaagttctggaatccaaacatcaactataccatctgggctcagggaaagcatttctacctcggtgactggctctattttgtgttcgacaggaaccaacacaacattctcgaagtaaacaagaccgactacgaaaactgtaacgccgaccatcctctcgtaaactggacacgtggagctgggagagacattgtcactctcaacgtgaccaaacactactatcttctcgacggaaagggtggctgttatggaggcatgaagctcgctgttaaagtagagaagcttcctcctccgccaaaagctgcacctgtcaagagcattggttcagtttccatggccactggtgttgctcagttcgtgattccgtttgctcttttctctgtttcgacggtgtgggatgccatcttaaggatgtggtagtgaccaccaatctcagaggtctttagttggaatcc

SEQ ID NO: 428 - DNA, 641 bp, Brassica juncea
tttgtcgacgagagaatggatcagatcttgaacaaagtgggatcgtactggctagggaagaaggcgaacaagcagctcgattccgtcggtgacgatatcaactctctgtctactagcatcgaaggaggaacaaaatggctggtgaacaaaatcaaagggaagatgcagaagccattacccgagttactaaaggagtttggtttacctgtggggatctttccacgcgacgcaactaactacgagttcaatgaacagactaggaaactcaccgtctttatcccaacgatctgcgaagtcggatacaaagactcatcggtcttgaggttcaccacgacggttacagggtttttggagaaaggaaagctagctgacgttgaagggatgaaaacgaaagtcatgatttgggttaaagtcacgagcatctctgctgactcttcgaaggtgcatttcacggcagggatgaagaaaagcagaagccgtgatgcttatgaggttttaagagacggcgttgagattgataagttctagcctctctgtttctgtgtcctgcttctatcttcccttgtgtttccagctttatatgtctttttttaatctgtctttgtatatgcaattaactctggtgttcatgaggatccgaa

SEQ ID NO: 429 - DNA, 935 bp, Sorghum bicolor
aaaggatccgagggacttgttcagctactgcagcactgcccgcaatggccaccacggcgaccgaggcggccaaggccgcgccggcggagcaggccaacggcaacgccaacggcgagcagaagacgcgccactccgaggtcggacacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctcaacatgctcatcaagctcatcggcgccaagaagaccatggagatcggcgtctacaccggctactccctcctcgccaccgcgctcgctctcccggaggacggcacgatcttggccatggacatcaaccgcgagaactacgagctgggcctgccctgcatcgagaaggccggcgtcgcccacaagatcgacttccgcgagggccccgcgctccccgtcctcgacgacctcatcgccgacgagaagaaccacgggtcgttcgacttcgtcttcgtggacgccgacaaggacaactacctcaactaccacgaccggctgctcaagctggtgaagctggggggcctcatcggctacgacaacacgctgtggaacggctctgtcgtgctccccgacgacgcccccatgcgcaagtacatccgcttctaccgcgacttcgtgctcgtcctcaacaaggcgctcgccgccgacgagcgcgtcgagatctgccagctccccgtcggcgacggcgtcaccctctgccgccgcgtcaagtgaaaaaaaacatgcctggccaccgacggcgccgccgccgccgcatcccccatcccaatcatatcgtagacgacgcgcagcattaattattcaccggctctcgagttt

SEQ ID NO: 430 - DNA, 1383 bp, Arabidopsis thaliana
aaaggatcccatttgtaagtgaacccattccactcttcttgcatttgaatctgattgttttccgtttaaagatgagaactttgatgaattctgctgctacaatgagagctgtgaagaaggagtttattgtaatagacttagatgctgataaagatgaagatgttcgttgtggtaaagtgaaagaagagtatatgatggatgctggcaaaactaatccttccaacatccaacaggttgtttctgctgttgcttctgatgatgatggtgatgatgatgatgactggggtaccaaaatggattatcagtatataaagttgttggatagtttcagagaagatggaagtttaaatctgagtgacaatccactaaggtctattaggtatgaagtagataatggtggatatgacaagcgggagtttaaagcagtgtttacaaataagcggagtagagaagatcgaaacactattcgtgtaaccaagaagaatgttgagccaaagcctcctcatgttcaagcaagtacagagaaggtaacaaaagaagccggtttcaaattaaggcgaagagagagtcttgtgagtcagaagagtgttgaagcaatgcttattacaagtcatgtgagaagaaactcccaacacaataatggcgacgctagcgagaaggagaattttgaggatgacattgtattggatgaggtttacagatcttatctcaaacggttagtggaaaattcgaaaagttcaagaactaatcctgaaaaagagataaaagtaaagtgtgaggaggatcatacagtgtctttgtctgattctgattctgatattattgtggttggagattgtccgtttctggaagaagaggattctccatttgtgccatcaaaaagttataaagtgattgatttggatgaagagagcagtgatcaacgcaattcttggtttaggagggagataatgaatgttctgaagcagccatacactgtaacagagctcaaggaacttcacaaggaagcatcagtgcatggagtgtcatccagacatatagaactacgagatggaacagagtttagctttccaacgaacaaaaagaaaccttcatatctcgataggtatccagacttcaaaaagcagtaccttgactctttgcgtgaaaaggatgagcgtaaagctctgaacctgttgcgcgggtttatcttttatataacgaatgtggttcgtgatgatgcattcaaaccgtggctcgatcaagaatgtttgaagatcagatgtgtctgacaaaagagtatcagcacttggagttctgacagaagactactaattaggagatgtaagacctttgtttcatgaaataagtttggacaagatttgcatttgtgtactcgagttt

SEQ ID NO: 431 - DNA, 559 bp, Arabidopsis thaliana
tgactgcttcttctgcatttcccagtgagaaatggcgacgaaggaaccagaatctgtttacgagttaagcatcgaggatgcaaaagggaacaacttagcactcagtcaatacaaagacaaagttcttttaattgtcaatgttgcttccaaatgtgggatgacaaactcaaactacactgaattgaatgagctttacaacaggtataaagataaaggtctggagattctagcatttccttgtaaccagtttggtgacgaggaaccgggaactaatgaccaaattactgactttgtttgtactcgcttcaaatctgaattccccattttcaacaagattgaagtaaacggagagaatgcttctcctctgtataagttcctgaagaaaggcaaatggggaatcttcggcgatgacattcaatggaactttgctaagtttcttgttgacaaaaacggtcaagctgtacaacgttattatccaactacttcccctcttacacttgagcatgacataaagaatcttctgaatatctcctgaatgatgaagctttgttgctgaatc

SEQ ID NO: 432 - DNA, 856 bp, Arabidopsis thaliana
aaaggatccaggttgacagagctttagttccgtacaaatggcgagtaagaaggttgacggagaaggaaaagggaaagctatagcgaatacgaggatgcttcgaagcatggatcgaaagactcgaagcgatactaagcgagatggttcttcttctaagctcatgaagatcgaatctccggagaagaagaaacggaagacgacgaaagcgaagaatgttggagctgcgaagaagaaggtaaagaaagaagaggtagctgtgaaaatcgagaaagaggaggaggaagatgatgatgctgcagagaaagaagaagatgacgactccgataagaagaagattgtgatcgagcattgcaaacaatgcaaatcattcaaggagagggctaatgaggtgaaggaaggtctagaggaagctgttcctggcatcattgtcactgtgaatcctgataagccaaggcgtggttgctttgagattcgagaggaaggcggcgagacattcatcagtcttttggctatgaagcgcccatttacaccgatgaaggaacttaacatggaagaggtcattgcggacatcgtagagaagattaagtaacacagctagtaggttctaccaatgccgagtctttcgtttcctccttggccctcggctaataggcttcaatatctgactatctagagcaactgcaggattttttaggcttaattttgatatattggtgaaaaccatttgagcacggtttcgtcgtttggtagtgcttgatcggctttgtgcagtttctttatgctaaaacttcctgatatatatgggattaagtctgtcttcgtaatgctagtttgaagcaattcgtttctcgagttt

SEQ ID NO: 433 - DNA, 821 bp, Arabidopsis thaliana
ttgttcaccaaagagaagaagactaactgtgttttttttttctttcctcgatgcctagatcaagcagatgggtcaatcagcgagctacctctaagattaaaaaatttatactctttttgggtgtagcctttgtcttctacctctacagatacccttcttcgccatcgacggtggaacaatcatccacttccatctacaacatttccgttaaggatattgaagggaaagatgtgagtttgagcaagtttaccgggaaagtgcttcttatagtcaatgtagcctctaagtgtggtctaacacatggaaactacaaagaaatgaacattctgtatgccaagtacaaaactcaggggtttgagatcttagcatttccttgcaaccaatttggtagtcaagagccaggcagcaacatggagatcaaggaaaccgtttgcaatatcttcaaagcagaattcccaatctttgacaagattgaagtaaatggaaagaacacttgtcccctttacaatttcttaaaagaacaaaaaggaggattgtttggggatgctattaagtggaatttcgcaaagtttctggtagacagacaaggaaatgtcgttgaccgatatgctccaactacatcacctcttgaaattgagaaggatatcgtcaagctattggcatctgcttgaacatatatgtcaaaggacaggagagcaaaaagcatcgcatcaaacatgtctgagactgagaatgaaaaccactttctatacttattctttacctttcatgtttatccaaaaccatccatggaaaagaagatgcttgtctgaatctgtgaa

SEQ ID NO: 434 - DNA, 1902 bp, Arabidopsis thaliana
aaaggatccctattgtttcgagtgacccaacttcgaagcttatagatcgttaccttagaaaatggtgggtatgtcgatgcagccatatggtattcaatcgatgcttaaagaaggttacaggcatctctctggtctcgacgaagccgtcattaagaacattgaagcttgcaaggagctctccaccattactcgcacctctctcggtcccaatggaatgaataaaatggttatcaatcatttggacaaactgtttgtcacaaatgacgctgctactatagtgaatgagctcgagattcagcacccggctgctaaacttctggttttagctgctaaggctcagcaagaagaaatcggagatggagctaatctgacaatctcctttgctggtgaacttcttcaaaacgctgaggagcttatcaggatgggacttcatccgagtgagatcattagtggatatactaaagctgtcagcaaggctgttgaaatactggaacaactggttgagactggttctgagaccatggatgtacgtaacaaggatgaagttatttctcggatgagagcagctgttgcaagcaagcagtttgggcaagaggaaataatttgctctttagttactgacgcatgtattcaagtctgcccaaagaatccaacgaatttcaatgtggataatgttcgtgtttccaagcttttgggaggaggcttgcacaattcttgcatagtccgtggtatggtcttgaaaagtgatgctgttggtagcattaagcgaatggagaaagcgaaggttgctgtatttgctggtggcgttgataccactgcaacagagaccaaaggaactgtcctcattcatagtgctgagcagctagagaactatgcaaagacagacgaagctaaagttgaggagttgattaaagcagttgcggaatcaggagccaaagtcattgttagtggaggatcaattggagaaatggcattgcatttctgtgagcgctacaagataatggtattgaaaatcagctcaaagtttgaactgaggcgtttttgccgtacagcgggggctgtcgcccatttgaagcttagccggccaagccctgaagatcttggatatgttgattctatatcggttgaggaaattggtggtgtgacagtcacgattgcaagaaacgaggaaggtggtaactccatctccactgtggtcttgcgtggaagcacagatagcattttggacgaccttgagagagctgttgatgatggagttaacacatacaaggccatgtgcagagacagccgtattgttcccggggctgcagcgactgaaatagagttggctcaaaggttgaaggaatacgccaatgcagaaatagggttggacaaatatgccatcaccaaatacgctgagagttttgagtttgtacccaagacccttgcagataatgctggcctcaatgcgatggaaatcatagccgctctgtacactggacatggatctggaaacacaaaactaggcattgacttagaggaaggtgcttgtaaagatgtttcagagacaaaagtatgggatctttttgcaaccaagttatttgcccttaaatatgcttcagatgctgcatgcactgtacttcgtgtagaccagattataatggcgaaaccagcaggtggaccaaggagagatgcagctcaagctgcaggtgctggtgcggaggaagactaagccggagaacaaatacctcgtagtgaaactctcttcttttgtaaccttctgttcctgaaagtctgagaaaattttggtatgtctcagtttaagatttgtgatctttgtaacgcaccaccaacttaagtgttttgccttctttttctgttttgccttgttttggctcgtctcaacactcagatttggtacct

SEQ ID NO: 435 - DNA, 685 bp, Arabidopsis thaliana
catttgagaactctagaaacctgcttcaatggcgatcgacaagcttccacttcttctctttctctccatactcctctgcctcaatcgccctgttcttagcgacaccgatgaagaggacattcttctcacaggaatcaacagctacagaacaacacagaatctaacaatcttaagcaagaacgaaaacgcagaatgcctagctgacgaaatcgcagaccaattcaagaacaaaccttgtaccaacgacactggctcagccacagtacctggaactgagccacagttcgcaaactaccctcagattctagcaaaatgccacttgaacgtctcagacacgagagacggctcgattatgcctgcatgtgttcctcgtttagaatcaaacctcgtcctcacaaacttcaccaagtcacaatactcaatgagtttgaacgattccaagtttacagggattggtattggtaaagaagatgattggatcgttgtagtcctcactaccaacacaccagaaggaagctattctacagctactcctacaaaacaagagtctaatggcttcacctttggtattggtctcgttagttatttagtcattttcatgtactcttccttttgtttctttctcttttgagatatcaaatgttttgatgagttatcaaacactctttcctttagactatcatag

SEQ ID NO: 436 - DNA, 1606 bp, Arabidopsis thaliana
aaaggatcctctaattaacgacaacacgacgaagatgaatccttctcacggtggcgacgacaagcaacgaccggcgatgtatccccaagttgatcaatccattcctgataatccttttgcttctacaaatccttacgtcgcttcttcaccttatctatatccttctctatcctctcataatctcggacctaatctcttcccagaccacggagatgcatccaacgaccaatcaccatctgctcctcctcaggcgacggaggaggttctcatccgtgttcccggcgctattctcaaccttatcgacaaatcctacagcgttgaactcgcgtgcggtgatttcaccatcgttcgaattatccaggggcaaaacattgtagcggttctagccaatgttggaaatgagattcaatggccgttgacgaagaacgatgttgcagctaaggttgatggatctcactatttcttttcgattcatccgccaaaggagaaaggtcaaggatctgggtctgattcagatgatgaacaagggcaaaagagtaaatcgaaatcggatgatgagattcttaattacggattgaccattgcttcgaaagggcaagagaatgtattacttgtgcttgatcaggttttacgagactacagttgtttcacagagcagagaatgtctgaaaaagccaaggagactggagaagaggtgctgggaaattcagtggtggcggacacttcgccggaggagcttaagggtgagagaaaggatgttgtggaaggtcaatgtgcggcgtattggacaacacttgcaccgaatgtcgaggattatactcacagtactgctaaaatgatagcttccgggtcaggtaagctgatcagagggatactgtggtgtggggatgtaactgtggagagactcaagaagggaaacgaggttatgaagaataggcttagtcgtgctgagaaggagaaagatgttagccctgagacactgaggagaatcaagagggttaagagagtgacacaaatgacagagaaagttgccactggtgttctttctggtgttgtcaaagtctcgggattcatcactggttcaatggcaaactcaaaagctggaaagaagctttttggtctcttgcctggagagattgttctcgcatccctcgatggatttagcaagatctgtgatgctgttgaagttgctgggaaaaacgtaatgtcgacttcatcaactgtcacaacagaattagtcaatcacaggtacggcacaaaagcagcagaggctactaacgaagggctagacgcagcgggacatgcatttggaacggcatgggttgctttcaagattcgaaaggcatttaaccccaaaaatgtcataaagccttcatcattggccaagtctgtttcggaactaaaggctaagaaaggctccaagtaaacactaaacagccttcaactgttctgtgttcatctaaacttgcatttagtttttcattttggaaaagtatatgaagattgattgatgtaactctatatttagttttctgtgtatattgtgattctatgtaaactatataaacagtttcttccaatcttctcccatttatggctcgagttt

SEQ ID NO: 437 - DNA, 613 bp, Arabidopsis thaliana
aagcaacaagtgaagaaagaaagaaaaaaatggagaagagtggaggaagaattgtaatggatgagataagaagctttgagaaggcacacttgttcgatcttggtcatcctcttcttaaccgtatcgcagattccttcgttaaagccgccggagtgggagctttacaagccgtgtcaagggaagcttactttaccgtggttgacggggcaggttttgactcgaacaacgtgggtccaccgtcggagattacagggaacaagaaacataggttccctaatctcagaggggaaagcagcaaatctcttgatgcattggtgaagaacacaggaaaagaatctctccaatgggggctagcggcagggttatactcaggtatcacttacggtatgacagaggttcgtggaggagctcatgattggcggaacagcgcggtagctggagcattgacaggagcggcaatggctatgacgacgtctgagaggacaagccatgagcaagtggttcagtctgctctcactggagcagctatttccaccgctgctaatctcctttctagcgttttctagatgatttgtattagaagctttaatgcataagggttgtttcatgtatc

SEQ ID NO: 438 - DNA, 1520 bp, Arabidopsis thaliana
tctcactctctccgtagtctgagactcgccggaaaagcttgtattggcttctcttcgatttctggcggaagtaaggatatcacgtgagctatgaagttcctcatgcaatccatttctgggaggaatcgatctctggttcgagctctagttagtcggcgttacttcgcttcatcgccggaggaaatcgcaaagagaaattacgccaacgatctgtcggaatacaacaccgctgtcaactccgtcacagctcagcgcaggcactatttgctgagggatgtttatgatgatatgaagcttgatggtgtgcagcctacagctgatatcttccattcatttgtcgtgggaacgatgaagggtgctcggttaagcgatgcgttctttttccgggaagaaatgaaagccatggggattgctccagatgtgaacttgtacaactttttaatttccacatgtgggaaatgcaagaatggaaaggaggcaatccgagtctatgacgagatgaagagatatgatgtaaaaccaaatggacagacctttgtctgcctgctcaatgcctgcgctgtttctggccagttagatcttgtatatgcgatagttcgggatatgactgctgctggtgttggtttgaaccagttctgctatgcgggactcataactgcacacttaaacaagcagcccagaccagataatctttctactaagattctcgagtttgtggagcagtcaaaaggctggtcagcaattgattcatcaaggaagagtgcagaagatgtgatgtttagcatcagtgaagaagagctgtacaatattccaaccgctgattattcccacaggaccaggtttctgcagaggaatttgactgtgtatcacgtagcattcagtgctctcgctgatctgaaggatgtaaaagcaacggaagctcttcttgagatgcttaagaaagacggaaaagatactgacacttactgcatgctacaaatcatgaggtgctatctacattcgcaagactttgagaatggtctcaaactgtttcaagattacatgagcgcagacaaaatccctgccatggaactatacacgacgcttatagaaggagctatgacaggatacaccgataatggaatgaagattgctcaggacactctgatccaaatgaacgaacgcaatttcttcttagacccaagaactggaagcaatctgttactcaaagccgctggtgaaaagacgggagggtacacagttgcaaatatgatatgggatctgatgctagctcggaatattctaccaacactagctgctgttgaagcttactacaagggcttgaaagaacgcgaaataccagaggatgatccgagactgatgttagtgacgcgaacatacaataacttgcggcttagggaagggacattacctaataggcgttaaagcaaagggaccaagaggaagaaagatggtatcatggcttcttcgttttctacttctatttgcttattgggatctctgtgaaccatctgggtatt

SEQ ID NO: 439 - DNA, 1474 bp, Arabidopsis thaliana
aaaggatcctcgtcttcctcctcctaaatcaccggcgataatggaatgctctgcaactcctcccaagctttatccaaccgtcgacacttcaaccaccgttgctcctctccctaagtcctcttcctcctcctcttctactaataataataatctctatccttcaatcaatgtcaatgatcttgtcaacaatatcttccccgatcccaccgcctctgactcagcttcagcgcctcctctcgcgacggaggaagtgattctcacaatccacggcgcgatggtccacctcattgacaaatcctacagcgtagagctcgcttgcggcgatctcgagattctccgtcttgttcaaggagatatcaccgtcgcggttttcgctcgcgtcggtgacgagatccaatggccgttgactaaagacgaacccgccgttaaagtcgatgagtctcattacttcttctcgctccgacccgttaaagaatccgagtcatcggatcattcagtcaacgaaacagagaacgagatgttgaactacggattaacaatggcttcgaaaggtcaagaaccgatgcttgagaagctagacaagatcttagctgattacagtagtttcacagcggaggagaaacagaaagaagagaacgttttggatttgacggcggcgaaggagacttcaccggaggagctgaagggaaagaggaaaaagatggtggagaagcagtgtacggcttattggacgactctggctccgaatgttgaggattacagtggcgttgcagcgaaactgatcgctgctggttctggtcaattgattaaagggatcttatggtgtggggatctcacaatggatagactcatgtggggaaatgatttcatgaagaagaagttgtccaaagcagagaaggagagacaagttagtcctggaactttgaaacgtctcaaaagagtaaagaagatgacaaaaatgacagagaaagtggcgaatggtgtgctctctggtgttgttaaagtttctggattcttctcgagttcagtgataaatagcaaagctgggcagaaactctttgggcttcttcctggagaaatggttcttgcaacacttgatggattcaacaaggtttgtgatgctgtcgaagtagcaggaagacacgttatgaaaacaacttcagatgtaactactgaaatcgtcgatcacaagtatggagcaaagacagcacaagcgacaaacgaagggcttagcgcagcagggcatgcttttggaacggcgtggactgttttcaagattagacaagctcttaaccccaagagtgccatgaagccatcatcactcgctaaaaccgtagttaaaacggcagctaaagagagaaagaaggggaaaaaaagttctaagtaggctaatggacgttgtgttgtttgtatatcaatatcattgccttggtacataagcattaaacagaccatagaggtttgaaggtacctt

SEQ ID NO: 440 - DNA, 985 bp, Arabidopsis thaliana
gaacgtttcagaatcatcaaccaaattcagaaaatttcagccatgacaggatcacaagaagaccaacctaagatcatcattgatcaagagcaacccaaaactctagaaacagagcaccaaccagaaccttcttcatcgtctccggatcagaagaaatggggtactcacgtgatgggagctccggcagctccagttgctcatcccgataaccaacaggcggcggcgtgggtcgctggagataaccagcagacgcagtaccaaccgtacgtcatctactctcctgtcgaacatccaacaactaacaaccctctcgagccagtcatcggaatgttccatacctggagtcgcaaggcagaaaccgtcgcacgtaacctctggcacaatctgaagacaggaccgtctatgtcggaaacggcgtgggggaaggttaatttgacggccaaagcgataacaaaaggaggattcgagtcgcttttcagacagattttcggaacagagccaaacgagacgctgaagaaaactttcgcttgttatctctcgacgacgacaggtcctgttgctggaactgtctatctttcgaatgctcgtgtcgctttttgtagcgatcgtcctctgtacttcacagcaccttctggtcaagaatcttggagctactacagggtggttgtacctttggcgaatgtagcgacggtgaatccggtggtggtgaaagagactccacctgagaagtatattcagttgacgacggtggatggtcatgacttctggttcatgggttttgtgaattatgagaaggctacgcatcatctgctgaccagtgtctccgattttcaaaccgcacacggctctgtgtctggttaaaactgttagagtaaaattcttttagaggtaatggagaaagtgtttaagtgttttgagagagttttttaggaaatagaacttttattactttgctttaaactttgaatacaacttcacaacattg

SEQ ID NO: 441 - DNA, 649 bp, Arabidopsis thaliana
aaacatcgaaatcttagagaagaagaaaagaaaaagaagagaaatgacagagaagaaagagatggaagtggtgaaagggctcaacgtggagagatacatgggccgttggtacgagattgcttctttcccatcaaggtttcagccaaagaacggcgtcgacactcgcgccacctacacccttaaccccgacggtaccatacacgtcttgaacgaaacgtggagcaacgggaagaggggttttatcgaaggcagcgcctataaggccgatcctaaaagcgacgaagccaagctcaaagtcaagttctatgtccctcctttcctcccaatcattcccgtcaccggagactactgggtgctctacatcgatcctgactaccagcacgctctcattggccagccttccaggagttatctctggatattgagcaggacggcgcaaatggaggaagagacgtataagcagctggtggagaaggcagtggaggaaggttatgacatcagcaagcttcacaagactcctcagagtgacacaccacctgagtccaacactgcccctgaagactccaagggcgtttggtggttcaaatctctcttcggcaaatagattacacggcacacaaagactttgtttcacctctttgatccttag

SEQ ID NO: 442 - DNA, 1088 bp, Hordeum vulgare
cttccgtccttgagccacgcccgcgaaaaccctacctccggagccatcgccgtcgccgtcgccggtcgagatgaagggcggcgacatcgaggcgggctacgccgacgccgcggcgtcgaagggggcggcgctgtaccccggggcgacggagagccccgagctgcgctgggcgctcatccggaaggtctacgtcgtcctctgcctgcagcttctcctcaccgccgtcgtcgcggtcgtcgtcgtcagggtccgggccatcccgcgcttcttcgtctcctcctacgccggcctcgggctctacgttttcttcctcatcctccccttcatcgtgttgtgcccgttgtccatctaccgccagaagcacccagtcaacctgctgctgcttggtgtcttcacagtggccatcagcttctctgtgggcttgacatgtgcctttaacagcggcaaggtcattttggaggctgggattcttacagtggttgttgtcttgagcctcactgtttacaccttctgggctgcgaagaggggcaaggacttcagcttccttgctcctttcctatttgcttctctcagcatgttgctcgtctttgggctcattcagatcttcttcccgctgggcaagctgtctcacacgatctatggtgcgctggcggcgctcatcttcagtggctacattgtctatgacacgaacaacatcatcaagcgttacacgtatgacgactatgtctgggccgccgtctcgctctaccttgacatcatcaatctgttcctgggcctgctgaccctgtttagggcggctgacagctaggcgcgtcgccctgcccctgctctctcgtgcttcaaatcccgtggacgaatgtggtatcctgacgagtcccttgacatgaagaattgcataggctggtctatcttgctggcacggtggaggtgcttcttagtttagttgagttattaatccctattagtagagagcaaacataagaaaactgctgtgcgtcggttgtattatacggatggtggatgtgatgctgggtttagggggggcttgacatgctggactgctggtgctgcgtttctgatatcatttg

SEQ ID NO: 443 - DNA, 645 bp, Sorghum bicolor
gctagggaagggaaggagaggcgaagcggagcggaggcgagatgggggcggccgagtccgtgccggagacctccatacacgaattcaccgtcaaggattgcaacggcaaggaagtgagcctggagacctacaaggggaaggtcctccttgttgttaacgtcgcctccaaatgtgggttcaccgaggttaattacacgcagctgacggagctttatcggaagtacagggacaaagactttgagatattggcattcccctgcaatcagttcttgcgacaagagccaggttctaatcagcagataaaagactttgcttgcaccagatttaaagctgaatacccagtttttcagaaggtgcgtgtaaatggcccggacgccgcgccggtttacaagtttctgaaagctagcaagcctggtttgtttggatcagcaagagtcaaatggaattttaccaagtttctcgtggataaaaatgggaaggtcgttgagagatacggaacatcgacggctccaatgtcaattgagaaggacatccagaaggcccttgatgaggaataaagatcccatgtcctcttgtctcgtctcatccatcacccacactggcagaaataggcactcgcagaagtattccgtcgtagcaacattt

SEQ ID NO: 444 - DNA, 1127 bp, Sorghum bicolor
ctctctagcctcaacgcctccgccccccccactcgcgagaccctagctagccctagcgccacccgccgactcacccggagagaggaggaggaggaggaggccttcgccgtggtcgtcggccgaggagcaggcgccaggatgttcgggtaccagaagggcgtcgacgtcgaggcggggacctccgccgccacgggcggcggcgcgcgccagctctacccggggatgcaggagagccccgagctgcgctgggcgctcatccgcaagatctacgtcatcctctccctccagctgctcctcaccgccgtcgtcgccgccgtcgtcgtcaaggtccgcgccatcccgcacttcttcaccaccaccaacgccgggctcggactctacatcttcctcatcatcctccccttcatcgtgctgtgcccgttgtacttctaccatgagaagcacccagtcaacctgatcctgctcggcctcttcaccgtcgccatcagcttctctgtgggcttgacatgtgccttcaccagtggcaaggtcattctggaatctgcaattctgacaacagtggttgtgctcagcctgactgcatacactttctgggccgtgaataggggcaaagacttcagcttcctgggtcctttcctgttcgcctccctcatagtgctgcttgtgttcgcactcatccagatactgttcccactgggcaagctctcccagatgatctacggtgggctggcatcactcatcttcagtgggtacatcgtctacgacacgaacaacatcatcaggcgcttcacgtacgaccagtacgtctgggccgccgtctccctctacctggacgtcatcaacctcttcctgtccctgatgaccctcttcagggcagccgactaggcgctctgctcccatcctgtcctatctacgcaagctgtgaataccttacgttggtccctgaatgctcgtctcgtgggttaagctcgggtgcccagaattccagttttaagagttgtgtatagctgcgttgccttttttacttactagtatggtcttattcggcttggctcggtcagagtcataatatcattaggtagttggaaagcgaacaaatgtactcctaccttgattatgtgcgtgga

SEQ ID NO: 445 - DNA, 958 bp, Sorghum bicolor
aaaggatcccgagcagtgagaggagatcgatcgagggcggtgaggtgacagaggaacagaggaggagaagcagaagatgtacttccggccgccgcccaagggcccggagtggtacgccggcgatgcggagacggggcaggcggcgcggccgctgtacccaatgatgctggaggacccgcgcctgcggtggtccttcatccgcaaggtctacagcatcctgtccatccagatgctgctcaccgtcgccgtcgccgccgtcgtcgtgtacgtccgccccatcgcgctcttcttcgtctccacgcccggcggattcggcctctacatcttcctcatcatcctcccgttcatagtgctgtgccctctgtactactactaccagcaccacccggtgaacctgctgctgctgggcctcttcaccgtcgccatcagcttcgccgtcggcctcacctgcgccttcaccaaaggggaggtaatcctggagtcggcgatcctgacggcggtggtggtgctgagcctcacggcgtacaccttctgggcggcgaagcgcggccacgacttcaacttcctgggcccgttcctgttcgccgccgtcatgatcctcatgctcttcgcgctcatccagctcttcttcccgctgggacgcatctcgctgatgatctacggcgggctggcggcgctcgtcttctgcggctacatcatctacgacaccgacaacctcatcaagcgctactcctacgacgagtacgtctgggccgccgtcgcgctctacctcgacgtcatcaacctcttcctctccctcctcacgctcttccgggcggcggattcgtgagcacggctctactcctacctgcctgcctgcgcagccagagaataatgatgttggatttggaatgtgccttgccttgccccgcctctgttaattggtatctgctggaattcagttcctctgctcgagttt

SEQ ID NO: 446 - DNA, 992 bp, Sorghum bicolor
aaaggatccctactcgttccaccacctacccctgtaatctcccggccggcgacgtcatcctcctcatcatcatcatccatggagggcaaggacggcaagcacgacgtacccgccaccacggccgcgccaccaccggccggcgcgccgcagcccgcggcgcctgcgcctcccgcggagtcggcgcggtggggcacgcggcagatgggcccgccagcggcccccggggcgcacccggagaaccaggaggcggcgcggtggacggcggcgcgcggggaccaggagctgccgccgtacgtcgtcatgggggagcccgtggcggtgcagaggggcaagggggatagccccatggaacacatcctcgacttcttcaacacctggagccgcaaggccgaggagctggcatccaacatctggttcaatctgaagactgcgccatccatgtctgacgcggcgatggggaagctaagcctgggcgccaaggccctgtccgagggcggcttcgacaagctgtacaagcagaccttctcctccagccccgaggagcacctgaagaagacgttcgcttgctacctgtcgacggccaccggccccgtcgccggcacgctctacctgaccaacatgaacgtcgccttctgcagcgaccgcccgctctccttcaccgcgccgtctggccagaccgcttggagctactacaaggttattatccctcttggcaagatcgcgacggtggagccggtgacgatgaaggagaacccgccggagaagtacgtgcacatcgtcaccgtggactcccacgacttctggttcatgggcttcgtcagctacgacaaggccgtgcacaacctcgtcgaggccgtctcccagcgctcccagtcccagcacggcgccggcgtcaccgctgccggcaccaagtgatgagccaccaccgctcgtgagtcttgggcgttttgcacccgcgtcgtgtatagctccgcctgtgcattctcgagttt

SEQ ID NO: 447 - DNA, 1525 bp, Sorghum bicolor
aaccgaccagctacgcaacgcaacaatggcttccgcttcctcgaatgccaagcagagcctctacccggatgttgaccagtcccaccctgatctcaacacccccttcttcgcgcccaccacctccaccggcgccggcaccaccgccgtgggcagctccctctaccccaccgtcgacccaaacgagctcgccgagaacctcttccccgagacggccgaggaggacgccgcgccgccgccgcccaccaccgaggagaccgtcgtcgccgtcccgggcgcgcagctccacctcgtcgaccccgaccgcagcctcgacctcggcgctggcacgctctccatcgtgcgcctccgccagggggaccactccgtcgccgtcctcgcgcgcttgatccccgagaagccccaccaacgccgcggcctcttccgcctgtttagcagcgggcggtctgacggtggcgccgagcaggagcccgtccagtggccgctcacccgcgatgtcgccgcggtcaagctcgaccccgcgcactacttcttctcgctccatgtcccgcacacggaccacccggacgacaaggatgacgccgaggatgccgaggcggacgcggaggcggcgctgagctacggcctcacggtcgttgggaaggggcaggacaaagtattggaggagctggacagggtcctcgaggagtacactaccttctcggtgaagcaggtggaggcggcggcgaaggagaagtcggaggtcatggacgcgagggcggtggccgagatcactccggaggaagctgtcggggataagaaggaggtcgtcgaggagaagtcggcggcgttctggacgacaatcgcgccgaacgtcgacgattacagctcgtcggtggcgcggctgatcgcgcggggctcggggcagctagtgaggggcatcatctggtgcggcgacatcacggcggagggcctgcggcgtggggaagaggtggtgaagaagagcgtggggcccagcgcgaagccgacgcaggtgaagcccagcactctcagaaggatgaagagggctaggagggttacaaagatgtccaacagggtggcaaactcaatcctgtctggtgttctgaaggtcactggctttgtcacaagcaccgtgttgaactccaaaccagcacaaaagtttttcaagttaatgcctggcgaagttattcttgcttcacttgatggatttgggaaagtatgggatgctgtagaagtgtctggcaagaacgtgatgcagacatcatcagttgtcacaacttctgttgtaacacacagatacggtgaacaagcaggggaagccacacacaattacctccacgctacaggaaatgctctcggagctgcgtgggcagtattcaagattaggaaagcactcgaccctaagggtaatttgaagaagtcatcttttgtaagccaagcagcgcacactgtagctaaagaatcaattgcgaggcaaaagaagaagtgagctggcctggtcgacagttcgactatgcccgtaatttag

SEQ ID NO: 448 - DNA, 1447 bp, Solanum lycopersicum
actttgatcacttcaatggcttccaaaaaccctaattcctcttcaatgtatccacaagtagcagtagttgaccaaaatgtccctttcccttcatctacttctcgccaaaacctttacccaaccattgacatgaacgaccttgtagaaaatctcttccctcaaaatgaccaaactgcccctgagcgacaacattattcaccatctgcccctcctgaaatccttgaagaaacccttctcgttatccccggttccattcttcatttgattgacaagcactattccgttgaactcgccatcggcgatttattcctacatcgtctccgacaagggaacaatatcgtcgcagtacttgttcgtgttggaaatgaaatccagtggccgttgaccaaggaccttgccgcggtaaaactcgatgattcacattactttttctcatttcaagctcctaaagacgatgaatcggataaagaatcatcagtcagtgacttggcaaatgactcgttgaattatggtttgacgattgcttccaaaggacaggagaaattattgaaggagctggatgacattttggaaaattacagtaactttgccgtgcagaaagtggaggaaaaggccgcggtagcattaggtggaccggtggcgaaggaattgtcaccggcggatttaaagtcggagaagaagaaggaggtgttggaagagagatgtgcggcttattggaccacattggcgcccaatgtggaggagtacaatgcaacagcggcaaagttagttgcttcgggctcaggacacttgataaaggggattttgtggtgtggagatgttactgcagatagattgaagtgggggaatgaggttctgaagaataggtttaagacaggttcgaagactgaggtcagtcctgagacgttgaagaggatcaaaagggttaagagagtgacaaaaatgacagagaaagtggcagttggagtcctatctggagctgtgaaggtttcaggattctttactaggtcccttgcaaataccaaagcaggaaaaaagttctttagcctccttccaggggaaatggttcttgccactcttgatggatttagcagaatatgtgatgctgttgaagtagctggaaagaatgtgatgtctacatcaggcactgtgacgactgaatttgtttctcacaggtatggagaagaagcagctaatgcaaccagtgaagggcttgatgctgcagggcatgcttttgggactgcctgggctgcttttaagatcagaaaggcactgaaccctaaaagtgccttgaagcccactgccctggccaaatctgctgctaaagctgctgctacggctgctgcagctgataagaaggctaagagttccaagtagtcacttattagtctgacctaaccattgaaggtgactcaagataacatgcattgcctctgacctcttcata

SEQ ID NO: 449 - DNA, 1420 bp, Solanum lycopersicum
aaaggatcccaaactgggtaatcaagaatccaaaaaaaaaactatggcttctcaaaatccatctcctcccaaattatacccagaagttattgattcaaacccagaatcatcttctccatttattacaaatacccaaaagaacaaatcatcttcttctatgtacccaactattgatatgaaagatctagcagagaatctattcccagaaactgaaaacagtcagcctaatcaaaattccaactttgtatcactggaagaagtgattgtccaaatcccaggtgcgattgtccatctgatcgacaaagaacgtagcatcgaactcgctagtggtgaattcgagattgttcaactaaaacagggcgacaacgttgttgctgttcttgcacgtgtcggagatcagattcaatggcctttagcgagagatgaagctgctgttaagcttgatgaatctcactatttcttcactcttcgtgtaccttctgaagcaaatgatgaagatggatacgcagagaatttactcaactatggtttgacaatagcttcgaaagggcaagaaagactgttaaaggagttagatttagtattggagaagtacagtgcgtttagagtggagaaagtgaagaaggataaaggggttgcagaaaaatggtggatggcgccaaaagatgtttcaccagaagagatggagaagaaaaaggaggatgtggagaggagttctgcggcatactggacaactttggctccgaatgttgaggattatagtagcagtattgcaagaatgattgcagccgggtcgggtcagttgataaaggggatattgtggtgtggggatattactgtggatagattgaagtgggggaatgatgtgttgatgaagaggatgggaaaaggaagtaactctgagattagccctgaggctatgagaaggatgagaagggtgaagaagatgacaaaaatgtcagagaaagtggcaactggtatactctcaggagtagtgaaggtctctggattcttcacaagttctattgcaaactcaaaagctggtcagagattctttagccttcttccgggagaaattgttcttgcttccttggatggattcaataaggtttgtgatgccgttgaagtggccggaaagaatgtgatgtcaacgacctcagtagtgacaactggtcttgttcaacagaggcatggtgaccaggcggcacagatgacacgtgaaggattcgatgctgcagggcatgctttagggactgcatgggcagtgtttaagataagaaaagctctgaatccaaagggtgctatcaagcctactacagttgcaaaagctgctgctcaagctaaccttgctaaactgaagagcaagcagaagtagatccggatgttccacttgccatcatctcttaactagctcgagttt

SEQ ID NO: 450 - DNA, 800 bp, Solanum lycopersicum
gagtaccacattccgaccacgacgacgatggccggtcaaccggagaagaagccagaatctgtctatgactttactctaaaggatgcaaagggaaatgatgttgatcttagtacctacaagggaaaggtcctactgatcgtgaatgttgcgtccaaatgcggtttgactgattcaaactacaaagatctcaaccacttacatgagaagtacaaagatcaaggcctggaaattttggcatttccttgcaatcaatttggtgcacaagaaccagggagcaacgatgagatcgtagaatttgcttgtacacgtttcaagtcagagttccccatctttgacaagattgaagtgaacggcgaaaacacatctcctctttataagttcttgaaatcagccaagtggggattacttggagataatattcagtggaatttcgctaagttcctcgttgataagaatggccaagtttctgatcgctattatcctaccacatctcctctctcaatggagagggacataaaagtgctgttggaaatcgagtagttgccaaggttgagccctcaacaatgtggatggatttcgaacttgttaatgctggcttcgttttattgtagtttgtcccattattaataaattactacatgtttctgaaactgatatccagttatttgatatttagacaaatattattattctgtcagtttgttttgtttgatgaagaattataagttcttgatgtttatttgtttccattgaagctctctatctattgaaggtaggggtaaggtcggcggtatacacta

SEQ ID NO: 451 - DNA, 747 bp, Solanum lycopersicum
cagctataaatgctttgttctacagctcgcgttcttctcatcccaaagcaaaatctcagtattttaaggcgattttcttcgattctaagacaaacccagttcaattctgtgtttaatcttcctgtttcgtctttctctaagccgatccgaacagttttacccaattctttggttacctctaagggttttgagttgtggggtttaagatcagatcataccatggctagtcaatcaagcaaccctcaatctgtttatgatttcactgtcaaggatgctaagggcaaggacgttgatctcagtatttacaagggaaaagtccttatcattgtcaatgttgcatcacagtgtggcctgactaattcgaactacactgacatgacggagttatacaagaagtacaaggatcaaggtttggagattctggccttcccttgcaaccagtttggtggacaggagcctggaaacattgaagatatccagcaaatggtctgcactcgcttcaaggctgagtaccccatatttgacaaggttgacgtgaatggtgataatgctgctccattatataggtttctgaaatcaagcaaaggtgggttctttggagatggtatcaagtggaacttctccaaattcctcattgacaaagaaggacatgtcgttgatcgctactctccaaccacttctccagctagcatggagaaggatatcaagaaactcttgggtgttgcttaagctctagagtctggataa

SEQ ID NO: 452 - DNA, 1169 bp, Solanum lycopersicum
ccttacaaacgtacaatcagtgtgagaaatagtttgttcaagttcttcgataatttgagagatgtggaacgaggcttaccggaaagatgacgtggagttcggcactgcgcctttgtatccggcgatgttggaaagtcctgaactccggtggtcttttattcgaaaagtatactcgattatttctatacagttgcttctgactattgcggtcgcctctgtcgtcgtcaccgttcatccaatttcacacttctttgcagccacaaatgcaggcttagcactttatattgtactcatcatcactccatttatcacgttgtgcccgttgtattactatcaccagaaacatccggttaactacttgcttcttggattgttcacggtttctcttgcctttactatcggattgacttgcgcattcaccagcggcaaagtaattctggaggcagtcatactgacaacagcggtagtgattagtctgacattatacaccttctgggcggctaaaagaggccaagatttcaacttcctgggaccttttttgtttggtgctcttattgttcttctgttgttttccttcatccagattcttttccctctgggtaagatctcagtgatgatctatgggtgtcttgcgtcgatcatattctgtgggtacattgtctatgatacagacaatctaatcaagcggtacacttatgatgagtacatctgggctgctatatgcttgtatctagacgttatcaatttgttcctctctttgttgtccatcttcagggctgctgacaattaaagagttaaagagaggaatacctaataataatttctctctgcatgtgtgtgaaagttctattatttgtttcctttctcctagttttccccctctcttttgttgtggatggtttgcttattgataattgtatagaaccgttttcttagttggaagaagtagaactgtatcgattttaccaaagatgacatccattgattggggttcctctaattctcctcttctgttgtttgagtcgttggaaaaggtcattaactcaataatcatacacgtccattggtcaggatcaatcactccggtggggttcgttttcaatctatgcccaatttctaactaactaattacttaaattagtggttcgtctttgacatatgcccaactt

SEQ ID NO: 453 - DNA, 665 bp, Hordeum vulgare
caaagctcccatcttttccccttccgtctccgtctccgtcgcctcgtcttctccgcgatccccaatccctcgatccccgatccgcccgcccccagcccggatccaggcgatggcggccgcgggagacgccggcgagaagaggatggtcacgctcaagagctcggacggggaggagttcgaggtggaggaggcggtcgccgtcgagtcgcagaccatccgccacctgatcgaggacgactgcgccgacaacggcatcccgctccccaacgtcaactccaagatcctctccaaggtcatcgagtactgcaacaagcacgtccaggccaagcccgccgacgccgccggacctggtgcgtccgatgcgccgccccccgccgatgacctcaagaactgggacgccgagttcgtcaaggtcgaccaggccaccctcttcgacctcatcctggccgcaaacttcctcaacatcaagggcctactggacctgacctgccagactgttgccgacatgatcaagggcaagactcctgaggagatccgcaagaccttcaacatcaagaacgacttcacgcccgacgaggaggaggagatccgcagggagaaccagtgggcctttgagtagaggagcatgtaggcgatgccatccgcactggatgaacaatgcttag

SEQ ID NO: 454 - DNA, 765 bp, Hordeum vulgare
ccaaccatggattccaccgccgacagcaagggcaagcgtcctctcttccagcccgatgacgtgtctgctgccgcatcggtgccggatgaggcggaggcggagccctcgtcttcttcggaggaggtgaaggagacggagccgggggcacagaagcagcaggaggagaagcccgccctggttctggtggcggaggatggcgtggaggtgcgcatctcggagcccgcggcgcggatgtcgcagatgctccgccacatgatggaggacggctgcgccgacggccgcatcccgaccgccaacatccactccgacatcctcgagatggtcgttgagtactgcgagaagcacgggccctactacgaccccgaggcctctgagcgcgaccggtaccccttcccgcccttcccagtcgagctcacccctaccgtctcctccatcaagcccgtcacctacgtcgacccggacccccacggtctcaaggactgggacagcgatttcatctccctcgacaactccaccctcttcgagatcatcctggccgcaaactacctgaacattgaggatctgctggacctgggcacctcggctgtggctgacaagatgagggggagaaagccagaggagatccgtgaaatctttgagattgagaacgactacacaccagagcaggaggctgaagtcaggaaggagaatgcatgggccttcgaggactaaaatatgacagttgatcttgcttttgtttatgctgctattcttggtttcaagtaa

SEQ ID NO: 455 - DNA, 631 bp, Arabidopsis thaliana
aaacagaggaagaggtgagatggaggaacttgtagggcttctgagaatccgagtgaagagagggatcaatcttgctcagcgagacactctaagcagcgacccttttgttgtcataaccatgggatcacagaagctgaagactcgtgttgtggaaaataactgcaaccctgagtggaacgaggaattaacccttgcgttaagacatcccgatgaacctgtgaatctgatagtgtatgataaagatacattcacatcgcacgacaagatgggagatgcaaagatagatattaaaccatttctggaggttcacaaaatgggtttgcaagaacttccagatggaacagagatcaagagagttgtgcccaacagagaaaactgtttggctgaagcgagcagtatcgtctccaataatggcaaaatcgttcagaacatgattcttctgttgaggaatgtcgaatgcggtgaggtcgagattcagcttgaatggattgatattccaggttctagagggctttgaacatatctctttctgtgtgtaataaaaaaaaaactcagttcgttttgggtttttagacaaaagtcacaataagtagaacagagtactactctgttttgtaattgaaatatttgg

SEQ ID NO: 456 - DNA, 894 bp, Arabidopsis thaliana
cgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaagatgactcagagtcaaaccaacgacggagctggagctggagctgttacgacggtagaatctgttcctcctcagcctcaatctcagcctcagcctcagccgcagcagcagagcaacgagatggttctgcatacgggaagcttgagttttagtagtcatatgtcgagagaagacgaagagatgactcgttctgctctttcggcgtttagagctaaagaagatgagattgagaagaggaggatggaagttcgtgaacggatccaagctcaattgggtcgggtcgaacaagaaaccaaacgtctctctactattcgtgaggagcttgagtctatggcagatcctatgaggaaggaagtttctgtggttcgtaagaagattgatagtgttaacaaagaactcaaacctctaggttccactgttcaaaagaaggaaagggaatacaaagaagcacttgatacattcaacgagaagaacagggagaaagtacagctgatcacaaaactcatggagatggaacagttggttggagaaagcgagaagttgaggatgattaagctggaggagctgagcaagagcatagaaaccgtgtgaaaaaggttgttcaagaagaactaattgggttcttttgtgtgatgtacctacctagtttaaaattttcatcatgtaagatgtgtgggttgcttt

SEQ ID NO: 457 - DNA, 1691 bp, Arabidopsis thaliana
aaaggatcctgagttataacgtttcggcttcccgacctcaaccgtcttctgctcctccgccccgccacagtttcttagggttcttccgcattgtttctccgaattgcaatcccctcattctccacaataaacagatagctaatataattgagtttggatactcgcaagtgaaaatatgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtggacttccaatgatcctctacgtgaaaaatacaacaagaaaatggcaggcatggatgctcctatcgcaaaaccaaaagggagcaagaagatgaaagattgggagtcttaaaccgcaccaacatttagtttgctttttaaaaaaaatccaaaacgatacagaagtgttatgtggtagtaaaaaacatcgtaacatcttactcagttatgtcttgagtcctctaaatcgtagtaattaaaaatattgctttgtggaagacatctagtcttttgtatcgggatcaattatgcatcaatcaaagctgtctgctctcgagttt

SEQ ID NO: 458 - DNA, 849 bp, Brassica juncea
cttaagaactaagcaaagatcccccatctttctcctatttaagcttctctccgagctctgcttttaccagaaaacatggcatcttattacagattccaatctgggttttgtcctctctcgccttgtccctctcttcttcttggaaacttcgtcgaacggatcaaagacgcttgtcatttcctcgtctccgctgttcttggcaccatcatatccgccgtcttgaccttcttcttctccctagtgggcacattgttaggggcacttacaggagctttgataggccaagaaacagagagcgggttcatcagaggagcagccattggagccatcacaggagctgtgttctccatagaggtctttgaatcgtccctcgatctttggaaatctgatgagtcttgtttcggatgccttctctacttgattgatgttattgttagtcttctaagcgggagactcgtaagggagcgaataggtcctgcaatgctaagtgcagtgcaaagtcaaatgggagctttggatgcaccctatgacgatctctcgagcctatttgagacaggaggcgcaaagggtttaacaggagaccttgttgagaagatcccaaagttgacaatcactgacaacaataacacagatgcatctgagaacagagagtcctgttctgtttgtcttcaggatttccagctcggtgagacagtaagaagcttgcctcattgtcatcacatgttccacttaccttgcatagacaaatggctcctcaggcacggttcttgtcctatgtgtagacatgacctttaatgtaaaccgtgcagctcagatacgtctacacacagctccttacctctcaagtaa

SEQ ID NO: 459 - DNA, 437 bp, Brassica juncea
caaagcgaaaatggcaggaagattgagcggtgtggcctcacggatcatgggtggaaacggcatcgttgcccgatccggcgcctcttctctccgccaacgcgccgggatgggtctccccgtcggcaaacacatcgtccccgataagccgctttcggttaacgacgagctgatgtgggacaacgggactgcgttcccagagccttgcatagatcgaatcgctgataccgtcgggaagtatgaagcattgggatggttgtgtggcggtctagggttctttgctactctgggtatgctcgctgttgtgaacgataaagcttctaaggttccatttacaccacgagtttatccctatgacaacctgagagtggagcttggaggagagccatagagacctgtcaagtgatctagactagatcatctagtcgagcgtgttttca

SEQ ID NO: 460 - DNA, 1472 bp, Brassica juncea
aaagtcgacacagccaatcgttatctcgtagagagagaaagcgcgggattctcgttttctgatctcaaacttacaaatggcgaacggagccggtagagtggatctggacggcaaaccgataaagccgatgacgatatgcatgatcggcgcgggaggtttcatcggctcgcacctctgcgagaagctcctaacggagactccgcacaaggtgctcgcgctcgacgtgtacaacgacaagatcaagcacttgctggagccggatactgccgagtggaaagatcggatccagttccatcgcatcaacatcaagcatgattccaggctcgaaggactcgtcaagatggcggatctgactattaatcttgcggcgatctgtactccggctgattacaatacgcgtcctcttgataccatctacagcaacttcattgacgcgcttccagttgttaagtactgctctgagaacaacaagcgtctcattcacttttctacctgtgaaatttatggtaaaaccattggaagcttccttcccaaggatcatcctctacgcgaggatccttctttctatgttcttaaagaagatgtttccccttgcatatttggttcaattgagaagcaaaggtggtcatacgcgtgtgcaaagcagttgattgagagactcgtttacgctgagggtgctgagaatggactggagttcaccattgtgagaccttttaactggattggacctaggatggatttcatccccggcattgatggtcctagcgaaggtgtcccccgtgttctcgcctgctttagtaataatcttcttcgccgtgagcctctgaagcttgtggacggtggagaatcacagagaacttttatctacatcaaggatgctatcgaagctgttcttttgatgatcgaaaaccccgagagggccaatgggcatatattcaatgtaggcaacccgaacaacgaagtcacagtacgacagcttgctgaaatgatgaccaaggtatacgcaaaagtgagtggagagggagcaatagagagcccgacggtggatgtaagctcaaaagagttttacggggaaggttatgatgacagtgacaagagaatcccagacatgaccatcatcaaccgccaacttggatggaacccgaagacatctctgtgggacttgctggaatcgaccttaacctatcagcataggacttacgcagaagctgtgaagaaggcaacatccaaaccagtagcttcctaaaatgttacaagtcccccagttatcaacacagacgccctgatttggcatttttaagaactctattcgattctttgttttttttcacatctcattgactcttttttttttacatttcttgttaagaaaacaatattattacattacgctagttcgccgtttcaagtataccgtctattttttgttctcctctcagctggtgtctttggccatgtatgttgaattcttt

SEQ ID NO: 461 - DNA, 1408 bp, Brassica juncea
aaaggatccatcgtcgttcgattcaaaaatcagttccaatgtctgataacaccgataaccggagagcaatatggggagttccggagaagcttcagcttcacatagcgatgctcacgttacaattcggttacgcaggattccacgtggtctcgagagctgctcttaacatgggaatcagcaaacttgtcttccctgtttaccgtaacatcatcgccttgcttcttctccttcccttcgcttacttcctcgaaaagaaagagagaccagcgattactctcaactttctcatccagttcttctttttggcactcatcggaataacagcgaaccaagggttttacttgttgggtctggactacacttcaccaacgtttgcttcttccatgcaaaactctgttcccgccatcacctttctcatggctgctcttctcaggattgagaaagttagaataaacagaagagacggcatctccaaagtcttaggaacagcactttgcgtcgccggagcttctgtcatcactctctacaagggtcccaccatctacacacccactagcaacctccacgctcacctcctcacaaccaactccgtcgcctccgctgtcttagcgccgcttggagacgccgcgccgaaaaactggactcttggctgcatctacctgattggtcactgtctctcctggtccggttggctcgtgtttcaagctccggttcttaaatcttatccggcgaggctctcggttacgtcttacacccttttgttcggaatcatccagttcgtgatcatcgctgctttctgcgaaagagattctcaggcttgggtttttcactccggttgggagcttttcaccatcctctacgcaggaatagtggcgtctggaatcgcgtttgcggttcagatttggtgtattgacagagggggtccagtcttcgttgctgtttaccaacctgttcagactttggtcgttgccataatggcttcgattgctttaggcgaggagttttacttgggcggtattattggagctgtgctgattatagcgggactttactttgtgttgtacggtaagagcgaagagaggaagtttgcagctctagagaaggcggcgatccagtcctccgcggagcatggtatagagcgtgcacccgtttctcgcggctccatcacaactccactgctccatcagtcaacgaacaacgtttgactaatggagtattcctcaataattacaaatgccattacccaattaaaagggggaacaatggtgtgccgttgtgttttatgacttttgtgtctgcttttttctttattttagtttttttttcttgatatttaattacctacgaaaggtttttgagagggaaaatggtggatgagacatcattgttcatgaggatgggtaccttt

SEQ ID NO: 462 - DNA, 1650 bp, Brassica juncea
aaaggatccttaaaaatggcgatgataggcttacttgaagtcttcgcagcattcttttttttcctagtattcaaacatttctttctccccaagaaatctcccggccagcctattctcaaaagctggcctgtcctcgggatgcttccaggaatgctcccccatatccctcgtatcttcgagtggacgttcgaagttcttgaggccaccaacttaacttttttcttcaaaggcccgtggcttagtggaacggacatgctattcacggccgacccaaggaatatccatcacatactaagcttaaactttgggaattaccccaaaggacctgagttcaagaagatcttcgatgttttgggagacgggatcttaagtgctgatctggagctgtgggaggatctgaggaagtcaaatcacgccatctttcatcatccagatttcttgaagctctcagcaagtagcaatacactcaagttaaaggaaggtcttgttccttttcttgataatgctgctcatgaaaacattgtcatagacttacaagatgtattcaagagattcatgtttgatacttcttcgatttcgttgactggtttcgacccaatgtcactatccaccgagatgcccgaagttgagtacggtgaagctacggaaaccggtgaagaagcgatctattatagacatttcaaaccggtcatcttgtggaggcttcaaaactggttgggtattggactcgagaggaagatgaggtcttccttagtgactgtcaaccgtatgtttgcgaagatcatatccacaagaagagaggagataagtagcggcgaaggcgagcaattaatggacgcgctaacgtattatataaatgtggacacgacaaaatataagctcttgaaacctagtaatgatacgtttatacgagacgttgctttcagtttattgttggcaggaagggacacaacaagttcagttctcacttggttcttctggcttctttctaagcatcctcatgtaatgaccaaaatccgacaagagatcaacacaaagtttgatccgacagatctagagaagctcgtgtatctacatgctacgttgaacgaaacaatgagactttacccaccggttcccttcaaccacaagtctcctttaaagtcagatgtgcttccaagcggacacaaagttaaagcagaatcaaagattgtgatctgtatctacgcattgggtagaatgagatctgtatggggagaagacgcattggattttaaaccggagagatggatttcagaaagtggagagctaaaacatgaaccttcatacaagttcatggcttttaatgctggtccgagagcttgcttgggtaaacatttggctctcccgcagatgaaaatagtagctgtagagatcatacaaaactatgactttaaggtcactgaaggtcacaagattgaagcagtgccttctatcgttctccgtatgaaaaatggtcttagtgtcacagtcactaagaagatgtgattcttattgataattggattactagtatttatgtgtttgttcggcgcaaatgtcatctaaagtattatttgtagttgtgttatttgtattatttataagtgtgtctctatttctattactatgtttgttccccgcggtaccttt

SEQ ID NO: 463 - DNA, 1156 bp, Brassica juncea
aaaggatcctcttgaagcttttgtcatgtcgtacgagaaagagctagccgctgcaaagaaagctgttgctctagctgctagtctcagccgaggagtacaaaagactctgatgcaatccgaagtatggacaaaatctgacaaaactcctgtcactgcagctgattatggatcacaagctgttgttagtcttgtattagagagggagctcaaacctgtaaccctctcattagtagcagaagaggtggatactggagatctacggaagaaagggagtgaggagtttctagaaggtataacaaagcttgtgagagatacactagcttctgatgaatcatacgcagactctcctgtaaccgcagaggatgtgttgaatgctatagactgtggtaaatcacaaggaggtagcagtggttgccactgggttcttgatcctattgatggaaccagaggatttgtaagaggagagcaatacgctgtgggattagccttgcttgtggaaggcaaagtggtggtcggcgttatggcttgtccgaatcttcctttgtcttctgcggttgttgagaaagacgacaagtcttgccaggataatgttggatgtcttttctttgctgcaactggttcaggagcttatgtgcaaccgctcaatggcaattctccaccacaggaggtgagagtgagtagcaatgagaatcttgaagaagcaaagttcttagaatcataccatatgccaattcccctccatagttccattgctaagaaacttgggatcacagcgttacctgtaaggatcgatagccaagcaaagtatgcagctgtgtccagaggagatgcagagatgtacttgcgcttcactcttgttggataccgtgagtggatatgggaccatgcagctggttcaatcatcacaacagaagctggaggcgtcgtttgcgatgttgaagggacacctctggacttctcaaaaggaaagcgtcttgatcacaacagagggatcatagttaccaccaagaaactcaagccattgattctgaaagctgttagagaatccatggaagaagagaatcttcgtgtctgagacacaactgaaactctacttgtatttgtatttgtattttgtctgaactgataaattgtgtgtgtattgcctctcgagttt

SEQ ID NO: 464 - DNA, 3347 bp, Brassica juncea
tttaggcctgtagccatgcttcgaactgcctcttgctcagcttctctcacctccgcctctcccttctttcgccacttccctctctcttactcgtccctgtcatcgtctacaggcgctctccgagcccccggtcgcaaccttcgccgggttgcctctcctgcatccaccggaagacgtgtctttctccgacgtgggttgagggttccctccaccgcaggtcgcggagtcaataggcaactctctcgcctctctgttcgggccgttgccacacaacccgcaccatcttatcctgatgtaggccaagatgaggctgagaagctcggatttgagaaagtatctgaagagtttatctcagagtgtaaatcaaaggctactctcttcaaacacaagaaaactggttgtgaggtgatgtctgtgtctaatgaagacgagaacaaggtgttcggtattgttttaaggactcctccgaaggattcaactggcattcctcacatattggaacacagcgttctgtgtgggtctagaaagtaccctctcaaagagccatttgttgaactgcttaagggaagtttgcatacttttctaaatgcattcacatatcctgatagaacctgttaccctgttgcttccacaaatacaaaggatttttacaatcttgtggatgtatatttggatgctgtcttcttccccaagtgtgtggacgacgtccacacttttcagcaggagggatggcactatgagcttaatgatccctcagaagacatctcttacaaaggtgttgtctttaatgagatgaaaggtgtctattcacagcctgataatattctaggccgaattgctcaacaggccatatctccagataatacatacggtgtcgacagtggaggtgatccaaaagatatccctaatctgacgttcgaggaattcaaggagttccaccgtaaatattatcacccaagcaatgccagaatctggttctatggagatgatgatccactccaacgccttcgtatcttgagtgaatacttggacatgttcgaagcaagtccatctcgagacacttcaaagatcgaaactcaaaagctattctctgagcctatcaggatagttgagaaatatcctgctggtagagatggtgaccttaagaagaagaacatggtgtgcatcaactggctgttgtctgagaagcccttggatttggagactcagctcgcgcttgggttcttggatcatctcatgcttggaactcctgcttccccgctgagaaaaatcttgttggaaagcggtttaggagaggctcttgttagtagtgggatgtcagacgagcttctgcagccccagttcagcgttggtatgaaaggtgtgtctgaagataatgttcagaaggttgaagagttgataatgagtacactgaagaagttggcagaagaagggtttgagagtgatgctgtggaggcgtctatgaatactattgaattctctctgagggaaaacaatacaggatctttccctcgtggtttatctcttatgcttcagtctattgcaaagtggatatacgatatggatccttttgagccattgaagtatacagaaccattgaaagcgctgaaagccagaattgctgaagagggttccaaggctgtcttctccccactgatagagcagtttattttgaacaactcgcatcgtgtgaccattgagatgcagcctgatcctgagaaagcttctcaagaggaagcggaagagaaaagtatcctggaaaaggttaaagccggtatgacagaagaagatcttgcggagctagcgcgtgctacagaggagctgagattgaaacaagagactcctgaccctcctgaagcactgagatgtgtcccaagtttgaacttgagtgacatcccaaaagaacctacttatgttcccactgaggttggagatattaatggtgtgaaggttttgaggcatgaccttttcacaaatgatattgtctacgctgaagtagtctttgatatgggttcgctgaaacatgagcttcttccacttgtaccacttttctgtcaatcactactggagatgggcacaaaagatttgagttttgtgcaactgaatcagttgattggaaggaaaacgggaggtatatcagtttatccccttacctcatctgtgaggggcaaggatgaaccgtgcagcaaaattattgttcgtggaaaatcgatggctggacgtgctgatgacctttttaacctgatgaattgcttgttgcaagaggttcaattcacagatcatcagcggtttaaacagtttgtctctcaaagcatagcaaggatggagaaccggttgagaggaagtggtcatggagttgctgcggcgaggatggatgcaatgttgaacattgctggatggatgtctgaacagatgggtggtcttagctatcttgagttcttacgcacgcttgaaaagaaagtggatgaagactgggaagggatatcatcttcacttgaggagataaggagatctctcctcgccaagaatggctgcatagttaacatgactgcagatggcaagtctctctcaaacatcgaaaaatctctagagaagtttctagatttactccctgaaaacccctctggtgggctagtcacttgggatggtagactacctctgagaaacgaagccattgtcataccaactcaggtaaactatgttggcaaagcaggtaacatatacagcacagggtatgagcttgatggaagtgcatatgttatatcaaagcatattagcaacacttggttatgggaccgtgttcgtgtaagtggtggtgcatatggaggtttctgtgatttcgattcgcattcaggagtgttctcattcttatcgtaccgtgatccaaatttgttgaagacacttgacatatatgatggaactggagatttcttgcgtggtcttgatgtggatcaagagacgcttaccaaagctattattggaaccattggtgatgttggttcgtaccagttgcctgatgccaaaggttatagcagtttgatgaggcatttacttggagtaactgatgaagaacggctaagaaagcgtgaagagatattgacaacaagtttgaaggacttcaaggatttcgccgaggcaatagatgtggttagagacaatggtgtagcggtggctgtggcatccgcagaagacattgatgcggctaacaatgcacgctccaacttttttgaggttaagaaagctctctaagctgagaactcctacactttatatgatttagaatctcattagatttgatctttgctttagcctttctctactggagtgtccttgctatggagctcaaa

SEQ ID NO: 465 - DNA, 3290 bp, Brassica juncea
aaagtcgacctgtgagagtgttcttacgtcttacggcggaggacggcaaagattcttcggcgtgcgacggttgtgacggcagaaaatgaaagagacgaggatttcctcgcgaaaaaggcgtgctgacaggggagaagacaggagaaaagacaaagagaaggagcaagcaggggggggagtggtgaatgagagattaccgctgcgtttgtttgcaacagaccgttatccgagcaaacgacacaactgtaactcttcgctagagtatctccttctggtgagggatgtgcttgagggaactgacgagatggagcagatgatgggttcgtgtttcggccacctattcaggttgcctttgcggaggtgtgctttttcggggaagctagtgcatgggatgcttacaaggcagctggtgacgaagaagaggtttgagttgtggccggtgttcggaggtatgccgacaaggttttcactggctgaatttggtcacgttacgggactgccttgtggagagtttgaagctgggtacgtagttgatgaccagacccgacctaagaagagcgactatgcgtattgggacatcctctttggtggcaaacgagatgtaacaattgcagatgtggcggctatggttgcaagtgataaggagatgcctgcatctaggaagttgaagctgtgtcttataataattgtcgatggtgtgttgcttgcgaccacccagtatccgaagccaacggtaaagcatgttaagcgtttggcgaacctgagaagttttttgtcatttccgtgggggcgcgagtccttctggtggacaataagcagcatgctaccgccgccgagggtgatgggtagatgcgatgatcctgagggagagttttgcaggaagctgcggcagaaaacgttaagtttggctggtttcccgctagcattgcagctatgggcatttgaagcgattccagggttagtaaagcgtttgggggggaacgatcagcaggatttgttgagttatgcaggggaaaagctcccacaacacactggattgtcgttgagtgcggtcctagatgccgagtttgatccagagctaagcgtgcagccgatggtggaagtagctgaggataaggaggaaggatggggagagtttgactgcgagattaacgataggaaagttgtctatatggttgagcaattaaagaccgggcatagatttgagaaatgggcttggggcggtggtgattcaggcgagccagagtatgtgcatgaagtagttgagaaggagaaggagaagaaaaggaagacaaggcatccgggcaacaaggaagttgaagcgccggttcttaagcaaagaaggttgagcaggtattttaaccggaaaggagacggtgatgggggcaggttagccgctctggaggtcaaaatggaggagatgagtggagtggttgctgatctgaaaaagattgtggcaagacagggtaggatgttgcgtaagaggaggacactagatcgcaagacggggaagttctcgcgcagcatgttatctaggcagagaaagagtcaaaggaatgttgcgacaggacagagaaggctgtttgatgaaagtgatgcaaaagattctgaggaagagggagctctggataaggaaacagattttggggggaatgacagtgagccggaggggatgaaagaaagcgcaatagtaccgctgaaggtggctaagaggggggatgcaacaaaagatgggcatcaggtatacttcggcagcagcagcaacacattttacgttacggaggataaggatggtgatgtgagtggagacataggaattgaaggggcagcggcagcatgtggaacttatgtggatcttgggggattggatcaactagtgggggcaattgtacatggagcagaggctgagggaaagggtggtgagagcaaaggggcggatgttgaagacaaatgcaggggtcagaatgtaccagaggtggaaaaagaaaaggatggtaagaggcaaacggtaggagatggtgcggctaaagaggatgcagtgaatagagaagagggtgagcgggaacgtaagattggggaagttgaggagaaggaaatggtggcagggaaaaaggatggaagtgttgataagaagggtgaggatgatgagggtgaggccggtagggaagatgttgcggcgaagggagaacgtggaagcccagaacaacaggtgcccgcaactgaagctgatgattacagtagagacgatgagcatggcttagatgcagctgatgaagtgatggaattgagtgattcatcaccatgcaagagatcagcgaagcatgagccggctgagagagagggagacttagcatccctattgttggctaaggagtcgtttactttggacaaaatagtaccagagaccgaagatggtgattttccatttttcgaacgtgtactgcttgcaaacccgaaagtgttgcatctcaatgctggaaaatatgatctggaaaatcatttttttttggatcttgcaacggcagagaaatgggtgtcaacaaagcacatggaagttttggttgattatgtggccagcagacatgaagaaaggctgaaagaaaggcgaagtcttttcctgccgccttggtttgcagcccatttgcaagggaaaagtaggcgtttcaacgctgcgagggccaacaaaggaaaggtgttggttgatggtaggctgacgggattattaactaaggaagggaagagatggggtcacgaagtggataggttgtacgctccgatgatttgggatgaaaaccactgggttggactctgtataagtttggttgattggcgtgtgcttgtactggatcctaacccagggctaagggatatgtcagcggtgggaattttgatggatccagtgttgaagatgctgccatatctggtggagaaggtatgtccaccacctgctgaaggggcatacaagttggatccatttaactgtgaaagaatgggtggtgtgtacgagaacacccgaagtggcgattgtgggccagtttccataaagtttatggaattgcatgctgtagggaacccacatcctggaatggaaggcttgagcgatgcgctggtggacatcatgaggaagcagttcgcaatggatgtgtacaaggattgggtagtaccactgtacattgggggatgatagagttttctctatatgtatttgttgtatggtaattggaaggttttagtttgtggtagattttgtatgatatggacgaaaatggtttgtaaggatggaattcttt

SEQ ID NO: 466 - DNA, 1771 bp, Brassica juncea
aaaggatcctgcgcctctctctgaaactctcaggtaatctttcttcttactccagttgtgctttcgcatcgtttataggcttagcttcgatgatttcgtattgataatcaaaccctttgcaaagatctcacctttattagttagtttgtagctcacagtcacagacaatcatggggaagaagaagttcatcgacaagaaaaaggcggcgactttcgagctctgccctcgcgacacgtcagaccctttatacagcgacgcaccaggaggcgataagatcttcctacgagtcgatcagaaccctgtgaacatcaacggtttcgctgaagacaactcacagttcgatgacgcccctgaagaaggagaagaagatttggcttacggctactccagcttcgcgggttcgagtagcaacaaccctttacccgctgatgtgaggaaggagattctcgagctaggctatcctgatgacgggtacaactacttggaccatttgagagagattaagaacactggcggcggttctaacttctacgctaaccctaagttcgaaggtgagtatcttcctcgtgacgtcaaggcttatgatgcgtctcgtgttaaggtctctggtgtggtggtggatggtgaggatgataagttgatgtatagcgtggcgtccaagactgttaatgttaaggtgaagaaggctattgatcctgaagttgctgctttgcttgaggacagtgatgggtctgagtttggttctgatgttgaggatttggaggaggattttgttgtccgagctaatcttgctgaagagggagagggttgttctggtgtgagccatgaggagtttgctagacctcctgtggcggctgagaacaaccagagagttcctcgtcagattgatgagttgtttgatcagcttgagcttaatgagtatggaagtgagagtgactatgatggggaagaagaggaaggagaagagttcaaggcgcagagcgttggtgattttatttacgagaagccgaaagattacgagcttgatgagaagtatatgaaccctgcggatctgttgaagaacagtgactctgcgaaagataaagaggagcttgagtacatcatccgcaggtctgtacaatacggtgagaatttggtaaacagcaacgaagatgagtttgtggaggtggttgaagaaagcagcgacgaaagcgagaagtgggattgcgagaccatagtcacaacgtactcgaatctcgataaccaccctggtttaatctgtgatccagagagtgcgaggaagaagctgagcgaagcgctagctaaagcaaagagtttgaatggtgggagtaggatcattaccctccaggggaaagagaagcttccggttgagtttttacccggtaggagagctgagcaaaccagtatgaaaccgaaagctgaaccggttaagaggaagactcatgggcaagagacgaaagaggagaagaaagagaggaaggctgctgtgaaaacagagaagagggaagcgaggaagatgaagaaagagacaaaggagctttatcggtttgaaacgcagcgtgctcagaaggctgttgctgtttctggtccatcttctattcctctttaaggtaataatactaaacgtttcccagagtctcttctgttaaacaaccagtttttttttaataccatttcatgtaatattttgtgtttttgtttctaaagattttgaatctcttttttgtatgcggaaaggtttagttgtgtttcaattaacgaggtaccttt

SEQ ID NO: 467 - DNA, 1223 bp, Brassica juncea
aaagatatctgcaactgaattagcagaggaggaggggaggggaagggagattcatggctgaacatcatcatcgcatcagagtctacttagcctctgctatcttacttttagcggttattaatacgggaattgcagcagagaatctttcccagcagaagctaacttcacgaattcttcagaatgagattgtgaaagaagtcaatgagaatccaaacgctggatggatagctgctttcaatgatcgctttgctaactccaccgttgcagagtttaagcgcctcctcggtgttaaaccaacacctaagaacgaattcttaggcgtacctgttgtaagccatgacattgacatctctctcaagcttcctaaagaatttgacgctagaactgcttggtctcagtgctccagtattggaaggatcctagatcagggtcactgcggttcttgctgggcatttggggcggtagagtcactgtctgacaggttctgcatcaaatataacatgaatatatctttatcagtcaatgatctcttagcatgttgtggattcctttgcggtcaaggctgtaatggtggctaccctatttccgcgtggcgatactttaagcaccacggtgtagtcaccgaagagtgtgatccatactttgacaatactggatgctcacacccgggatgtgaacccgcttaccctacaccaaaatgtgtgaggaaatgtgttagtggaaaccagctttggcgtgaatcaaaacactatggtgttagcgcctacaaagtcagacatggccctcaagacattatggctgaagtttacaaaaacggacctgttgaggttgcctttaccgtttatgaggactttgcgcattacaaatctggagtgtacaagcacataacaggtgcaaacattggaggtcatgctgtcaagcttattggctggggaacttctgatgatggcgaagattattggttgcttgcaaatcaatggaaccgaagctggggtgatgatggttacttcaagatcaagagaggaacgaacgaatgtggaatcgaacacggtgttgtcgccggtttgccttcagacaggaacgtctttaatggtattaatacatcagatgatgttctagtttcctcattttaaaactaaaaatcagaaaacaaaagacgtgtttctgtctcgacactctctgtaatatatgtaatttgcttcctgtttccaatgctcgagttt

SEQ ID NO: 468 - DNA, 2334 bp, Brassica juncea
cacggtggctcttggtttatccgagaaattagggtttaccatcggcgtgggtttacttccggcgaagaatgggtacttcggtgcaggtttctccactgtgcggagtttacaacgagaatccactcgcatacttggtctccatcgatggcttcaacttcctcctcgactgtggttggaacgacctcttcgacccttccctcctcgagcctctctccagggttgcttctaccgtagatgcggttttactttctcatccagatacgcttcacctcggtgctcttccttatgctatgaagcagcttggactctcggctcccgtttacgccactgagcctgttcacagactaggtctcctcactatgtacgatcagtatctatccagaaagcaagtctccgactttgatctgttcacgctggatgacattgattcagctttccagaatgtcatcagattgacttactctcagaacttccatctttctggcaagggagagggtattgtaattgctcctcatgttgctggacatatgctgggaggtagcatttggaagataacaaaggatggggaggaggttgtgtatgctgttgactacaatcatcggaaagaaaggcatttaaacggaactgttttacagtcttttgtacgacctgctgttctgattaccgatgcgtacaatgctctttataccaatcaaacccaaagccatcacagggacacagaatttctagataccatttcaaaacatttggaagttgggggcaatgttttattgccagtagacactgccggtcgagtcctggaacttctcttgatacttgaacagcattggtcacagagagcttttagctttcccatttactttctcacatatgtgtcgtctagcacaattgactatgttaagagcttcctcgagtggatgagtgactccatttcaaagtcctttgagacttcacgtgataatgcctttctattgaggcatgtcactctcttgataaacaagacggatctggataatgctccacctggtccaaaggttgttcttgcgtctatggctagtcttgaagctggttttgctcgagatatattcgtggagtgggccaatgatcccagaaatttagtcctctttactgaaacaggccagtttggcactttagctcgtatgcttcaggcagccccacctcccaaatttgttaaagtcaccatgtctaagagggttcctttggccggggaagagttgattgcatatgaagaggagcaaaacagacttaagagagaggaagccttgcgagctagcctcgtcaaagaggacgagacaaaagcttcccacggacctgatgataattcaagtgaaccaatggtcatagataccaagactactcacgatgttgttgggtctcacggacctgcatataaagatatattgatagatggatttgttcccccatccagcagcattgccccaatgttcccattctatgataacacagctgactgggacgagtatggggaggtcattaatccagatgactacgtgatcaaggatgaggacatggaccgaggagcaatgcatgcaggaggtgatgtggatggaaggcttgatgaggcaactgctagtctcatgctagatactagaccttcgaaagtcatatccaatgagctcattgtgactgttagttgttcactggttaaaatagactacgaaggtcgttcggatggtcgctcaatcaagtcaacgattgcacatgtttctcctctgaaacttgttctggtgcacgcaacagcagaggctacggagcatttgaagcaacactgcttgaacagcatctgtccgcacgtgtacgctccgaaaatagaggaaaccattgatgtgacttctgatctatgtgcctataaggtccaactctctgagaagctgatgagcaatgtgatcttcaagaagctgggagattcagaagtagcatgggtggattcagaggtagggaagacagagagcgagaagcggtgtctgcaaccaatggcaagtgcagcagctcctcacaaacccgtgctagtgggagatctgaaaatgcaagacttcaagcagtttctggcaagcaaaggagttcaggtagagtttgcaggtggaggagctttacgatgcggtgagtatgtcactctaaggaaggttggtccaactggtcagaaggggggagcatcagggccacagcaaattctgatagaaggaccgttgtgtgaagattattataaaatcagagattatctctattctcagttttacctcctttgaatggtataagagagaagatacaatttcttcttctgttgtttcctag

SEQ ID NO: 469 - DNA, 376 bp, Brassica juncea
ctaatgcacaccatcaatcttcctcattgtctcttggcctttggcttctgtaagggagagatctctctccagatctcttgttggctgcgcgggtttctctgctaagctcaccaccatgactcgaggaagccagagagagcgagaccgtgaaagggctcaagctcgtgccggaggcaagggaaagaccaaagacgatggtttaactccagagcaacgccgtgaaagggatgcaaaagcattgcaagagaaggcggcgaagaaagctgctcaagctgcaggagcagctacttccggaggaggaggcaaaggaaacaataataagaaatgatgtgtttttgtaactttctttcttttgaaatcgggtattgtttgtatg

SEQ ID NO: 470 - DNA, 2330 bp, Brassica juncea
atcgagattcttccttgtctgaagattctttctataaacaagtgatcgaagaatctttcaactaccactccctacatatttccgaagaaacatatccacttttccatttacaacaatataaagtgcgaggaagaagaaagaagatatggccacgtgtcctcctttcgacttctcggcgaaatattacaacggtggcggaagcggatgcgagaggcggagcagcttcttcggagatactacggtgctcgaccaaggcgttgggtacgccgttattctcgggtttggtgctttctttgccgtcttcacatctgtgttggtttggttagagaaacgatatgtgggggctcaacatacctctgaatggttcaatacagctggaagaaacgtcaagacaggactcattgcgagtgtcattgtgtcacagtggacatgggctgcgacaatactccaaagttcaaacgtcgcatggcagtatggtgttagcggaccgttttggtacgctagtggggccaccatacaggtactcttgtttggtgtgatggcgattgaaataaaaagaaaagctcctaatgctcacacggtctgcgaaatagtgaaggctcggtggggaaccgcaacacatatagtgttcttggtgttttgtctggcgacaaacgtggtagtgacggctatgctattgctcggtggctcggccgtggtgaatgctctcaccggagtgaatatatacgctgcaagctttctgattcctctcggtgtcattgtttatactttggcaggaggacttaaagctactttcctcgcaagctatgttcactctgtcatagttcacgtggttttagtcgtctttgtgtttctggtctacacttcgagtagtgagcttgggagtccctctgtggtctatgaccggctaagagatatggccgctaagtcaaggatatgcactgagccactctcacaccacgaccaagcttgcggtccggtcgacggcaactacaaaggctcttatctcaccatgttgagctctggtggtgctgtcttcggtatcatcaacattgtcggaaacttcggcactgtcttcgtcgacaatggttactgggtgagtgcaatagctgctcgaccttcatcaacccacaaggggtatttgcttggtggactcgtgtggttcgctgtgcctttctctctagccacctccttaggcctcggcgcacttgccctagacttgcctataagcgcagatgaggctaatcgaggtctagtcccgcctgctactgccattgctctcatgggtaaatcaggatccttgcttcttctcactatgcttttcatggctgtaacatcagctggttcttccgagcttatcgcggtatcatctctcttcacctacgacatctaccgaacatacataaatcctagagcaaccggaaaacaaatcttgaaagtctcaagatctgcggttcttggatttggatgtttcatggggattcttgcagtgatcttgaacaaagccggtgtttccctcggatggatgtatctcgcgatgggagttctcattggctctgcggttatccccatcgctttcatgcttttgtggagcaaagctaatgcatttggtgctattcttgggtcgatctctggctgtgttcttgggattgttacttggttatccaccgcaaagattcagtacggacgtgtcgatcttgataccacagggagaaatgctcccatgcttgctggtaacctcgttgctattctaacaggagggtttatccatgcggtgtgtagtctagtacagccacagaactacgattggtcgacgacgagggaaatcaaagtggtggaagctgaggctccaggggacgatatcgatgttcctgtagaggagctaaaagaagagaagctgagaagagccaaagcttggattgttaaatggggtcttgtcttcactctcctcattgttgtcatctggccagttctgtctctcccagcacgtgtgtttagcagaggatatttctggttttgggcaattgtggctgtagcttggggaactataggatcgattgtgataattggtttgcctttgatcgaaagctgggaaacgatcaagagcgtttgtatgggaatgttcactaacgataggttaatgaacaagcttgatgacttgaaccataggcttcaagctttaaccaaggctgtaccagaagctgagaggatttatctgcttgaaatcgagaagacaaagaaaaccgatgaagaaagttgaagaaagatcaatatggttatatgaaagattgattttcttctgcttttgtttatatgctttgcttgctcgt

SEQ ID NO: 471 - DNA, 1066 bp, Brassica juncea
agaagaaggtcggatgggagtggattactacaacgtcctccaagtcgatcgcaacgcctccgaagatgatcttaagaaagcgtacagaaaactcgccatgaaatggcatcccgacaagaaccccaacaacaaaaaagacgccgaggccaagttcaagcagatctctgaagcttacgaggttcttagtgatccccagaagaaagctgtgtacgatcagtatggcgaggaaggcttgaaagggaatgttccacctccaggtgctggtggagccacttacttctctaccggagacggtccaacgtccttccggttcaacccgagaaacgcagacgatatatttgctgagttctttgggttctccaggccatttggtggtggtggtggtggtacgagattctctagcagcatgtttggtgataacatttttgcatctttcggtgaaggaggaggaggagtcggtggtgctatgcatcatggtggagccaggaaggccgctcctatcgaaaacaagctgccttgcagccttgaagatctctacaaaggaaccaccaagaagatgaagatctctagggagattgctgatgtcagcggcaagacgatgcctgtggaagagattttgaccattgatgtgaagccagggtggaagaagggcacaagaatcacattccctgagaaaggaaacgagcaacccggtgtgactccagctgatttagtcttcatcattgacgagaagcctcatccggttttcactcgggagggcaatgacctcatagtcacacagaggatctcactcgttgaggccttgaccggctacactgtgaacctgaaaacacttgatggtcggagactgacgatcccagtcaccaacgtgatacacccagagtacgaggaagtggttccaaaggaaggaatgcccttacagaaagatcagacaaagagagggaacttgaggatcaagttcaacgtcaagttccccaccagattaaccttagagcagaagacaggagtgaagaagcttctcggataaattgagctataatcagtgagtgcataccagtcaaagcaa

SEQ ID NO: 472 - DNA, 2124 bp, Brassica juncea
tcttataggaagctagctacacttggtttcattttgcatgtggtggtgaataatggattctgagtcttggaagcttctcagaagtgtttgcatactttctttcctcctcggctctttctgtgtctatcaaagccttcatgctgttgttgctgcgcaagaagaacaagatacacaaccatccgtgactctgcaagtaaacgcttctaatggagctggacgactcattcctgatactctcttcggaattttcttcgaggagattaaccatgctggtgctggtggtttatgggctgaacttgttagcaacagagggtttgaagctggtgggcagaacacaccgtctaacatttggccttggtctattgttggtgatcagtcatcagtatatgtagctacggaccgttcatcaccctttgaacggaataaaatcgctttgagaatggatgtgatctgtgatggcaatggttgtccttcaggaggtgttggagtttataaccctggttactggggcatgaatattgaagaaggaaagaagtacaaggtggcgttttatgtgcgttcgagtggtgatattgatctctctgtgtcgttgacaagcttcaatggatcgttgactcttgcttctgagaagatcacagcgtctgcttctgatgtttcaaaatggattaaaaaggaggttgttctggaggctaaagggagtgatcatggtgcaaggctgcagttaacaacaaccaagaaagggtcattatggattgaccaagtctctgccatgccggttgatacttacaagggacatggctttagaaatgatctttaccaaatgatggctgatataaaacctcgtttcatccgtttcccaggtggttgttttgtggagggtgaatggttaagtaatgcattccgctggaaagaaactattgggccttgggaagagagacctggacattttggtgatgtttggaagtattggactgatgacggccttggccacttcgagttctttcaattggcagaagacattggagcagccccaatatgggtgtttaacaacgggataagtcataatgatgaagttgaaactgccagtatcatgccctttgttcaggaagcacttgatggtattgagtttgctaggggagatgctaattccacatggggatcggttcgagctgcaatgggacgccaagagccctttgaactgaagtatgttgctattgggaatgaggattgtggaaagacttactacagagggaactatattgtgttctatgatgctgtcaaaaaggcttatccagatatcaaaatcatctcaaactgtgatggatcatctagtcctcttgaccatcctgctgattactatgattttcatatatacacttctgctagcagtttgttttcaatgtatcatcagtttgacggaacttcacgcaagggtccaaaggctttcgtcagtgaatatgctgtgactggcaaagatgctggtacaggaagccttctcgctgctcttgctgaagctgcatttctcattggtcttgaaaaaaacagtgacattgtggaaatggcaagctatgcaccgctctttgtgaacacaaacgatagacggtggaaccctgatgcaatagtcttcaattcatctcatctatatggaactcctagctattgggtgcaacggttctttgcggagtcaagcggatcaactcttctcagttcagaactgaagggaaactcttcttctattgtagcctctgcaatctcatggaaaaacagtagccaagattacatacgcataaaggctgtaaactttggagatagctcagtgaacctgaaggtgttggttactggattggatccgaacgtgatgaaagtttcaggatcaacgaggacagtacttacatctacaaatgtgatggatgaaaactccttcacacagccagagaaggttgtgccacaagaaagcttgctagagatggctgaggaggatcttaccgttgttctcccgccacactcgttctcttcatttgatttgttgaaggaacctgcaaagatcagaaagccagtttctgattcttcctatcagaaaacctcaactatgtgatgagacacgattgatgatgacaaggagta

SEQ ID NO: 473 - DNA, 1644 bp, Brassica juncea
aaaggatcccggtcattcttattagagactcatagtattaaacaattgttttggttcttggtactgatatttgatacttatcagtaatctggaatctagtcgttttttattaagtaagtttatggagaagaagctgcttcttattacagtgtcgatcatcacgaatcttgtatttactattcatattctttatagaaactcaaccacatggaatccgacttggaccagtagagctgctattgaagcagaggatgcagcctctgtgtcatgctcaggccatggaagagcttacgtggacggtattggagtccttggcggcaagcaaccttcttgtgaatgcaacaattgctatacaggcaaagattgttctattcttctctcagattgtcctgtcaacgctaactcaggagaccctttgttcttagagcctttctggatgcgacaagcagagagcagcgcggctctggtctcgggatggcacaggatgagttatatctatcaagatgggacatatatgtcggaagcgcttgagacggtcatcaggaaactgcatagtgtggtgggaaacgctgttacagataacaggtttgtaatatttggaagtggaagcacacaattgcttgcagcagctgttcatgccttgtctttgacaaactcatcatcatcaggacccgcaaggcttttggcttcagttccatattacgctatgtacaaggagcaagcggagttctttgactcagtacatctcaagtttgaaggagatgcgtttgcgtggaagaatagcgagcgcaatgataataccacacaagttatagaggtagtgacatctccgaataatccagatgggaagctgaaaagagcggttcttgatggtcctaatgtcaaaacaattcatgattacgcctattactggccttatttctcccctataactgttccagctgatgaagatttgagcttgtttagtctctccaagactacaggtcatgctggctctagattcgggtggggtttggtaaaagacaaaactgtttatgaaaatatgaaaagatatatcactttgagtagcatgggagtttctaggacaacacagcttcatgttcttcaactgctcaacgtagtagttagggatggaggcgataatatattccattttggtcatgaaactttgaagaaaagatgggagacactgaacaaggtcttgtcactctctacacgtttctcgctccagaaaatcaaacctgagtactgcaactatttcaagaaagtcagagactttactccttcttatgcatgggtgaagtgtgaaaggccaggagacgcaaactgctatgagatattcagagaggccaagataacaggacgtgatggcaaagtgtttggatcagaggaaagttttgtgagattgagtctaatcagatcacaagatgactttgatcatcttattgatatgttgaagaagttagtcttacaagaaggtgtagaagctcattctatctgaaaacttgatgttgtcaacaaatgtctttaattcaatattatgtagtaacgtatttgtgcgactataattaagcctacaatgcccgttgtatgaaacctttgtaaatattgcgaaaatcagtcccaacgataactctcgagttt

SEQ ID NO: 474 - DNA, 818 bp, Brassica juncea
ggagaatgggagatctctacgctttagacttcgatggagttctctgcgatagctgtggagaaagctctctttctgctgttaaggctgcgagagtgagatggcctggtttgttcgtgggagttgattcagctttagaggaatggatcgttgaccagatgcatattgtgagacctgtggtggaaactggctatgagaatcttctacttgttcgcctactgttggagacgaagatgccctctattagaaaatcttcagttgcagagggattgactgttgatgggatattggagagctggggaaagattaaaccagttatcatggaagcttgggatgaagacgataaagatgctttgattgatttgtttgggagtgttagagatgattggattaacaatgacttgaccacttggattggtgccaatagattctatccaggagtgtcagatgcactgaagtttgccagctcaaagatttacattgttaccaccaaacagggccggtttgcagaagcgttgctgcgtgaaatagcaggtgtaatcataccaccagaaaggatctatgctctaggttcagggccaaaggtggaagtgctaaagctactccagaacaagccagaacatcagggcttaaagctgcattttgtggaagacagactcgcaacgctgaagaatgtcatcaaggagcctgaactagacaaatggaacctatacctaagtaactggggctacaacacagagaaagagagagcagaagctgaaagcattcccaggattcaggtcattgagctttccacgtttagcaataagcttaaatgatga

SEQ ID NO: 475 - DNA, 935 bp, Brassica juncea
gaatctagttttaccaatatccttccttgaataagattcaaatgacgacgatcatcaattcgggcggcgccatcgcgattcgcgaggtttgggcggagaatctcgaatcagagtttgagctaatcagcggaatcatagacgattatcctttcgtctcgatggacactgagtttcccggcgtgattttcaaatccgatctccgccgtggaaacccggccgatctctaccgcctcctcaaatccaatgttgacgcgctaagcctcatccaggtcggccttactctctccgacgccgacggtaacctccccgatctcggtgatggccgacgcttcatctgggagtttaatttcaaggatttcgatgtggcgcgtgacgcacacgctccggattcgatcgagcttctccgtcggcaagggattgatttcgagcggaaccgccgcgatggcgtcgactccgagaggttcgcggagctgatgatgtcgtcggggcttgtctgcaacgaggaagtgagctgggtgacgtttcacagcgcgtacgattttgcttacctgatgaagattctcacgcgccgggaactaccttgcgcgttgggtgagtttcagcgcgtgatgagagcgttgttcggagaacgcgtgtacgacatgaaacacatgatgaggttttgcgagaggaaattgtacggcggtttagaccgggtggcaaggacccttgaggttaaccgggaggttggaaaatgtcaccaagccggttccgatagtttgcttacgtggcacgcgtttcagaggatgagagatttgtattttcaccaagatgggccggagaaacacgctggtgttttgtacggacttgaggttttctaaaggattatcgactatttgtaatttaaatttaattaattaacttaattaatccttgtagtaaatgttactgtggaa

SEQ ID NO: 476 - DNA, 1457 bp, Brassica juncea
aaattatgaataagcaagatgttatgaagcttcagacttgtgttctgaaagtgaacgtacactgcgaaggctgcaagcataaagtgaaaaaacagttgcagaaaatcgaaggagtgtactctgtaaaagcagatgtagaacaggggaaagtcactgtcacaggaaatgtcgacccagccattctcgttaagaaactgagcaaatcagggaaacacgccgagatcataggcggtggcggcggtggaaaagagagcaacgggaaagctaatggtggtggcggtggtcaaccaatgcaattgactcctcagcagattcaacaaatcatgatgatgaaggctgctcacggtggtggtgggaaggatatgaagatgatgatgcctcctgtggcatctaaggatcatcagaagaagtctgttaagtttgaggaagaggaggaagacgatgagtttagtgaggaggatgacgatgagtttagtgatgagttcagtgaagatgattatgatgacgatgagttcgatgaggatgatgaagatgatgatgaaagaggaggtcatggtcatggaggtggaggaggcatgcctcctaataaggtgatgatgatgcctaacaagatgcctcaaatgggtgatggtggtggagctaagggacctaatgagattatgatgatgatgaatggtctcaaagccggtggtggcggaggaggtggtggtgggtttgagattccggtgaaaatgaagggaatgggtgagggtaaaatgggaaaagaagagaaagcgaacaagggaggtgggggtaaaaccggaaaagcagatgctaaaagtggtggtggccttctaggctttttcaaaaagggtaaaagtgaaaaaggaggtgagaagaagggaggtggtaagaaagaagacggtggaggtgataaggtgaaggcctccggtggtgggggaggaggtgatgataatgggcctaaaaagggaggaggtaagtcgaaaggagcagcccatggggcccatgatatcgatgagctcatgaaacatgtcaaagcaggtggaggaggtaacaagggcaatcataatcatattagtgccaaggggatgggtggcccaatggttcaaggtggtccaatgggtatgatgggacaccaaagcggctctttcccggcggttcaaggcttaccgatgagtggaggcggaggatattatccaccaccgcctcaggcaatgaaccaacaacagtatatgcaaatgatgatgcaacaacaacatcaacagcaacaggctgcatttcatggaggatatggtggtggtggtcacggtggagacatgtaccatccgatgatgtatgctcggccttacccggcagtgaattatgctcatccaccgccaatgccacctccacactcgggtccttatactgatatgtttagcgatgagaatccagctggttgtagtatcatgtgatga

SEQ ID NO: 477 - DNA, 914 bp, Arabidopsis thaliana
gaagaaagcttcatatttccaggggatacagttgaagcggcatggcaagagtcttcgaatcggattcgggttctggttgttccaatgtactgagtcttgacttaatcagagaatcgttgattaggcaagaagacaccatcgtcttcagcttgatcgagagagctaagtttccactcaattctcctgctttcgaggaatctcgttgtctagattctggaagtttctcttctctcactgagtttttcgtcagagagacagaaatcatccaagctaaggtaggaagatatgaatacccggaagagaatcctttcttccttgagaacattcctcactcggtttttcctacgcacaaatatccatcggctttgcaccctaaggctctatctgttaacattaacaaacaaatctgggatatttactttaaagaattgcttcctttgtttgtcaaacctggcgatgatggcaactatccatcaactgctgctagtgatctcgcctgtttacaagctctttcgagaaggattcactacggtaaatttgtagctgaggtcaaattcagagatgctccacaagattacgagcctgcgattcgcgctcaggatagagaggctttgatgaagctgttgacgtttgagaaagtagaagaaatggttaagaagagagtgcagaagaaagcagaaacgtttggacaagaagtaaaattcaactctggctatggcgatgagagtaagaagaagtataaagtggatccattgcttgcctctcgcatctacggggaatggcttatccctctcactaagctcgttgaggttgagtatcttctacgtcgtctcgattgaatattatttgtatccaaatctggccctgttaaagtgggccttaagtttttaagtgggcctgttgatatttgttag

SEQ ID NO: 478 - DNA, 837 bp, Brassica juncea
gaagaagatgaagctgaaagtgtatgcagatcgtatgtcacagccgtctcgtgctgtaatcatattctgcaaggttaatggaatcgaattcgatgaggttttgattatcttggcgaagcgtcagcaattatcccctgaattcaaagagattaacccattggggaaagttccaactattgttgacggcagacttaagctcttcgagagtcacgccatcttgatttatctttcctctgcattcccgagtgtagctgatcattggtacccgaatgatctttccaagagagccaagattcactctgtcttggattggcatcactccaatttacgccctggtgcagctggatatgtaatgaatagtgttctagctccatttcttggcggttctctggactcgaaagcagctgctgaagctgagcagatactaaccaagtctctgtccactctagagactttttggcttaagggcaatgctaaattcttgctcggaagcaaccaaccatccatagctgatctcagccttgtatgcgaacttatgcaactccaggttttggatgagaaagatcgtcttagattgttttctccttacaagaaagttgaggaatggattgagaatacgagaaaggtcacgcagcctcactttgatgtggttcataaaaccctttatggagctaaagacaaagttgagaagcagcggaagatgggaacaacaaccgtatctaaacctggttttcaatctaagatgtgagaacaaatttgtgtcggaggctgtttgtgaaaaccccggtttaggggatcactgtaataactcggttcaacatttacactgtaatcgga

SEQ ID NO: 479 - DNA, 200 bp, Brassica napus
agatcatgatttctgttgttgtcatcactgagctactggttgagtacacggcggcgctggcaaaactcaccgccgggattcttccgagacgtcaaggagacagagacgtcgtacgcatcggcggtttctctctacgttatcctcctcgatcgacgacaacgattccagatttctcttctcatctcgttgacttctgatga

SEQ ID NO: 480 - DNA, 4337 bp, Arabidopsis thaliana
agaagatgagtttcgcggcctataagatgatgcattggcctaccggcgtcgagaactgtgcttccggctatatcacccactctctctccgattcaacgctacagattccgattgtttccgttcatgatgatattgaagctgagtggcctaatcctaaacgaggtattggtcctttgcccaacgtcgttataaccgccgcaaatatccttgaggtgtacatcgttagggctcaagaggaagggaatactcaggagctgaggaatccgaagcttgctaagcgtggtggagttatggatggtgtctatggtgtttctctcgagctcgtgtgccattataggttgcacggtaatgttgagtcaattgcggttcttcctatgggaggtggtaattcttctaagggaagagattcgattatattgacatttcgcgacgccaaaatttcagttcttgagtttgatgattcaattcacagccttaggatgacttcgatgcattgttttgagggtccagattggcttcatctgaaaagaggaagagagtcttttccaagaggccctttggtaaaagtggatcctcaaggcagatgtggcggcgttcttgtttatggtttgcagatgatcatactcaagacttcccaggttggttctggactagttggagatgatgatgcgttcagttctggagggacagtttctgctcgagttgaatcatcttacataattaacttgcgtgatctggaaatgaaacacgtcaaagattttgtttttctacatggttatattgagcctgtaattgtcatccttcaggaagaagagcatacttgggctgggcgagtttcatggaagcaccatacttgcgtgctttctgcccttagtatcaattcgacattaaaacaacacccagtcatctggtcagctattaatctgccccatgatgcctacaaactacttgcagtaccatctccgatcggaggtgttcttgtgttgtgtgcaaatacaatccattatcatagtcagtcagcctcctgtgctctggcactgaacaattatgcctcctcagctgatagcagtcaagaactgcctgcatcaaatttcagtgtggagcttgatgctgcccatggaacctggatatcgaacgatgtggccctattgtcgacaaaatctggggaattgttgctgctgactcttatatatgatgggcgtgctgtacagagacttgatctttccaaatcaaaagcctctgtgcttgcttcggacattactagtgttggaaattcccttttctttttaggtagccggttgggagacagtttactggtgcaattttcctgtagatctgggcctgcagcatcattacctggcttgagagatgaggatgaagacattgaaggtgagggtcatcaagcaaaacgtttgaggatgacttctgatactttccaagatacaattggaaatgaggagctttcattgtttggttcaactccaaataactctgattcagcacagaaatcgttttcatttgcagtgagagattcactagttaatgttggcccagtgaaagattttgcgtatggcttaaggattaatgctgatgcaaacgccactggggtttccaaacagagcaactatgaattggtgtgctgttctggtcatgggaagaatggtgctttatgtgttcttcggcagtcaattagaccggaaatgattactgaggttgaacttccagggtgcaaaggaatatggacagtttatcacaagagctcccgtggtcataatgctgattcttctaaaatggctgctgatgaagatgaatatcatgcctatttgattatcagtttggaggctcgcacaatggtacttgaaactgctgaccttctcacagaagtcactgagagtgttgactattatgttcagggaagaacaattgctgctggaaatctatttggaaggcgtcgggtaatccaggtgtttgagcatggtgcccgtattctggatggttcttttatgaatcaagaattaagctttggagcctctaattcagaatccaattccggttctgaaagttccactgtgtcatctgtttcaatcgctgatccatatgttttacttagaatgacagatgacagtattcgtctgcttgttggagatccttccacttgcacagtttccataagtagcccatctgtacttgaaggctctaaaagaaagatatcagcctgtactttgtaccatgataaaggaccagaaccatggctaaggaaagctagcactgatgcgtggctttcgtcaggagttggagaggctgttgatagtgttgatggtggacctcaagatcagggtgacatatactgtgtggtctgttacgaaagtggtgcccttgagatatttgatgtgcctagtttcaattgtgttttctctgttgataaatttgcctctggaagacgccacctctctgatatgcctattcatgagctagagtatgaactcaacaaaaattccgaggataatacttcgtcaaaagagataaagaatacaagggttgttgagttagctatgcaaagatggtctgggcatcatacacgcccatttctctttgcagtattggctgatgggacaattctttgttaccatgcttacctatttgatggtgttgatagtaccaaagcagagaatagtttatcttcagaaaatcctgctgctttaaattcctctggtagttctaagcttaggaatctgaaatttctacgtatccccttggacacgtctacgagagaggggacttcagatggagttgcatctcaaagaattaccatgttcaagaatattagtggccaccagggattttttctttctggctcaaggccggggtggtgtatgttgttcagagagcgactacgatttcattcacagctgtgcgacggatcaattgcggcctttactgttcttcacaatgtgaattgcaatcacgggttcatatatgtcacagcacagggagttttgaagatttgccaattaccttcagcatcaatctatgataattattggccagtgcagaagattcctctaaaggccacacctcaccaagttacttactacgcggagaagaacttgtacccgctgatagtatcatatccggtcagcaagccgttaaatcaagttctttcttcactagttgatcaagaagctggccagcagcttgacaaccacaatatgagctcagatgatctccaacggacatacaccgtagaggaatttgaaattcaaattttggaaccagaaagatctggtggcccctgggaaactaaagccaaaatcccaatgcagacctcagaacatgcactgactgtgcgagttgtcacgcttctgaatgcaagcacaggggagaatgaaacacttcttgctgttgggactgcgtatgtccaaggggaggatgttgctgcaaggggccgtgtgcttcttttctcttttggaaaaaatggcgacaattctcaaaacgtggttactgaagtctactcaagggagctaaaaggtgctatatcagctgtagcctccattcagggtcatcttctaatatcatctggtcctaaaatcatcttgcacaaatggaatggcaccgaattaaatggtgttgccttctttgatgctccgccgctctatgtagtcagcatgaatgttgttaagagtttcatccttcttggtgatgttcacaaaagcatatactttcttagctggaaggaacaagggtcccaacttagcttactagccaaagattttgaatcccttgattgttttgctacagagttcttgattgatggaagtacgcttagcctggctgtctccgatgaacaaaagaatatccaggtattttattatgcaccaaagatgattgagagctggaagggtctgaaacttctttcaagggcggaatttcacgttggtgcccatgtgtcaaagttcctacgtctgcagatggtttcttctggagcagataaaataaatcgatttgctttgttatttggtactctagacggcagttttggttgcattgctccactggatgaggtcacattccggaggttacagtctctccagaaaaagctagtggatgctgttcctcatgttgcgggtctgaacccactcgctttccgtcaatttcgctcaagtgggaaggctcgacgatctgggcctgacagcatagttgactgcgagttactatgccattacgagatgcttccattggaggaacagcttgaacttgctcaccagattgggacaacccgatattcgattctcaaggatttagttgatctctctgtcggaaccagcttcttgtgatga

SEQ ID NO: 481 - DNA, 7939 bp, Arabidopsis thaliana
aaagtcgaccgattgttctgacctaccaacctggccccggtcaatctccgtggaaagaaatggcttctccgttggagtctcttctctccatctctggctctgtctctacaagctccactttaatcagactccggatcttccgccatgatatccccgagattctccagaattccgatatgacgtctgatattgcgcctgttatagttgacatgatattccaaacattggctatatatgatgaccgtgcctcacggaaagctgtagatgatttgattgtaaagggactgggaaatgttaccttcatgaaaacttttgcggccatgcttgttcaagttatggaaaagcagttgaaattttgttttgatacagtctgttacagactactaatttggtcatgtcttcttctggaaaaaagtcaattcgctactgtttcgaagaatgcatttgttagagttgcatcaacgcaggcttcattacttcgtatcattatggagagctctttccgtatgcggagggcttgtaaaagatttatgttccatttgttctctcagtcacaagctatctacagtttatatatggatgaagttaaaggttcacggattccgtacaaggatagccctgagttattaggactactgcttgagttctcttgttcgtctcctgctctatttgaacagtcaaaggccatatttgttgatatctatgttaaagatgtcctgaattctagagaaaagcagaaaccaaatcttagtaattgtttcaaacctcttcttcaacgcttgtcacatgaggaattccaaactgtcatccttcctgcagctgttaaaatgttgaagcgtaatccagaaattgtcctggaatcagttggatttctattagcaaatgtaaacattgatctaagtaagtatgccctggaactgctaccagttatactaccacaggctcggcatacggatgaagacaggcgtctaggagctttatcaatggttatgtgcttaagtgaaaaatcaagtaatcctgatactatagaagcaatgtttgcgtcagttaaagccataattggaggttctgaaggaagacttcaatctccccatcaaagaattggaatgctgaatgcagtgcaagaactggcaagtgctcctgaaggaaagtatattggtagtttgtcgaggacgatatgcagctttctcatagcctgctacaaggatgaaggaaatgaagacgtaaaactttcaattttgtctgctgtagcttcatgggcatcacgatcttctgttgccatccaaccaaacttagtatctttcattgctgccggccttaaggagaaagaagctctaaggagggggcatctccgctgtgtacgaatcatatgcagaaatcccgataccatatcacagatatcagacttgctatcccctttaattcaacttgtaaagacgggatttacaaaggcagtacaacgtctggatgggatatatgcgctactgatcgtttccaaaattgctgcctgtgacatcaaagcagaggatactatggtgaaggagaaattatggactttgatatctcaaaatgagccttcacttgtgcaaattactttggcctcaaaactttcaagtgatgattgtgtagtatgtgtagaccttcttgaggtgctccttgtggaacactcctccagggttttggaagcattttcattgaaatcactatcacagttgcttctctttctgctttgccatccaagctggaatgttcgtaaaacagcttacaattctgttacgaagatcttcctcgcgacttcacagctagccactactcttttagacgagttctcggattttctttccataactggggaccaaatcgtttcttctagaaccagtgacgcagataatcccgcggatcatcaagctcctttcgtcccctctgtagaggtgttagtgaaggctttgattgtcatttcatcggcagcagttgctggacctccaagctcatggattgttcgtgccatattttgctcgcatcatcccagcatagttggtactggaaaaagagatgctgtttggaagagattgcaaaagtgtctcaaaacttgtggttttgatgttgctacttttttgtctaccaatggggaaagtgtttgcaagagtctacttggaccaatgggtttaacgagtgctaaaactccggagcagcaagcggccgtatattccttgtccaccatgatgtctctggcaccagaggatacattcacagtgttcaagatgcatctacaagaccttccagatcgactgtctcatgatatgctctcagagactgacattaagatctttcatacacctgaggggatgcttttaagtgagcaaggtgtctatgttgctcagacaattggtgccaagtatacaaagcaggagccgagttctaatcattctctaaagaaaggattggctagtagagaaactgcaaactcagggagaagggacactgcaaagttgacaaagaaagctgacaaaggaaaaacggcaaaggaagaggcacgggaactgatgctcaaagaggaggcctcaacacgggaaaatgttcacaggatacaaaaaagtctttcgttggtgcttcatgcccttggggagatgggtcttgctaatcctgtgttttgtcacagccagttaccttttttggctacttttttggatccattgctgcgatcacctattgtaagtgctgcagcctttgaaaacttggtgaagcttgcacgttgtacagttcagccactgtgtaactgggctctagaaatttcaactgctctgcgtttgatcgcgattgatgaagttgatacttcatttgattttcgtccatcagttgacaaggctgggaaaacatatgagggtctttttgagaggattgtaaatgggttatcgatatcttgtaaatcaggaccacttcctgtagatacattcacgttcattttcccgatactggagcgaattttactgtcatcaaagcggacaaaactccatgatgatgtgctgcagattttatacatgcatctagatccgatgctgccacttccaagactccggatgatatcagttctatatcatgtgctaggtgttgttcccgcgtatcaagcatcagttggacctgcactgaatgaattgtgtcttggattgcaagcagatgatgtcgcaaatgcgctctatggagtctattcaaaagatgttcatgtcagactcgcctgcttaaacgctgtgaagtgtattccagctgtttccaaatgctcccttcctcagaatgttaaaatagcaacaaacatttggatagctctacatgaccctgaaaagtcagtggctgaatcagcagatgatttatgggcccgctatggtcatgatttggggactgattattcaggaatctttaaagcactttctcatataaatctcaacgtccgtttagctgcagcagaagcactggctgatgctcttcatgaaagcccgtcatcaatccagttatccctttcaactttattttctctgtacatccgtgatgctacgtctggtgaggatgtctttgatgctggttggataggaaggcaaggaattgccttagcactgcaatctgctgctgacgtattgacaacaaaggaccttcctgctgttatgacctttttgatatcccgcgcactggctgatcccaacacagatgttcgtggaaagatgatcaatgctggtatcatgattattgataagcatggcaaagaaaacgtttcattgctgttccccatctttgagaattatttaaataaagaggcatctgatgaagaggaatatgacttggttcgtgagggtgttgttatattcactggagcactagcaaagcacttagcaagagatgatcctaaagtacataatgttgtggaaaagctgttggaggtgttgaatacaccatcagaatctgtgcaacgtgctgtctcgacatgcctttctccacttgtgttatcaaagcaagaggaggcccctgccctttttttgaggctcttggataagctaatgaagagtgataaatatggtgagcgtagaggagcagcttttggtcttgcgggagtagttatgggctttggaatttctagcttgaagaaatatggtcttatagtcactttgcaagaagcacttattgacagaaattctgctaaacgtcgtgaaggagcattactcgcatttgaatgcctctgcgagaagcttggaaaattatttgaaccgtatgtgataaagatgttacccttacttctggtgtcgttctctgaccaagtcggagcagttcgcgaagcagcagaatgtgctgctcgagctatgatgtctcaactatctgcatatggtgtgaaacttgtccttccttctctactcaagggacttgaagataaagcatggagaacaaagcaaagcagtgtacagctcctcggtgctatggcattttgtgctcctcagcaactgtcccaatgtcttcctagggttgtgccaaaacttacagaggttttgacggatacacatccaaaagtccagtcagccgggcagttagcacttcagcaggttggaagtgtcataaagaacccagagatatcctctcttgtccccacccttctattggccttaacagatcccaatgagtacacacgccatgctcttgacacccttcttcaaacaacattcgttaattctgttgatgccccctcgcttgcactgttggtaccaatagtacatagaggattgagagaaagaagttctgaaacaaaaaagaaagcttctcaaattgtcggtaatatgtgttctttggtgacagagccaaaggatatgattccttacataggattgctccttcctgaggttaaaaaggttcttgtggatccaattcccgaagtacgttctgttgcagcaagggctgttgggtcacttattagaggaatgggagaggataatttcccagatcttgttccgtggctgtttgaaactctaaaatctgatacaagcaatgttgaaagatatggagccgctcagggattaagtgaggttatagcagctcttgggacagattactttgagaatatacttcctgacctcattcgtcattgttctcatcaaaaagcatcggtccgagatggataccttacgcttttcaagttcttgccaagatccttgggtgctcagttccagaagtacttgcagcttgttttaccggccattctggatggtcttgccgatgagaatgaatctgttcgtgatgcagccctgggggctggccatgtactggtggagcaccatgcaacaacgtctctgcctcttcttcttccagctgtggaggatggtattttcaatgataattggcgtatccgtcaaagttctgttgaactgcttggggatctattgttcaaggttgctggtacatcgggcaaagctctactggagggtggaagtgatgatgaaggtgcaagtactgaagcgcagggtcgtgccattattgatattttaggaatggacaagcgcaatgaagttcttgcagcgttatatatggtccggactgatgttagtttgtctgttcgtcaggcggcactacatgtatggaaaaccatcgtagcaaatacaccaaagacgttgaaggaaataatgccaattttgatgagtaccttaatttcttctttggcatcaccatcttctgagaggcgccaggtagcaggaagatcacttggagagctggttaggaagcttggtgaaagggtgcttcctcttatcattccaattttatctaaaggactgaaagacccagatgttgacaaaagacaaggtgtatgcattggcctgaatgaagtgatggcaagtgctggaaggagtcagttgctgagtttcatggatcagcttattcccacaattaggacagcactttgtgatagtgctctcgaggttcgggaatctgctggactagcattcagcactctgtataagagtgctggactgcaagcaatggatgagattattccaactcttttggaagccttagaagatgatgaaatgtctactactgccttggatggacttaaacaaattataagtgttaggacagcagctgttcttccacacatcttgcccaagcttgtccatcttcctctctctgccttaaatgctcatgctttgggagccttagctgaggttgctggtgctggttttaacacgcatcttgggaccatacttcctgctttgctctctgcaatgggaggtgaaaacaaggaagtccaagaattggcacaagaggccgcagagagagtggtgcttgtcattgatgaagaaggcgttgagactctattatcagaacttctcaaaggagtgtctgatagtcaggcttcaattagaagaagttctgcatatctgattggttacttcttcaagagtagcaagctttacttaattgatgaagctccaaacatgatatctaccttgattgttatgctcagtgattctgattcaacaacggttgcggtttcctgggaagctttggctagggttattggttcagttccaaaggaagtacttccttcatatataaaacttgtacgtgatgctgtatctacagctagggacaaagagcgcaggaagcgtaagggaggatatgttgttattcctggtctatgcctccccaagtcccttaagccattacttccagtatttctacagggtctaataagtggatctgctgaactaagagagcaagctgcaattggtcttggtgaacttattgaagttactagcgagcaagctttgaaggagttcgtcatacctataacagggcctcttattcgaatcattggagaccggtttccatggcaagtcaaaagtgctatcttggctacattaatcatcctaatacaaaggggtgggatggcgctaaagccattcctccctcaactgcaaacaacatttgtcaagtgtctgcaagactctacaaggaccatccgttctagtgctgcggttgccctgggaaagcttagtgcattaagcacaaggattgacccattagttggtgatttgatgacaagtttccaggctgcagattctggggtacgtgaggccatcctatctgcaatgagaggtgtaataaagcatgctgggaagagcattgggcctgctgttagagtacgcatttttgatctcctaaaggatctaatgcaccatgaggatgaccaagttcgaatatctgccacaagcatgctgggtgttttatcacagtacttggaagctgcacaactcagtgttctgcttcaagaggtcaatgatttatctgcttcgcaaaattggggtgctaggcatggctcagttctctgcatttcatccttgctgaaacacaatccttccaccattatgacgtcatcgctcttttcctctatgttaaattctcttaagagctctttgaaggatgagaagtttccattacgtgaaagctcgacaaaggccttgggaaggcttttgctaaaacaacttgcgacggatccttccaacacaaaagtggttatcgatgtcctttcatcgattgtctcagctttgcatgatgattcgagtgaggttcgaagaagagcactctcttcacttaaagcttttgcaaaagataatccatcagcaaccatggcaaatataagtgttatcggacctcctctagctgaatgtttgaaggatgggaacacaccagtgagacttgctgcagaaagatgtgctttgcacgtgttccaattaacaaaaggcgcagaaaatgttcaagcagctcaaaaatacattacaggattggatgcccgacggttatccaagtttcctgaacaaagcgatgacagtgaaagcgatgatgataatgtaagtgggtaggaggaaacatgttttcgccatctctgttgaatccatttcccgggttt

SEQ ID NO: 482 - DNA, 1991 bp, Arabidopsis thaliana
agagaatgaagtcttttgcggctaaggtagaagagggagttaaaggaatagacggaaagccgtcggtaggtccggtgtaccggaatcttctgtcggaaaaaggttttcctccgattgattctgagatcaccactgcttgggacattttcagtaaatcagtggagaaattccctgacaataatatgcttggatggcgtcgaattgttgatgagaaggttggaccatatatgtggaaaacgtacaaggaagtatacgaagaagttttgcagattggctctgcactacgagccgccggagctgaacctgggagtcgagtggggatctacggtgttaattgtcctcagtggatcatagcaatggaggcttgtgcagctcacactctaatctgtgtacctctatatgatacattgggttcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagcgacgagcttagccacaaggcttcagaaattggagtcaaaacatactcctggatcgattttctccatatgggacgtgagaaaccggaagacacgaacccgcctaaggcgtttaacatatgcaccataatgtacaccagcggcacaagcggtgatcctaaaggtgtggttttgactcaccaagcggtcgcgacttttgttgttgggatggatctctatatggaccagtttgaagataagatgacacatgatgatgtgtatctctccttcttgcccttggctcatattcttgaccgtatgaacgaggaatacttctttcgcaaaggcgcttccgtcggctattaccatggaaatttgaacgtgttacgtgacgatattcaagaactgaaaccgacttatctagctggagtaccaagagtgtttgagagaatccatgaggggattcaaaaggctcttcaagaacttaacccaagaaggagattcatcttcaatgctctctacaaacacaagcttgcgtggttgaatcgtgggtactctcatagtaaagcttcacccatggctgatttcattgctttcagaaagattagagacaaattgggaggtcgcatccggttgctagtatctggaggagcacctttgagccctgagattgaagagtttttgagagttacttgttgttgctttgtcgttcaaggctacggtctaacggagacacttggaggaacggctttgggtttcccggacgagatgtgtatgctagggacagtcggtattccagcggtttacaacgagatacggcttgaagaggtgtctgaaatgggctatgacccgctcggagaaaatccggcaggagagatctgtataagaggacaatgtatgttttcagggtattacaagaaccctgaactcactgaagaagtcatgaaagatggatggttccacacaggagatataggtgagattcttccaaacggagtactcaagatcatcgatcgtaaaaagaatctgatcaaactttctcaaggagaatatgttgctctcgagcatttggaaaacatcttcgggcaaaactctgttgtccaagatatatgggtttatggagacagcttcaaatctatgcttgtcgcggtggttgttcccaacccagaaaccgtcaacaggtgggctaaagatctcggttttactaaaccattcgaagaactctgttctttcccggaactaaaagaacacatcatttcagaactgaagtccacggcagaaaagaacaagctaagaaagtttgagtacatcaaagcggtgacagtggagacaaaacctttcgacgtagagagagacttagtgactgcgacgctcaagaatcggaggaacaatcttctcaaatattatcaggtgcaaatcgacgaaatgtaccgcaaattggcctcaaagaaaatctgatga

SEQ ID NO: 483 - DNA, 1979 bp, Arabidopsis thaliana
gtaagcgagaaaaatggcgagagaacatgcgatcggagaagccaccggaaaacgaaagaaacgcggcagagttgaagaagcagaagaatactgtaacgatggaatcgaagaacaagtagaggatgagaagcttccgttagaggttgggatgttctattacccaatgactccgccttcgttcattgtttccgatgctctggagccagattttcctttgatctatgtcaacagagtcttcgaagtcttcactggctatcgtgccgatgaagttcttggtcgtaactgtcgattcctacagtacagagatcctcgagctcaaaggcgtcacccattggttgatcctgtggttgtatctgagattaggagatgtcttgaagaaggtattgaattccaaggagagcttcttaatttcagaaaagatggtactcctttggttaacagactacggcttgctccaatacgtgacgatgatggaaccattacacacgtaattgggatacaggtcttctctgaaacgactatagaccttgaccgtgtctcgtatcctgtgttcaaacataaacaacagcttgatcaaacatctgagtgcttgtttccaagtggaagcccgaggtttaaggagcatcatgaagatttctgtgggatattgcagctatctgatgaagttttggctcataacatcttatctcggttaactccaagggacgttgcttcaattggttctgcttgcaggaggttgaggcagttgacgaagaacgagagtgtgaggaagatggtatgtcagaatgcgtggggaaaagagataactggaacactggagattatgactaagaagctaagatggggtcggttagctagagagctcaccactcttgaagctgtgtgttggcgtaaatttactgttggagggattgtacaaccttcccgctgcaatttcagcgcgtgtgctgttgggaaccggcttgtgctatttggtggggaaggggttaacatgcagccattggatgatacttttgttctcaatcttgatgcagagtgtcctgagtggcagcgtgtgagggtgacgtcgtcgcctccaggacgttggggacacacactctcgtgtctcaacgggtcgtggttggtagtctttggagggtgtggaagacaaggattgcttaatgatgtatttgtgcttgatctagacgctaagcatcccacatggaaggaagtagcaggaggaactcctccattgccaagatcttggcacagctcgtgcaccattgagggctctaaactggttgtctcaggtggctgcacagacgctggagtgcttctcagcgacaccttcttgttggatctgacaacagataaaccgacatggaaagagatcccgacatcatgggctcctccttctagacttgggcattctttatcggtctttggtcggactaaaatcctaatgtttggcgggcttgcaaatagtggtcatctaaagctaaggtcaggggaggcatacactatagacttggaggatgaagaaccaagatggagagagcttgagtgtagcgcattcccaggcgtggttgtaccgcctccaagactagaccatgtggctgtgagcatgccgtgtggtagggtcatcatctttggagggtcgattgcagggcttcactctccttcgcaactgtttctaatagatcctgcagaagagaaaccgtcatggaggatcctgaatgtccccgggaaaccgcctaagttagcttggggacatagcacatgcgttgttggaggaactagagtattggtccttggtggtcacactggtgaggaatggatactcaatgaattacatgaactctgcttggctagccggcaagactcggatctgtaaagactctttccttcttcatttggtttgtggttttgtatctgtcacattccaaactcttacgacatgtagaagagatatatcagaagctagaagcgtgtgtacatag

SEQ ID NO: 484 - DNA, 2748 bp, Oryza sativa
cggagttgataccaaacaaggaattcatcaatggcagcgcatacagtgacggacccactggaggagctatggaaccacacgatgtcgatggacaagacgcacctgatgtgcttctacccgagcaagatcaccatgggtggcgtctggacgggcgacaatccgctcgacttctccatacctctcctcctcttccagatcctcctcatcacctccaccacccgcgccgccaccctcctcctctctcctctccgtctccccacctacatctcccagatcctcgccggcttcctccttggcccctccgtccttggccacctccctcacttctccaacctcgtcttccccgtccgtagcctcttcgtccttgagtccatggcccttctcggcctcgtctactacaccttcatcgtcggcgtcgagatcgaggtctccgccatcacccgcgccggcatccgtagcttcggcttcgccattggctgcacgctcccgcccttcctcgtcggcgctctcaccggctacgtcgcgctcagcactgacgacaaacacaagggtgacacgttcctcaacaagctctccttccccatcttcctcggctccaccttctcctccaccgccttcgccgtcctcgcccgcaacatcgccgagctgaagcttgccggcaccgacgtcggccagctcacgctctctgcgtcactcatcaacgacaccttcgcctggaccggcctcaccgtcgccacggtgctcggccactcgcgctgcaccatcacgcagaccacgtggacgctcacgtcgggcgtcgtcatcttcggcgccagctacctcctgctccgccccatgctcctgcggctggcgaggcgcgccgccgagggggaggcggtcggcgaggaccgcgagtgctggattctgatcggcgtcatggtggcggcgctggtggcggacgcggggggcacgcacgccatattcggcgccttcgtgttcgggctcgcggtgcccaacgggccggtcggggtggcgctggtggagaaggtggaggacttcgtggtgggcgctctgctcccgctcttcttcgccctcagcggcctccgcaccgacaccgccaagatcaccaacatgcattctgccgtgttgctcatggtcgctgccatggtcgctgcggtcttgaaggtcgtcgccgcaatcggcgtcgccggtgtgttcggcatgccgctcggtgacggcacgtccatcgggctgttgctcaacaccaaggggatcatcgagctcgtcatcctcaacattgcaaggaacaaagggattatgagtgaccagtcgttcacggtgctggtgttcgtgtcagcgctgatcacggcgatggtgagccctttcctgggcatggtggtgaagccggcgcggcggctcgtgttctacaagcggcgcacggtggcgtgggctcacccggaatcggagctccgcgtgctggcctgcgtccacgtgccgcgcgacgtgcccgcgctactgacgctcctcgacgtggtgacgccgtcgagccgatcgcccgtgggcgtcctcgccctccacctcatcgagttcgtgggccgctcctccgcgctcctcctcatcaacgcctcggcgccatcgtcgtcctcctacgacgcctccgtccacgggcgcagccacacggagatgcagttcaagcacatctcccacgccttcatggcgtacgaggagcagtcggtgggcgtgtcggcgcgcaccatggccgccgtctcgccgtacgcctccatgcacgaggacatcacctccgccgcggagaaccagcactcggcgctcatcctgctcccgttccacaagtaccggtcggtggacggcggcctggaggtgtcccacccggcgatacagccgctcaactgcagcgtgcagagcttctcgccgtgcacggtgggcatcctcgtggaccgtggcctcgcggcggtgccgggtggcgggtaccgcgtggtggctctcttcttcggcgggagcgacgaccgggaggtggcggcgctggcgacgcggatggtgaggaacccgaccatcgacctgacattgctccggttcgtccagaagggaggaagcttcacggcgagcgagttcgacgcgctgaaagagcggaaggccgacgaggggtgcctgcgcgacttcctggagagggcgaacgagggcggcggcgcgacggtggagtacagggagcgcggcgtgttcaacgcgagcgagatggtgggggagatacagagcgtggaggccatggggaacaaggacctgttcgtcgtcgggaaggtgcccggggggtcagggctgacggcgggcatggcggagtggagcgagtcaccggagctggggcccatcggcgacctgctggcgtccaaggacttccagacgacggcgtcggtgctggtgctgcaggcgtacgggaggccggcggcagtggtgggagcgggagcgggagcaatgtcggtggattttggcggcgacagcgtggcgatggcggagaggacagccagtgggcgtaggccatgggcacgaccgggtgtatgatcatcgatcatcggagaatttttctttctagaattggtgaccgttgagatagatgtaggaatagctgataatatggtgtggataattgcatattatggtataaaatttatacatagtgcaaagcttaaacatagttcttggaaaaataaagctaaataaccatacactagcatgttgttaatcaagcagtcatcgttg

SEQ ID NO: 485 - DNA, 568 bp, Hordeum vulgare
agacgaatcaaagctccgacgcgccccgacaaatggcatctaagctggttctcctcgtggccacgctagcgtgcgtgctcggcggcgccgaggcgaagctcggcaggctggtcgtcagcggcgtcgtgccgtgcaacaccggcagcctcatcgacatcgccacctcccctgcgttcccaaacgcggaggtggagctgcggtgcgcggggcaggtggtggcgggcgcgacgaccaacaccaacgggtccttcacgatggaggcggacctgacgagcgcgctggcggcgttcatcggccggtgctcgctggtggtggacacgccgctcatcaagtgcgatgcccagctgccgccggcggggaggctcgtgtcctacctgcagggcccgctcaccaggctgctcggcggcatctttcacctcttccccgccggcttctcgttccacagccgatgaaattagctccttgtgtcgtcggtccaacgatttcagcatactgagatctggttaactacctcttgtatatctttagtttggtttgaaatgaaatgtatctcaagttgcaggagctg

SEQ ID NO: 486 - DNA, 1106 bp, Brassica juncea
aaactctccatctctacacgatacgaaaatctctctctaaatacaaaagctctcgcttctctctaacgacgaaccctaactccggcccggtttattccggagccggagaccccctctttcccctttttttctttttttcttttgctcccttccccccacttgacgctggtcgagatgctcgatgctctggctcggcaaatccaccttaagttttcttcttgagacaaacggtggtgagatccggtctctggagtagcggcgagaccaacgtgacggtggtgtggaaaggagtcggcttttagggcttacggagaaaccaaatctgattttcccctttctagatctccggtgactctggttcagcgacggcgcgtggcctcgggaaacgtcttctccaccgtggatctatggtccctcacgacggtgagataaaaggagaaggtttgtgatggtgagctgacagagaaggatctccaggtataagtaccggttctcggagatcacacgaatcacgactcacgcggacaaggtacacaacatgagattacattagcggcgtttcgtggtggtggtttctattccccagagcagaaagctacaaccaatggatggcaccgattctctaaagctcgtattaggtacaccaacccgcgctttttgtagctgaaacccgactttcattcggatctcgtgtccgttttaggctgagggtcacagtgattgaagaccagcaggatgagactccctcgataatgcacctatggtgaagaagctaagtgaccatgtactttgaagccaagctttaggatcatttagtttgtttttaattggttcgggggttgttcttagttccggttgtgttagtaaacattgttgtaccatgaggttgaattttaggtggttgaaggggtggattgcttcgggtcgtggagtgatttcatcccactgtggttgaaaaatacaatgaaggatgttaggttgcgttggttccaagtagtgaatcagggtggaactagactacttcattgtatatgtggtagaaatcttgtgtggtcataagctttgtattaagaattggtgaaatgaaatgttgttgttgagccaaa

SEQ ID NO: 487 - DNA, 1175 bp, Brassica juncea
aaaggatccagacaatgttctgagagagaaacagagagacaccggagagatttcaatccctagttccggccggccggtttggctgtgccggaggcgattctctttccccttcctcattttttctttgctttcctttccccagctcaaaaccgagacgatatgcaagctattctgacatggccgtttcctccggagctcgtgttgtagacggagacgatgtcttgtttggagttgcggcgagtctaggtctagactgagaggaggaggatcggcttttaggattgaagggtaggccagatctaattttcccctttcggatctagggtttaaccttcctggtaatggcgcgtgaagcgggtttgacgactcctttggctcggaatcacctccttacgtgacagtgagaagggtggaggagaggtgtgataaaacggaggtaggaggcttgctgacagggtgaactctcctgaagccttcatcagggtctcaattgcttttccattgccaagatccgtctttcagtccggacttctgtccggcttggccatggtgcgagacggcgaacgatggtggcacgaatcgaagcgggtttgcgactttaggtgatgatgcagctgggttacggtctcgactcatatcctttggaatcctcagctttgaatttgtattggagcccgttttgattcttggttacagtttgttcattgcatccacatcacatggtctttagagtagttttttcagtcggactctatgtccgtacgtggctaaggacaatagcaattgaacgccagcagatacaagcctcccgcggaaacgcgccttcgggtgaagatgctactggcaacgtacagaatgtcgatcctatgaggccatagcttggtgctgaactgtttttttcggtatagaattgtgtttgctgtgttagtagttgttttctgtcgtgtgtagaatgtaggggtctaagaggtgagtctcatttcgagttgtggagtgagctcattttcgttgtggttaaaaatgcaatggtgtttcagttgggtagcgttgaatccaagttagtgattcagggtgttactagactacaccattgcatcagtggtcaaattctgtagaggtcaaaatgtttgtaccttattgaattggtgaatgaaagtgattattgactcgagaaa

SEQ ID NO: 488 - protein, 269 aa, Arabidopsis thaliana
MVMDSSKWWWIGNHNTTNFSPWLHSTLSELDEKTKEMLRVIDEDADSFAARAEMYYKKRPELIAMVEEFYRSHRSLAERYDLLRPSSVHKHGSDSESHEKSSTCDESSWSEACETHEEYAESEIDNGESKWVDESEIDGIVEEIEPSEVVYSEGNGNSEMMKIEIERLREENKVYSEMVREKDEEKREAIRQMSVAIQMLKEENSELKKRVTNTVVARRNKEGGDSQRKQQMWKPFEFKKIKLEGLWGKGFGNWALPNTDSTSKELMTL

SEQ ID NO: 489 - protein, 355 aa, Arabidopsis thaliana
MRRINSLYGRIGLLKRVPEKSTKQAHTFLASLSFSTEGAYGGDGEFQQNSSKVKIFDRDLKRIHRDRAAWLSRQKNDSFVDAVADNLLDRLEDCKKSFPTAFCLGGSLGAVKRLLRGRGGIEKLIMMDTSYDMIKSCRDAQDDSLDNSIETSYFVGDEEFLPVKESSVDLIISSLGLHWTNDLPGSMIQCKLALKPDGLFLAAILGGETLKELRIACTLAHMEREGGISPRLSPLAQVRDAGNLLTRAGFSLPGVDVDEYVVKYKRAMDLIEHLRAMGETNALLERNKILNRETAVATAAIYDSMFATEDGTIPATFQVIYMTGWREHSSHPQAKRRGSATVSFTDLQKQFGGQS

SEQ ID NO: 490 - protein, 406 aa, Arabidopsis thaliana
MQAIGSSHGRRLCFNHYLSDSFSKFLSPSSSPSLLPQRCHSFCIPKLGSSSTNENGRGRSVTVRASGDEDSNENFAPLAPVELESPVGQLLEQILRTHPHLLPVTVDEQLEKFAAESESRKADSSSTQDILQKRISEVRDKERRKTLAEIIYCLVVHRFVEKGISMIPRIKPTSDPAGRIDLWPNQEEKLEVIHSADAFEMIQSHLSSVLGDGPAVGPLSSIVQIGKIKLGKLYAASAMYGYFLRRVDQRYQLERTMNTLPKRPEKTRERFEEPSPPYPLWDPDSLIRIQPEEYDPDEYAIQRNEDESSSYGLRSYVTYLDSDTLQRYATIRSKEAMTLIEKQTQALFGRPDIRILEDGKLDTSNDEVLSLSVSGLAMLVLEAVAFGSFLWDSESYVESKYHFLKA

SEQ ID NO: 491 - protein, 481 aa, Arabidopsis thaliana
MSPSDESTNGSRCSSCISSDNDGNDFGKSDEFTCKQCKNSDSKSKSKSVNDSDKLRRIIVASVKGFTIGTGLKGGLAIFSIVARFARRRRSSPQSRKTGEFSNSEAIAMGIKETLRYGLFLGTFAGTFVSVDEAIAALAGDKRTAKWRALFAGLVAGPSMLLTGPNTQHTSLAVYILMRAAVLASRCGIKSKRFGTICKPLTWKHGDLFLMCLSSSQILSAYILKQESLPSSYKSFLNKQGGKDLSILQGVKDIATAQPFTNLRAIEKYYKSVGVDIKLDPTMKVPCTIIHGNESCVKHGVTFFLQAYKRALPVYVPVYLIPALIVHRQDLLKKQYSILGKGLLGTARSSLFLATYCSSAWAWTCLLFRTFETCNIPLVAIATFPTGLALAIEKKSRRIEISLYCLARAIESFFTCMTEAGYIRPPKSLRRADVVVFSVSTAIIMHCYAQERDVFRSKYLNVLDWVFGVPPPPPAPSCETT

SEQ ID NO: 492 - protein, 664 aa, Arabidopsis thaliana
MAPKSKEKSKTSNSQPPPAIEDLFTSLHQHIKDTKYEEAVKVADQVLSIVPTDEDAIRCKVVALIKDDKFDDYLIKDVKINGALSVINSFQKLPIDLGFHKAYCLYRVNKLDEALVCLKGLERDTDTLVLEAQILYRLGKADACVDVYQKLTKSQIETLEVNLVAGLISAGKASQVQKTLESLKIKPTSSFELAYNTACSLIENNNYADAEQLLLTARRIGQETLNDDDIALTDEEIEIELAPIAVQLAYVQQILGQTQESTSSYVDFIKRNLADEPSLAVAVNNLVALKGFKDISDGLRKFDLLKDKDSQTFQLSQALDAKLSQKHKEAIYANRVLLLLHANKMDQARELCAALPGMFPESIIPTLLQAAVLVRENKAAKAEELLGQCAEKFPEKSKLVLLARAQIAASASHPHVAAESLSKIPDIQHLPATVATIVALKERAGDNDGAAAVLDSAIKWWSNSMTESSKLRVLMPEAAAFKLRHGQEEEASRLYEEIVKNHNSTDALVGLVTTLARVNVEKAESYEKQLKPLPGLKAVDVDKLEKTYGAKPIEGAAASSSQEEVKKEKAKRKRKRKPKYPKGFDPANPGPPPDPERWLPRRERSSYKPKRKDKRAAQIRGSQGAVTKDKQEAAPSTSKSNQVASSKGNAPAPSSKASKKKSRR

SEQ ID NO: 493 - protein, 512 aa, Arabidopsis thaliana
MEEDKQMHEEKSSLVKEEPVRGEEPEIEKLTVADVDAPPKSTGGWGWGFSGFSVLSDLQKAAEDISRNAAAVAEKAAKSIAEMGEVDEDSESSAKEEEKTEEADTEQDSDDENAKLKKSALERLEGASEESLLSQGLKVFDDSVESFTSGAWQAFGNALKGGTSLVQKLENSVQQGSSPREAGSGAPSLLETGKALTAKGMQVLEFVGKETMDLLITETGIGAEKDRVDFKDQVLEEVTFDRCFYIYGGPEQLEELEALASHYTLLFNRRKGKLSPDQKSLYDGKLKQIQQLFSFADEMSGSKAESDKGKKIDIKTEGNDDDMKNLHNSSVSKAADMATGFTNALAGLHVNDMIQRTGGRLESLHSEGVHRLSEMCCFAVTHLLILGKSMISHANKVQDEDTEALKIEWAEDPTEKAKLIRGKAETMAGYVEAVSNSFITGISDVSETYSAAIKGVAAADSKDDLLKTSTMQEKASTFNDSLRSDQTTAITKIQEGLQYLSYVVISTSMPSA

SEQ ID NO: 494 - protein, 318 aa, Arabidopsis thaliana
MAGGGNRRDEGSITIQSTNLFAALDTRKKKKKSDKAGKSKGSSKSREPEKEPEPQVYWAPTPLKVKSWADIDDEDDDDDYYATTAPPQSGWSTSLPSHTDSKDVHVEESESEEDILDEGDDDVEEEQEQETEVQVHPEPEVKKAPEVPAPPKEAERQLSKKERKKKELAELEALLADFGVAPKENNGLEESQEAGQEKKEDVNGEGEKKENAAGGESKASKKKKKKDKQKEVKESQEQQANNNADAVDEAAGSEPTEEESPIDVKERIKKLASMKKKKSGKEVDAAAKAAAEEAAARRKKLAAAKKKEKNHYNQQPVR

SEQ ID NO: 495 - protein, 802 aa, Arabidopsis thaliana
MRWDLITAIVAALVVSVLADESGQMAPYRIHTLFSVECQNYFDWQTVGLMHSFLKSGQPGPITRLLSCTDDQKKTYRGMNLAPTFEVPSWSRHPKTGDWYPAINKPVGVLYWLQHSEEAKHVDWVVILDADMIIRGPIIPWELGAERGRPFAAHYGYLVGCDNLLVRLHTKHPELCDKVGGLLAMHIDDLRVLAPLWLSKTEDVRQDTAHWTTNLTGDIYGKGWISEMYGYSFGAAEAGLKHKINDDLMIYPGYVPREGVEPVLMHYGLPFSIGNWSFTKLDHHEDNIVYDCNRLFPEPPYPREVKIMEPDPSKRRGLILSLECMNTLNEGLILRHAENGCPKPKWTKYLSFLKSKTFMELTRPKLLAPGSVHILPDQHEPPPIDEFKGTYPKIHTLFSTECTTYFDWQTVGFMHSFRQSGQPGNITRLLSCTDEALKNYKGHDLAPTHYVPSMSRHPLTGDWYPAINKPAAVVHWLHHTNIDAEYVVILDADMILRGPITPWEFKAARGRPVSTPYDYLIGCDNDLARLHTRNPEACDKVGGVIIMHIEDLRKFAMYWLLKTQEVRADKEHYGKELTGDIYESGWISEMYGYSFGAAELNLRHSINKEIMIYPGYVPEPGADYRVFHYGLEFKVGNWSFDKANWRNTDLINKCWAKFPDPPSPSAVHQTDNDLRQRDLLSIECGQKLNEALFLHHKRRNCPEPGSESTEKISVSRKVGNIETKQTQGSDETKESSGSSESEGRFSTLKLWVIALWLISGVGFLVVMLLVFSTRRGRGTTRGKGYRNKRRTSYSNTGFLDTK

SEQ ID NO: 496 - protein, 361 aa, Arabidopsis thaliana
MQLLNSCCGKGFDGKKKEKEEPSWRVFSLKELHAATNSFNYDNKLGEGRFGSVYWGQLWDGSQIAVKRLKEWSNREEIDFAVEVEILARIRHKNLLSVRGYCAEGQERLLVYEYMQNLSLVSHLHGQHSAECLLDWTKRMKIAISSAQAIAYLHDHATPHIVHGDVRASNVLLDSEFEARVTDFGYGKLMPDDDTGDGATKAKSNNGYISPECDASGKESETSDVYSFGILLMVLVSGKRPLERLNPTTTRCITEWVLPLVYERNFGEIVDKRLSEEHVAEKLKKVVLVGLMCAQTDPDKRPTMSEVVEMLVNESKEKISELEANPLFKNPYSSNENNREHVAEESSDVILEDKDHQQQQE

SEQ ID NO: 497 - protein, 203 aa, Arabidopsis thaliana
MSSVCGGLDFKDAESSSASSPIICSTGVKHISCVGSDDAQESDGDDSGYIHQTVIEESKDKAISEPIPESLPLNSLDDESEDKNLATALQDMFSESMSVVTLIPAIKGGREKHGKSLEKLSVSWAEDVYDPPPSIVSHTRSKKQQPQKSKSKDNLKKNGKKGQKGSSNSRSSKDKKQISSRSSKYSRDKFDWTTQMSVLAASS

SEQ ID NO: 498 - protein, 412 aa, Arabidopsis thaliana
MSLIGRLNLGRRFCTAVPRRSEDIMSNPDCRPSDLCLRVSYLIRCVGDLDTAAKYARLAVFTSIKSESTTTICQSIIGGMLRDKRLKDAYDLYEFFFNQHNLRPNSHCWNYIIESGFQQGLVNDALHFHHRCINSGQVHDYPSDDSFRILTKGLVHSGRLDQAEAFLRGRTVNRTTYPDHVAYNNLIRGFLDLGNFKKANLVLGEFKRLFLIALSETKDDLHHSNYENRVAFLMATFMEYWFKQGKQVEAMECYNRCVLSNRLLVCAETGNALLKVLLKYGEKKNAWALYHELLDKNGTGKGCLDSDTIKIMVDECFDMGWFSEAMETYKKARPKNDYLSDKYIITRFCENRMLSEAESVFVDSLADDFGYIDVNTYKTMIDAYVKAGRIHDAIKTSNKMIDATLKEVSHLF

SEQ ID NO: 499 - protein, 790 aa, Arabidopsis thaliana
MADSTKVRLVRCPKCENLLSEPEDSPFFQCGGCFTVLRAKTKEREADSVSVKSVEDTAKPVSASSPEKAILDSSETSSDSDVPSLRHHHNVVPVDVESDPCSKPSSLEQGNRSILLGDKDDLKSQSGRQQDSGWDRFRKRTTKRCDSQSVINRLSTSRHPCDEGTSSSANYFPDSLLEFQKHLKDQSNEAIEQDRAGLLRQLEKIKEQLVQSCNVATDKSKEQAPSSSSASGLNKAPPMRFHSTGNHAVGGPSYYHQPQFPYNNNNINEAPMHHSLMHPSYGDPHRFPIHGRGPHPYFSGQYVGNNNNGHDLFDAYPQQNGHFHHSSCSCYHCYDNKYWRGSAPVVPDAPYNAGFYPHESVMGFAPPHNPRTYGSRGLQPHGRWPSNFSDAQMDALSRIRPPKVVLSGGSRHIRPLAGGAPFITCQNCFELLQLPKKPEAGTKKQQKVRCGACSCLIDLSVVNNKFVLSTNTASTRQGEARVAADYTSDDYDLLGYVFHSLDDEPRDLPGLISDKSQDMQHVHSHSASLSEGELSSDSLTAKPLAEAHENFVDYSSINHDRSGAGSRSSRSEHDKVTLSKATAMRQNSMKEVSLASEMEVNFNDYSHRNSGVSKDQQQRAKKSGFASIVKKSFKDLTKSIQNDEGNKSNVSINGHPLTERLLRKAEKQAGVIQPGNYWYDYRAGFWGVMGGPGLGILPPFIEELNYPMPENCSGGTTGVFVNGRELHRKDLDLLAGRGLPPDRDRSYIVDITGRVIDEDTGEELDCLGKLAPTIEKLKRGFGMRLPKRTT

SEQ ID NO: 500 - protein, 355 aa, Arabidopsis thaliana
MEWIQSLPKIELHAHLNGSIRDSTLLELARVLGEKGVIVFADVEHVIQKNDRSLVEVFKLFDLIHKLTTDHKTVTRITREVVEDFALENVVYLELRTTPKRSDSIGMSKRSYMEAVIQGLRSVSEVDIDFVTASDSQKLHNAGDGIGRKKIYVRLLLSIDRRETTESAMETVKLALEMRDVGVVGIDLSGNPLVGEWSTFLPALQYAKDNDLHITLHCGEVPNPKEIQAMLDFKPHRIGHACFFKDEDWTKLKSFRIPVEICLTSNIVTKSISSIDIHHFADLYNAKHPLILCTDDFGVFSTSLSNEYALAVRSLGLSKSETFALARAAIDATFAEDEVKQQLRFIFDSASPEHV

SEQ ID NO: 501 - protein, 261 aa, Arabidopsis thaliana
MMRVMEPPPIEEAALAPVSVFWDIKSFPVPDGYDARLVGPCIKRNLRKLGYTGPITITAVGVLSEVPRDILKAVYSTGISLKEVIKSPTNMYALFLESSLLRTPPPANMMVISRPPSYIPRHFSSIRDKDREKGRYTIFPFPFGEMPLTLAISLWEDFLLADPVALEEEKCSEMGDPASWFCAVCHHFAAPDLVTGRDLIVSSRISILDNMHNCFNSKLSPVALALYASTQLWLPALGLYALTKKLRRRPELRLPVIQLVN

SEQ ID NO: 502 - protein, 1145 aa, Arabidopsis thaliana
MIPNGELRLPALKVREDRVSPSAPIPVTRTLVADTDVTSDDDMSTNSEDVSLDSSPENSRVSSAVGRSYGRNSSYYTYSEVSSSRETLVGAREQTGPRFDGDTEEDESTDSASSTQFSPPPAAGRINDGVSQEFDETFSSEEVSDIPSAPPFSGAAEESEEIKPATSSVQVSEVKTGDCVESRKTGHFTRPSAASESSGPPDQHPARLPTFHASSRGPWHAVVSYDACVRLCLHAWSTGCMEAPMFLENECALLREAFGLQQLLLQSEEELLAKRSSQAPHEGVAPKPKKNIGKMKVQVRRVKTVMDGPTGCSISSLKPSLIKFEKIRIHFSNMSTRLFSGWRALRKIHVRVPANGSSLPRQSLAYVHASTQYLKQVSGLLKTGVTSLRNNSTSYDIVQETYSCKLRLKSLAEDNAIMMQPGSGESHVFFPDSHGDDLIVEILDPMGKDFGRVLVQLANISEDSYVSSDSNEETIQAEKLRWWSVFREPEHQHVGKLQLYIDYSASFDDNSHLKCASVAETVAYDLVLEVALKMQRFQQRNLLLYGSWKWLLEEFATYYGISDVYTKLRYLSYVMDVATPTSDCLHLVHDLLTPVIMKGNGKSALSHQENRILNEIKDQIEQILKLVFENYKSLDESSFSGMIDVVNSASGVPAPALIPAVKLYTLLHDVLSPEDQTHLCHYFQAAAKKRSRRHMGETDEFVANNSEPNFWDMSAMSAAYQKMTMACKNVKNEIYTDIEIQNEDILPSFLDLPNLSASIYSTDLCNRLRAFLVACPPSGPSPTVAELVIATADFQRDLSSWNISPIQGGVDAKELFHLYIMIWIQDKRLSLLESCKLDKVKWSGVRTQHSTTPFVDEMYKRLNETIQDYQVIISRWPEYIFVLESAIADVEKATVEALEKQYADVLSPLKENLAPKKLSFKYVQKLTKRSVIPYVVPDELGILLNSMKRMLDVLRPNIEAKFKAWSSCIPDGGNAAPGDRLSEVTVMLRAKFRSYLQAVVEKLVENSKLQKTTMLKKILQDSKESVGESDIRSKMNNLKEQLTNTVNHLHSVCETHVFIALSRGYWDRMGQIVLSFLENRKENRAWYKGSRVAVSILDDTFAAQMQQLLGNSLREQDLEPPRSIMEVRSILCKDPADNKAKSFYY

SEQ ID NO: 503 - protein, 580 aa, Arabidopsis thaliana
MNRISAISTLVTPLPLLPSCSFVPTRRCYPRRATPYSRRINLKPLTSRIVLLTRRRQLGQIVEEVEAAKKRYGRLNTIVMNSVLEACVHCGNIDLALRMFHEMAEPGGIGVDSISYATILKGLGKARRIDEAFQMLETIEYGTAAGTPKLSSSLIYGLLDALINAGDLRRANGLLARYDILLLDHGTPSVLIYNLLMKGYVNSESPQAAINLLDEMLRLRLEPDRLTYNTLIHACIKCGDLDAAMKFFNDMKEKAEEYYDDFLQPDVVTYTTLVKGFGDATDLLSLQEIFLEMKLCENVFIDRTAFTAVVDAMLKCGSTSGALCVFGEILKRSGANEVLRPKPHLYLSMMRAFAVQGDYGMVRNLYLRLWPDSSGSISKAVQQEADNLLMEAALNDGQLDEALGILLSIVRRWKTIPWTTSGGMAAVRLETLLGFSKSILRPHLLSKVIPSEPIESIMIRFEATRPLLGTLQLKNVAMRFFKEQVVPIVDDRGSCIGLLHREDCNNLDAPLVSMMRSPPTCVSTTTSIGRVVDLVLEKKLKMVIVVHCGNFSGSGYSSKAVGAFTRAQLYRLFESEQKLL

SEQ ID NO: 504 - protein, 1188 aa, Arabidopsis thaliana
MAQGRERIPERWTYDVFVSFRGADVRKNFLSHLYDSLRRCGISTFMDDVELQRGEYISPELLNAIETSKILIVVLTKDYASSAWCLDELVHIMKSHKNNPSHMVFPIFLYVDPSDIRWQQGSYAKSFSKHKNSHPLNKLKDWREALTKVANISGWDIKNRNEAECIADITREILKRLPCQYLHVPSYAVGLRSRLQHISSLLSIGSDGVRVIVIYGMGGIGKTTLAKVAFNEFSHLFEGSSFLENFREYSKKPEGRTHLQHQLLSDILRRNDIEFKGLDHAVKERFRSKRVLLVVDDVDDVHQLNSAAIDRDCFGHGSRIIITTRNMHLLKQLRAEGSYSPKELDGDESLELFSWHAFRTSEPPKEFLQHSEEVVTYCAGLPLAVEVLGAFLIERSIREWESTLKLLKRIPNDNIQAKLQISFNALTIEQKDVFLDIACFFIGVDSYYVACILDGCNLYPDIVLSLLMERCLITISGNNIMMHDLLRDMGRQIVREISPKKCGERSRLWSHNDVVGVLKKKSGTNAIEGLSLKADVMDFQYFEVEAFAKMQELRLLELRYVDLNGSYEHFPKDLRWLCWHGFSLECFPINLSLESLAALDLQYSNLKRFWKAQSPPQPANMVKYLDLSHSVYLRETPDFSYFPNVEKLILINCKSLVLVHKSIGILDKKLVLLNLSSCIELDVLPEEIYKLKSLESLFLSNCSKLERLDDALGELESLTTLLADFTALREIPSTINQLKKLKRLSLNGCKGLLSDDIDNLYSEKSHSVSLLRPVSLSGLTYMRILSLGYCNLSDELIPEDIGSLSFLRDLDLRGNSFCNLPTDFATLPNLGELLLSDCSKLQSILSLPRSLLFLDVGKCIMLKRTPDISKCSALFKLQLNDCISLFEIPGIHNHEYLSFIVLDGCKLASTDTTINTMLENWLKRNHECIYIPVDRPNVIPNWVYFEEEKRSFSITVPETDNSDTVVGFTLWMNFVCPMGYSSIYPRAIIVRNLTRGSAWIHSLKNSKIRIQMNANLLTNDFHIVTGDEIEVDVDCDDRFTILATGIALCYKARDSSDFSFGDIKFTYEEDDLGYASNGIYLDCHRSKYGHDSLQAVVHWKISYPMDGETSNLFACSFFPGISRYQENNQPVVDVEESNHRPRRKMRMSLWKILGAIGFLTLVVVLEVYFELLSSIFANSTTDYIMLPT

SEQ ID NO: 505 - protein, 188 aa, Arabidopsis thaliana
MATRKALINVHRIIRSTAVVGRSSIIPAAANRSYPIIFRNGVDLGARFFCENTASAQNFDIDLSNEENKRRTINRLLYRSKQRGFLELDLVLGNWVEENVNSMDENGVKSLIHVLNLENPDLWKWLTEQEQPPEAVSSNPVFSALHEKVMKNLNKHAAPETRAAAGQPWVRGWDDFKRGRDAPISGNQ

SEQ ID NO: 506 - protein, 322 aa, Arabidopsis thaliana
MNRFSRARSYISLVLFRKSSYVTSHIPWNQCFYTSLKSSLKPASVSVSSVHCYSSRSKTAKSKMSKSSVSVSDSDKEKDAFFVVRKGDIVGIYKDLIDCQAQVGSSVYDPPVSVYKGYSLLKDTEECLSTVGLKKPLYVFRALDLKEDMFGALTPCLFQDQLPSASMSVEKLAELEPSADTSYETCIIEFDGASKGNPGLSGAAAVLKTEDGSLIFKMRQGLGIATNNAAEYHGLILGLKHAIEKGYTKIKVKTDSKLVCMQMKGQWKVNHEVLSKLHKEAKQLSDKCLSFEISHVLRSLNSDADEQANMAARLSEGEVEVA

SEQ ID NO: 507 - protein, 276 aa, Brassica napus
MESSTSLAIVLHQSSNHDELFMQQTLQFSQTLKDLKNLRKQLYSAAEYFETSYGKEEHKETVIETLKEYAAKAVVNTVDHLGSVSDKFNSFLSDNSAHFSTTRLRLSSLEQRMKLCREYMGKSGSSQHRFQVQSPHHHKRYFFPQHGRGTSFAAGDDSHRFKSAVRSTILENHPNNARKTNKTGSFSFLHNNISNITPSKITKSPMRFPLIRSGSLLKRSSSPSQPRLLALPEPQRAISMSTSREIVEIQQKSSLRKGKKSLMLKALMSMSSKSRN

SEQ ID NO: 508 - protein, 358 aa, Medicago truncatula
MGKTWWCLIFVTWLCLFAFSDGRELKTRHTSHLAQYNHTLATILVEYASAVYLSDLTQLFTWTCSRCGDLTKGFEIIELVVDVEHCLQAFVGVADDPRAIIIAFRGTNEHSLQNWIEDLYWKQHEINYPDMDDAMVHRGFYTAYHNTTIRPAVLGAVERAKKFYGDIPIIALGHSMGGAMAAFCGLDLTVNKQEKNVQVMTFGQPRIGNGVFVSLYSKLVPNTIRVTNDHDIVPHLPPYYYYLPQKTYQHFPREVWLYNIGLGSLVYRVEKICDGSGEDPSCSRSVSGNSITDHLVYYGVDMGSDDPQSCRIVMNSDVPSTSSIRDSRGNFILSRNPTSSLLKLSTEFDNKEKAVNVY

SEQ ID NO: 509 - protein, 275 aa, Medicago truncatula
MTVVRGSVFRLGRRLRLGILNSLKPETNHNTLNTNCSRCLGTTPSFQPRNHNAFFSSPASPFPSPFSTGQRRTMFIQTQSTPNPESLMFHPGKPVMDVGSADFPNPRSAMNSPLAKSIFTIDGITRVFFGSDFVTVTKSEDASWEFLKPEIFAAIMDFYSSGEPLFLDSQAASSKDTAIHDDDSETVAMIKELLETRIRPTVQDDGGDIVYCGFDPDTGIVKLKMQGACSGCPSSSVTLKSGIENMLMHYVPEVKGVEQELDGEEEEAALSGQTE

SEQ ID NO: 510 - protein, 1746 aa, Medicago truncatula
MKLNQAGSQLPGLAQLNGNGQMPSLGGVSRSALNMDPEFPRAREFIQEKICETLFRRHQQPISEIQKRRIKDLAKRLEEGMLKNAPSKEEYMNLETLEARLSLFLRQATMNNRSQQYPQLVSSSPIGTMIPTPGMSHGPNSNVVVASSIDASMISSSGGNSVVSTTFNGVNILPTGGIHGSSLNRSDGLSNGYQQSSTSFSAGSVGNMSSMSVPRTSSQMIPTPGYTVNSNHSHMNVDSSTNGNVFSSAESTMVPLSQLQQQKQHVGDQSQVLPNIGSQMSSGMRSGLLHKQFTNSNGAVNSGLGLIGNNIQLPNEPVTSDGYASTYANSPKHIHQHFDQNQKPVMQGDGYGLNNVDPFASGNFYASATSSGSMMNTRNTNSVQLPSIPKTSSLISGHSNLHGMQQSAHIKSEAINQLEKLNFQSSSTSRDALLHSQQQYQQRPHQFQQSEQYPQSQQQFQLKLHSQQPRHLVNDNAFNQSQLSSNLENQVKSEPGIEHHKEVLSSHVPEQFHMSEIQNQFQQNSSEDCSRAQYLSFPSGQHNLSSSVPQSSQQMLHPHHLVAESQNKFSCLTVEAQCNSKQWTDSQDGNPMSNNSSHDHHLHVDFHQRISGKDEAHCNNLSSDVSMGQAVAPRGAAEPLDPGSTTKNAHRNQQRWLLFLLHARRCSAPEGRCQERFCSFAQKLCRHMDGCNLRHCPYPRCHHTKELFHHFIHCKDPCCPVCVFVKKCRRACQLKAQSQPPSESSLPSVVNGSCKSYNITATSSRLISKPTLVVETSEDLHPSVKRIKIEHSTQSVNLEKDNSASSVSANCDSVVSRDAQSQTYPNAEKSISIKSEITEVKAEVLAHAKLSEMKMDSSNADDKIPDGEPVKNDDTGNLARPENMKTEKEVGQDKQEHVMQPGENAAGTKSGKPKIKGVSLTELFTPEQVREHITGLRQWVGQSKSKAEKNQAMEHSMSENSCQLCAVEKLTFEPPPIYCTTCGVRIKRNNMYYTMGTGDTRHYFCIPCYNDARSEHIVVDGTPIAKSRLEKKKNDEETEEWWVQCDKCEAWQHQICALFNGRRNDGGQAEYTCPNCYIEEVERGERMPLPQSAVLGAKDLPRTILSDHIEQRLFKRLKHERQERARFHGKSYDEVINILVVRNTSCSIFYYMVTFLFGLIVLFTPEYMSFSVPGADSLVVRVVSSVDKKLEVKQRFLEIFQEENYPTEFPYKSKVVLLFQKIEGVEVCLFGMYVQEFGAESQFPNQRRVYLSYLDSVKYFRPEIKSVTGEALRTFVYHEILIGYLEYCKLRGFTSCYIWACPPLKGEDYILYCHPEIQKTPKSDKLREWYLAMLKKAAKENVVVNITNLYDHFFTSTGECRAKVTAARLPYFDGDYWPGAAEDLIYQLRQEEDGRKQNKKGTTKKTITKRALKASGHSDLSGNASKDLLLMHKLGETISPMKEDFIMVHLQHACTHCCILMVCGNRWVCNQCQNFEICDKCYEAELKREERERHPINQREKHSLYPVEITDVPFDTKDKDDILESEFFDTRQAFLSLCQGNHYQYDTLRRAKHSSMMVLYHLHNPTAPAFVTTCNICYLDIETGQGWRCEVCPEYDVCNSCYQKGGIDHPHKLTNHPSVADRDAQNKEARQVRVLQLRKMLDLLVHASQCRSPHCQYPNCRKVKGLFRHGMHCKTRASGGCVLCKKMWYLLQLHARACKESECHVPRCRDLKEHLRRLQQQSDSRRRAAVMEMMRQRAAEVANNAG

SEQ ID NO: 511 - protein, 579 aa, Medicago truncatula
MACLVLHPMHENGEFTSSFSPHMRESILIYLTVGGSVIPMHILETDSIASVKLRIQTLEGFFVKKLKLVFEGKELAHNKSCVGDYGVADGNVLHLVLRLSDLKAITVRTLSGKEFGFYVEKTRNVGYVKQQIAKKGRGVFNLADQELVWEGEALEDQRLIEDICKDNDAVIHLLVRISDSKVRTKPVEKDLELSIEALFAHDTVPNSAVDQLGPVSITNKVLKRNQLTREFLLEPIFNNSNIKIPPVVHELIKVTLEGLEKGRKPIRSSEGSGGAYLMQDSSGLKYVSIFKPTDEEPMAFNNPRGLPISVDGEGLKKGTQVGQGALREVAAYILDHPRKGPRSYHNNEEKGFAGVPPTVMVRCMHEGFHHPEGYKNVSSNVKIGSLQMFMRNIGSCEDMGPRTFPVEEVHKISVLDMRLVNADRHAGNILVAKNGEDGPIVLIPIDHGYCLPKSFEDCTFDWLYWPQAQEPYSLDTTEYIKSLDAEEDIKLLKSHGWELPLECARILRISTMLLQKGAEKGLTPFTIGSIMCRETLKKKSVIEQIIHKAEEAALPGTSEAKFLDLVSVIMDNHLEGLFP

SEQ ID NO: 512 - protein, 287 aa, Solanum lycopersicum
MFRRKNHSNSEQGGEDQQHKVKELRASLGQLSGRSAQFCTDACLKRFLEARNWNVDKAKKMLEETLKWRLSFKPEEIRWNEVAKEGETGKVFKANFHDRHGRTVLILRPGMQNTAALDNQMKHLVYLIENAIFNLPEGQEQMAWLIDFTGWSITNNVPVKSARETINILQNHYPERLAAALLYNPPRLFETFWRIVKYFMDPKTFQKVKFVYPKNKDSAELMKSYFDVDNLPTEFGGTATLKYDHEEFSRQMAQDDVKAAKFWGSDKHPPGPGGNGNYSAVEVAPEP

SEQ ID NO: 513 - protein, 262 aa, Solanum lycopersicum
MEHEDSYKGVSEPKYECLLFDVDDTLYPLSSGISAQCTKNIIDYMIEKLGIDETKVPEMCISLYKEYGTTMAGLRAIGYDFDYDDYHSFVHGRLPYELLKHDHVLRNLLHSLPVRKVIFSNANEAHVAKVLSRLGLEDCFDDIVCFETVNPTNNGSAQDSNNGVSPRSLIVCKPFKEAYEQAFKIANINPQKTLFFDDSVRNLQTAKLTGLHTVWVGASHRTEGIDYALESIHNMKEALPELWEDVKPDIRYSEKTAIEVRA

SEQ ID NO: 514 - protein, 427 aa, Solanum lycopersicum
MVRNRREELYVTVPPLFRCPISMDVMKSPISLCTGVTYDRNSIQTWLSQGHNTCPATMQILPSTDFTPNLTLRRLINVWIQHQPASSPGSTTPSSSSVTKTEVVEIVENLNGEVDRLSSLAKIGEFVKCSGENRSFFVNLSDAIANIVGVLVDCDVVEVCEAVVAVLDLVVSENGVKEQLNKEILKSDQKFLPKFLLVLRKGKLSSRIQTARILEFIALDADSQRKMVEEQGLLYELHVFTSTETNRFAIEVGLSTLIAVSTTRLAKKELVRFGIIQTIGKILSNSETARAVVEKSLKLLETVATCAEGRTAIGKGEECLSAIVTRLMKSSKAATEHGVTVLWSVCCLFRHTAAREVVGKANGLTKVLLVMQSDCSAAVRQMCGELVKALRVVNTFSVRTEEVIKIKNYSKSCLASYDTQTTHIMPY

SEQ ID NO: 515 - protein, 360 aa, Solanum lycopersicum
MSLGGEKKNVVVIGGGVAGSVVAKTLQNEVNVSLIDEKEYYEITWASLRCMVEPEFAKRSVISHAEYLPHAKIIPSAAVDITDTYVLTKQGSRIAYDYLVVATGHTQSGFETRTEKISQYQAEYEKIKAADSILIVGGGPTGVELAAEIVADFPAKKVTLVHRGSRLLEFIGESASKKALNWLTSKKVEVILEQSVLVNSQSDGVYRTSGGETIVADCYFLCTGTLFGSVWLKQTILKDSLDSRGKVMVDSNLRIKARKNIFAIGDITDVPELKQGYLAQEHAKVVAKNITSLIKGVEDDHKLAVYKPATKALAIVSLGRKDAVAQFPCLSIAGRIPGMIKSGDLFVGKTRKGLGLQPSV

SEQ ID NO: 516 - protein, 238 aa, Solanum lycopersicum
MAALSVQEVLPATLESTSEPPSLFDGTTRLYINYQCPYSQRVWITRNVKGLQDKINLVPIDLQNMPDWYKEKVYPQNKVPSLEHNNKMIGESLDLVKYVDSNFEGPSLLPDDPEKRKFAEELIAYSDIFVPEVYKSFFRDAQTLAGAQFDYLEKALDKFDDGPFFLGQFSQVDIAYVPFIERFQIFMEKGINYDITSARPKLAKLIEEMNKLDGYKQTKVLDPEKLVEYYKNLFLKKA

SEQ ID NO: 517 - protein, 192 aa, Solanum lycopersicum
MALDFICNKQIEEGKPIEKLKMVDDEHEGGNLSRGFECNICLDLAHDPVVTYCGHLYCWPCIYKWIHLHSIPCENPAQRHPQCPVCKAHVSQTTMVPLYGRDQATKTSQDDGMAIPERPQQFHHRSSTSTIGETAHAERVDGNSFVPYPNAHHLAGTASLRMRRQQLQADDKSLRRVHFFLFCCVVLCLILL

SEQ ID NO: 518 - protein, 569 aa, Solanum lycopersicum
MQKTTLTSTRLLVSLPNWTLMVLKRNINQDSDENSEFPPRESKRQHPSNAFFSGLRSYSSPQELARKLEPLIRSWVREEIEQTLQSTLRSSLNDDETSKSRDIQLLFDDVFPSSLFTGSKLSMENRPIKVLLYDASSNQRITSGPLSSAKVDVVVLNGEFNPSNLEDWSEEEFSKMVIRAREGKRPLLTGDLIIQLRDGVGYLGDLSFTDNSSWIKSRTFRLGVKLNNRSGEFRVREGVSKPFTVRDHRGEAYKKHYPPTLDDEIWRLKKIAKDGASHKRLSKEGISCVKEFLRLFVTDPSLLRKMLACGNNIWEKITEHVSTCPLDNSEWYVYNAGESIVLLFNCIYELVGAILDGQNFQSIDKLDIFQKRMVEDFKRSVYKNLNCLAPLEDHSLIGQAILTSNLQNGLNHIPSSSQQNMNYSDEQGQVEFQSNSDHATISSPLAYTAQQDSPTTVSMPESFNGIQAFNSTLASSFLVGEPCSSIYPGDYDWGSNGSLDSLGMTDYLPPNNNYQFETPVWQGNELLASSSVQPVSPNIGFHITRRGNPRAIWCTIRAVLKWKTLVKRK

SEQ ID NO: 519 - protein, 325 aa, Solanum lycopersicum
MVPSSVDCTGESATGENQRSLPTPFLTKTYQLVDDPAMDELISWNEDGTTFIVWKPAEFARDLLPKCFKHNNFSSFVRQLNTYGFRKVVPDRWEFANDCFRRGEKGLLRDIQRRKISPAGAAVVAPAVVTVNAAQAVTVAVAPAVRVVSSSNSGDEQAFSSNSSGAAAGAAMLRTTTCTTTPELIEENERLRKENAQLNQELNRLRSLCSNVYNLMSNYTANPADIPAGILGGRALELLRTGQVDGGGAAITAAESSGFKADEDMSPRLFGVSIGVKRVRRSSEEESEDQDQVQPHGSDMKSEPLDSGSAQHDDQPWIDRLDLGC

SEQ ID NO: 520 - protein, 222 aa, Solanum lycopersicum
MNSLMIKLLFFLVLISNGYSTKLDSYPPTCKKIECPNYDVIESGKDYEIRRYNSPMWMSTEPIDDTSFVSATRIGFTRLFMYIQGKNDQHEKMDMTAPVMTQVKPSDGPLCSTSFVVSFNVPKKNQPNPPSAEGLHPQKWNQSSYAAVRQFSGFVTDGDIPKQAAALTASIADTKWAAAIEKSRSKDNSTIYTVAQYNSPFEFRARVNEMWFTFVMDTAIDI

SEQ ID NO: 521 - protein, 145 aa, Solanum lycopersicum
MAIFGDPFRRFLLSPTIHRSFSGSPALLDWIESPNSHIFKINVPGYSKEDIKVQVEDGNVLVVKAEGHGGKKDEFHGKEKDIVWHVAERGGGRGGDFSREIELPEDVKVDQIKAQCENGVLTIVVPKDATPKTSKVRNINITSKL

SEQ ID NO: 522 - protein, 236 aa, Solanum lycopersicum
MNKHHILQEDHQNSSGSSLAMSSSFGTTTPERHSSFSQESESAVASTLHSPSSSDYSPTITPSHDDSAVIIQKRKLGKKAKSYAYRIREHVKLGSKFSETVKGKLTIVKEGGRRNIFKHMFHVNDGEILLKASQCYLYTTAGPIAGILFISTHKIAFCSERPISVPFPSGGILRTPYKVVIPVTKIKRALPSVNENKPSQKYIEIVTEDDFEFWFMGFVRYEKAFLNLQRAISMSN

SEQ ID NO: 523 - protein, 229 aa, Solanum lycopersicum
MNSDHFRVQDEGVFLLASSQPKKRAGRKKFKETRHPVYRGVRRRDNNKWVCEVREPSEQKRIWLGTYPTPEMAARAHDVAALALRGNLATLNFADSSWRLTVPISKDPEELRKAAIQAAEELVGVGYMNEEINYIEENIAIGGANGSDNSNLVGNEVNNNNNIQNMEMGNISCYNNWGDNNEMLEIEGSTWQEKMSEGHLFSPTPHYDSCFSWDDVESDGEVSLWSYNM

SEQ ID NO: 524 - protein, 276 aa, Solanum lycopersicum
MAEDGHKVILNVYDLSQGLARQLSTTFLGKAIEGIWHTGVVVYGHEYYFGGGIQHAPAGTTPYGTPIKVVDLGVTHIPKDVFEMYLQEISPRYTAETYSLLTHNCNNFSNEIAQFLVGATIPEYILNLPNEVTNSPMGALIMPMIQQLESTLRANAVPQAPQFRPATVAPASQPTLSVGKSSSSGINQSKKPESQDGEKKNVNVPSAVKPVEEQEKTPANAVVKDPLGDARSKVQEEITREFAAIMATGTLRASEAAALATKKVMQRYGDTFAAMN

SEQ ID NO: 525 - protein, 257 aa, Solanum lycopersicum
MEEIIEEKKMKILCLHGFRTSGNFLKKQLSKWDPSIFANSEMDFPDGIFAAKGKSDIEGIFPPPYFEWFQYNEDFTEYENLEECITYLCEYITSKGPFDGLLGFSQGATLSGLLLGYMEQGEILKEHPPMKLFVSISGAKFRDPNICNIAYKDMMKVKSVHFIGEKDWLKLPSQELTTAFENPIIIRHPQGHTVPRIDEAAVETLKSWTREVALSSNESCVGGGPNEACKHVNIENGVEQGKKLEKPNEVEIQKAQE

SEQ ID NO: 526 - protein, 335 aa, Solanum lycopersicum
MESFRLRFHNFLSFHLSIIAKIFRWLFSSLPTIKRFPLFVPFIDAYISLLFRFANLSPCTLDLDDQTTIHFWAPNHRRYDKPNLVLVHGYGGDAKWQFMYQVKSLAESFNLYIPDLLFFGKSYTTRKERTEEFQAKCVVQGLKELGVRNCSMFAISYGGFVGYRMAEMNPQMVEKVVILSSGVGCSKDQKEEQLKKIGRDPVELLIPEKPEDLHVLVNLSIYKYNHFKWAPDYFLQEFIDMISRTYLKEKQELVHHLLSNHTDCRLPILNQETLLIWGDKDRVFPLMFGYQLQRHLGPRAKLEIIKNTGHAANIESPDSVNALIKAFILPQSKDL

SEQ ID NO: 527 - protein, 266 aa, Solanum lycopersicum
MADDDFLQLLKRIGAFLTLKISNLSQTLDSRCAGAIAGLAFAIVFIWKIMRSPSGPQRRHPKQQAVTPGSSGVSSHFSENVPSSEVSPPSENSNAQNVIDEFFQPVKPALGQIVRQRLGEGRKVTCRLLGVILEETSPEELQKQATVRSSALEVLLEITKFCDLYLMERVLDDESEKKVLLALEDAGVFTSGGMVKDKVLFCSIENGRTSFVRQLEPDWHIDTNPEIVFQLARFIKYELHVTPTKSERTAINVFSSTSLEQFFGAA

SEQ ID NO: 528 - protein, 185 aa, Solanum lycopersicum
MTTKEMEVVKNLDVEKYMGRWYEIASFPSRNQPKDGVNTRATYTLNQDGTVHVLNETWSGGKRGSIEGTAYKADPKSDEAKLKVKFYIPPFLPIIPIVGDYWVLYIDDDYQYALIGQPSKKYLWILCRQPHLDEEIYNQLVEKAKEVGYDVSKLHKTPQADPPPDGEDAPKDTKGFWWIKSILGK

SEQ ID NO: 529 - protein, 1405 aa, Solanum lycopersicum
MEPTDVAVSEDQQLSADPLPFARSYQLEALETALKQNTIVYLETGSGKTLIAIMLLRSYAYLLRKPSPYIAVFLVPTVVLVTQQGDALMLHTDLKVGKYWGEMGVDYWDASTWQQQVDDHEVLVMTPAILLAALRHSFLQIDMIKVIIFDECHNARGKHPYASIMVEFYHHQLTHESAQLPRIFGMTASPIKSKGASTAHSYWQKIHDLENLMNSKVYTCSSESVLAEYIPFSNPKLKIYEHEDIPCSLFNTLAHDLERLKEKHECSISKSNLSAMSAGSARRRLSKLHMAFLFCLSEMGVWLAFKAAEFLSFEENDFFSWGEFDACAQTIVRDFSLGASKIFSARLPSGPHWSIGGDIQANADAGYLSSKVNCLLESLLEYRDQKDLRCIIFVERIVTAIVLRSLLNELLPERSGWRTEYTAGHVSVLQSQSRKSQNKIVEEFRKGLVNIIVATSILEEGLDVQSCNLVIRFDPSATVCSFIQSRGRARMQNSDFLLMVRDGDDPTLTRMQNYMASGEIMRQESLRHASIPCSPLDDELYDEPCYKVESTGAVVTLSSSVSLLYFYCSRLPSDGYFKPNPRCVIDKETETCTLQLPKSSPLQGIISVQGKRKILKQLACLEACKQLHRVGALTDNLVPDIVEEEIINKELECQIQTVEESKYFPPELVSHCSNDSEAVYYCYLVEMQHASYNDFELHGIILAVRTRLKCDDEILAFDLDVDRRGLLQVQLNYSKVVTLTAEEIRRCQRFQVSVFRILLDRDLSILQDALGAVQSPIGSAVSDYLLLPSLGSTPEINWKCVNSLLFPSQALGDKHMDWCSTQDRKRSVNTKNGLVCSCMLENSLVFTPHNGYIYCVTGFLDKLDCNSLLGMRTGESITYIEYYKKRHGINICFEEEPLLRGKHICKVHNYLQRSRTQKAKDSTDSSVELPPEICSLIMSPLSISTLNTYSYVPSIMHRIESLVMASNLKRMHLDHCTLNVPIPTATILEAMTTKKCLEKFHLESLETLGDSFLKYAASIKLFKTYENHHEGLLTVKKTQIISNAALCKLGCARKIPGFIRNEPFDLKAWIIPGDNSQVHSFDEVLLTSSDKMYSRVKQKIRSKRVADVVEALIGAYLSSGGEVAALSFMKWLGVDINFVDAPMSRHFPMNAEKLVNVRYLESLLHYKFNDPSLLVEALTHGSYMIPEIPRCYQRLEFLGDAVLDYVVTAHLYFKYPGLTPGLITDLRSASVNNECYAQSAVKAGLHKHILHASQDLQRQICSTVEDFDKLNLDSTFGWEAETTFPKVLGDVIESLGGAIFVDSGFDKETTFQCIRPLLEPLVTPQTLKPHPVRELSELCDQKGYIRKKDVVSRENGIAYITVEVEANGVVHKSTCSGRDKLIAKKVASKNVLKSLKECPSNATEQ

SEQ ID NO: 530 - protein, 221 aa, Solanum lycopersicum
MALDLHFEEQIAESTFNKCRGSPLQKWKTLDDERDDDNRASGFDCNICLDVVKDPVVTFCGHLYCWPCIYKWIQFQGASDHQKPQCPVCKAKVSQKELIPLYGPGQATKSSADGVTSKGMVIPQRPLRPTCSGDIATTTNSLPSQQLNHRQQPHSGSYTASPTVIGEVVYARVFGNACPNSYNLEINTSLRMRRQLLHADRSLGRLYFFLFCCVLVCLLLF

SEQ ID NO: 531 - protein, 279 aa, Solanum lycopersicum
MTGTGDENQPKFKKSESQIPSVSSSSSDPQAPEMDPQKWGTHIMGPPAVPTCHPDNQKAASWRAEDQREEFQPQPYVVYSPIDKPSNNPLDSVVNVFNSWSNRAENIARNIWYNLKAGPSVTEAAWGKLNLTAKALTEGGFEPLYKQIFGADPNEQLKKTFACYLSTATGPVAGTLYLSTTKVAFCSDRPLSYKAPSGQEAWSYYKVAVPLGNIGTINPIVMKESPPERYIQIVTIDGHDFWFMGFVNFDKAKHHLLETLSIFRAQPPHLNLQQPAATY

SEQ ID NO: 532 - protein, 679 aa, Solanum lycopersicum
MWLECWLNNSKGMSDLQLYGLDDISWDEFCHNDDHIVPHPSSGRTNEPLPQNDSRKKPRHEVIGLTGNAGDQSTGKYANQQKEQVLSNRSPKMLEEDSWADAPDGAFSSPRQKAIVGEVSSLPSESTRTSDHCIKSNNIDSIENEPCPNGCNLDDKNASVGENSYSYPLGPISQADNDLSFLDNSCEDKDSNDLLYYSWPEIENFEDVDRMFRSCDSTFGFGPGSEDDLGWLSSSDVIEGSGDGLTSGFKFPCPASNALGSTSASCDTSKPKETNISTDNSGIENQSLGYNSSSWSSEKNESVNLGHMPFLNGSSNLQCKLVPDKKAEVHGGGVQVEIISNNQPRINDNIVDSMQKKHSKHQNRSEGKRKCGYLENGDTLNYTDSLPEEQKLPSGTGSTHVSFASAGVLQQKQAQDPDFGYLGGSFSYMDSDYGHSDGSALHPTLPILKYESNGLVSLSPKDSYASNQVQSMEGSPDPSFQVAAMTRKEKVEKLFHPSGVKIENKRDFEGVGIRAPTELGSSVVQECSSINSGLDEISEEAASFHQLQRVMEQLDIRTKLCIRDSLYRLARSAEQRHRHANLNIVSGDDGGTSGPLVTEGTNKCTGYVDIETDTNPIDRSIAHLLFHRPSDSAVAPARDSSTLKSPSMIHGSLSSTPVMSDNVISHGEIAPQTDGEVAD

SEQ ID NO: 533 - protein, 257 aa, Solanum lycopersicum
MKMNNLSLLFLTHLTLFFICVCSQNIAQTQFVYKWSETYCNKDTPVGCKQIPPLKFTLKGFWGTDSNGNIQQGCKDPVERDWNKVFDTVMVDKLNVFWPSLTKQDPKDMWKEAWNTYGTCTIERFKTPIQYFNRASRLDSEIGDLLQSHLINSNGIVPCDSATYNNVEILNSFKQVAKDKDVYFTCKDINTTHAYLNQVTFCYTNDAKNFVNCPTSLINKRCRVQNIIVPRPSPPKPIKQQEKSLDQIAYGDSWSIV

SEQ ID NO: 534 - protein, 434 aa, Solanum lycopersicum
MAESQLVHPPLFTYISMITLLTLVPPFVILMWYTNVHADGSVLQTYNYLKENGLQGLIDIWPRPTAIAGKIIICYALFEATLQLLLPGKRVEGPISPTGHRPVYKANGMAAYTVTLITYLSLWWFGIFNPTIVYDHLGEILSTLNFGSLIFCLFLYIKGHVAPSSTDHGSSGNIIVDYYWGMELYPRIGKHFDIKVFTNCRFGMISWGLLPITYCIKQYEEYGSLSDSMLIHTIITLVYVTKFFWWEAGYWNTMDIAHDRAGFYICWGCLVFLPCMYTSPGMYLVKHPVNLGPQLAISILVAGILCVYINYDCDRQRQEFRRTNGKALVWGKAPSKIVASYTTTTGETKTSILLTSGWWGLSRHFHYVPEILASFFWSVPALLNHFMPYIYVIYLTGLLLDRAKRDDERCKSKYGKYWKKYCEKVPYRVVPGIY

SEQ ID NO: 535 - protein, 330 aa, Solanum lycopersicum
MNFLRRVISPGSRSQVSQFANRSFKITQKHYGSIAQPTSSSLVHGIHQFHCPDVVGILAKLSDCIASREGNILSADIFVPDDNHVFYSRSEFLFDPAKWPREQMDADFSNLAKKFNAMKSVVRVPDTDPKYKISILASKQEHCLVDLLHGWQDGRFPIHITSVISNHERGPNTHVIRFLERHGIPYYYLPMTKENKREKEILDIVGDTDFLVLARYMQVLSGDFLKSYKKDIINIHHGLLPSFKGSNPSKQAFDAGVKLIGATTHFVSEELDSGPIIEQLVERVSHRDNLRTFIQKSEDVEKRCLAKAIKSYCELRIFPYEANKTVVFRS

SEQ ID NO: 536 - protein, 137 aa, Solanum lycopersicum
MKTFNCNFYIFLLLILPLIFESCCLARVQVHIINKLPDGLAMTLHCQSHDNDLGQLRLTGGDEASWTFSVNFWGTTMFYCDAQWDDSSTTYRFVTYDAARDARRCQTECWWMISEEETLYGYNQESEYWELFPFTSA

SEQ ID NO: 537 - protein, 119 aa, Solanum lycopersicum
MEVHKRKYIHDGEIEAKKQMKTEEIDGTAAAVVEDDEVEEFYAILRRIRVAVKYFEKGNAEGSGAGRNLTAAKPWSPNFRQEELKRAVDGVKERETVEDNAGLDLNADPVTDPSSSEAN

SEQ ID NO: 538 - protein, 310 aa, Solanum lycopersicum
MDGRGGCCIARYAGGAYDMSKVDRIMLKFRPIAPKPAAAGSSVSGTTTPPQKSEVPVRTGRWKRRYVKDNKNSNNNKRSSSGGCSPTPSRRKRKARSVEENDSSAKSVSGGETAVTLPLLSEIPERKDNSVDMMKKNAPIWLSFGGNQGNNNDNSNNNNGQLQGVAMDRSVVMFPQPVRVVGSWVKVESVTDAWVEGYGLGRTDEEKLINLERDSCPGFISDGLNRVRWANKAYKGMVGDGAGEVVVWLVMKDDVRLPESKSTAAFTCRVRVVRCGKEKNSLILPCDVWRMDGGGFAWRLDTEAALSLGR

SEQ ID NO: 539 - protein, 83 aa, Solanum lycopersicum
MSSSRRAWIVAASVGAVEALKDQVGLCRWDYPLKCLAQHTKNNMRCYSQAKKLSSSLIAKCEKTEQSEESLRKVMYLSCWGPN

SEQ ID NO: 540 - protein, 304 aa, Solanum lycopersicum
MWRNSCNLLKRTVTLVARTNTVNNGVRPFLGVDYKFGCYCGPTRMVGGYYFSSGSNGGGENKNGDSITHEEAKRLMRLVNVEELKWKLGMKNTEVIGYMDLLKACKNMGVAKTHDEAVGFARVLDEAGVILLFRDKVYLHPDKVVDEIRKAVPLALLPENDPTIEELKILQEKKDKIDELAHRHVRRVLWAGLGAGLLQVGLFFRLTFWEFSWDVMEPIAFFTTSAGIVIGYAYFLVTSRDPSYQDVLKRLFLSRQRKLIKKHDFDIQRFVELQKKIKLPVNSQSSIKHRLGMELEPEDLLHGH

SEQ ID NO: 541 - protein, 496 aa, Arabidopsis thaliana
MSLWYIIVAFVFFSTIIIVRNTRKTKKNLPPGPPRLPIIGNLHQLGSKPHSSMFKLSEKYGPLMALRFGSVSTVVASTPETVKEVLKTFDAECCSRPYMTYPARLTYNLKDIGFCPYTKYWREVRKMTVVELYTAKRVQSFQHTRKEEVASLVDFITQAASLEKPVNLNTKLMKLSGSVICRVVFGINLKGSKLENLYEEVIQGTMEVVGSFAAADYFPIIGRIIDRITGLHSKCEKIFKAMDAFFDQSIKHHLEDESIKDDIIDLLLKMERGEIELGEFQLTRDNTKGILFNILNAGIDTSAQVMTWVMTYLISNPRVMKKAQAEVREVIKNKDDIIEEDIERLEYLKMVVKETFRVLPLVPLLIPREASKDVKIGGYDIPKKTWIHVNIWAIHRNPNVWKDPEAFIPERFMDNQIDYKGLNFEFLPFGSGRRMCPGIGMGMALVHLTLINLLYRFDWKLPEGMEVEDVDLEESYGLVCPKKVPLQLIPVLTQWS

SEQ ID NO: 542 - protein, 289 aa, Brassica napus
MASRPCDSCRSAAATLFCRADAAFLCGECDGKIHTANKLASRHERVLLCQVCEQSPAHVTCKADAAALCVTCDRDIHSANPLSRRHERVPVTPFYDAPSNADVSMEAASWLLHNPSVKEGGVEIPNLFADLDYSGVDPKMEASENSSGNDGVVPVQTRALFLSEDYFNFDISASKTTFPHGFSCINQTVSSTSLDVPLVPEGGAVVEMSRTTATPALQLSPAEREARVLRYREKRKNRKFEKTIRYASRKAYAEVRPRIKGRFAKRTDSRVNDGGEVGVYGGFGVVPSF

SEQ ID NO: 543 - protein, 243 aa, Unknown
  Sequence found in Organisms: Brassica napus, Brassica oleracea
MCGGAVISDFAPNVTKAKGRKLTAEELWSELDASAADDFWGFHSTSKTQSTNQQVTLKEEAAEKEKEKEPVTEKRRKRKNVYRGIRKRPWGKWASEIRDPRKGARVWLGTFNTAEEAAMAYDVAAKRIRGDKAKLNFPDLLHHPTRSPATPLASSPVSEVQPPAKKHCVVSQSELTQPSFPVEYSGVGSGDEFQLDYDLKQQISSLESFLELDGDTVEQPSQLDESVSEVDMWMIDDVFASYQ

SEQ ID NO: 544 - protein, 466 aa, Medicago truncatula
MASSITNLNSPKLLPISKEQTNPFSHFPSNTLKFASLSSRTFSNVSCSVIRDTSSVLPLQDANGSVVLQRPDSFGRFGKFGGKYVPETLMHALTLLEASFHSLAGDEDFQKELAGILKDYVGRETPLYFAERLTEHYKNANGEGPHIYLKREDLNHTGAHKINNAVAQALLAKKLGKKRIIAETGAGQHGVATATVCARFGLECIIYMGAQDMERQALNVFRMRLLGAEVRPVHAGTATLKDATSEAIRDWVTNVETTHYILGSVAGPHPYPMMVREFHAVIGKETRKQALEKWGGKPDILIACVGGGSNAMGLFHEFVDDSDVRLIGVEAAGFGLNSGKHAATLTKGEVGVLHGAMSYLLQDDDGQIVEPHSISAGLDYPGVGPEHSFLKDLGRAEYHSITDDEALEAFKRVSRLEGIIPALETSHALAYLEKICPTLPNGTKVVVNFSGRGDKDVQTVTKYLKL

SEQ ID NO: 545 - protein, 369 aa, Solanum lycopersicum
MDLNNLFISLTPSWTSVSMLIGFFLYLATVGSILPGKLVPGATLSDGTRLHYRCNGLLSLLLLVLLLGVGSQMNLVSPTAIADRGLELLSTTLIFSVLVTLMLYLVGLNSRAKSSSLKPHVSGNLIHDWWFGIQLNPEFMGIDLKFFFVRAGMMGWLLINLSVLAKCVVEAKLSQSMILYQLFCGLYILDYFFYEEFMTSTWDIIAERLGYMLVFGDLVFIPFTFSIQGWWLLSNKVELTTAAIIANCLVFLIGYSVFRGANKQKHVFKKDPKAPIWGSPPKVIGGKLLASGYWGIARHCNYLGDLLLASSFSLPCGISSVVPYFYPIYLLILLIWRERRDEARCAEKYKDVWAEYRKLVPYRILPYVY

SEQ ID NO: 546 - protein, 246 aa, Solanum lycopersicum
MASNTLMSYGIAPVYPSILSSSKSKFATALPVSTGVTNDTSRFSMSANWMPGQPRPSYLDGSDPGDFGFDPLGFGEVPENLERYKESELIHCRWAMLAVPGIIVPEALGLGNWVKAQEWAAIPGGQATYLGQPVPWGTLPTILAIEFLAIAFVEHQRSMEKDSEKKKYPGGAFDPLGYSKDPAKFEELKVKEIKNGRLALLAFVGFCVQQSAYPGTGPLENLATHLADPWHNNIGDVIIPKGIFPN

SEQ ID NO: 547 - protein, 462 aa, Solanum lycopersicum
MASQPKNVGILAMEIYFPPTCLQQEVLEAHDGASKGKYTIGLGQDCMGFCTEVEDVISMSLTAVNSLLEKYSVDPKQIGRLEVGSETVIDKSKSIKTFLMEIFEKHGNTDIEGVDSTNACYGGTAALFNCVNWVESASWDGRYGLVVCTDSAVYAEGPARPTGGAAAIAMLVGPDAPIVFESKIRASHMSHVYDFYKPILDSEYPVVDGKLSQTCYLMALDACYKSLCNKYEKLEGKQFSMSDAAYFVFHSPYNKLVQKSFSRLLFNDFLRNASSIDESAKKILAPFESLTGDESYQSRDLEKASQQLAKPLYDEKVQPTTLIPKQVGNMYTASLYAAFASLLHNKHNTLAGQRVIMFSYGSGLTATMFSLKFNEGQHPFSLSNIASVMNVTEKLESRHEFTPEKFIEILKLMEHRYGAKDFVTSKDCSLLAPGTYYLTEVDSKYRRFYAKKAQENGLVNGH

SEQ ID NO: 548 - protein, 156 aa, Solanum lycopersicum
MSLIPSFFGGRRSNIFGPFSLDLWDPFEGFPIANTPSSAREISAFANAKIDWKETPQAHVFKVDVPGIKKEEVKVEVEEGRILQISGERSREKEEKNDQWHRMERSSGKFKRRFRLPENAKTGEIKAEMENGVLTVTVPKEEEKKKSEVKAIDISG

SEQ ID NO: 549 - protein, 425 aa, Glycine max
MESGVVAVNNNINNYESKATSTITIKGILSLLMESIDDENCDGGGSKKRVISLGMGDPTLTTLFHTPKVVEEAVADALQSRKFHGYAPTAGLLQARIAIAEYLSRDLPYQLSRDDVFITCGCTQAIDVSVAMLARPGANILLPRPGFPIYELCAAFRGVEVRHYDLLPEKGWEVDLDAVEALADQNTVALAIINPGNPCGNVYSYHHLEKIAETAKRVGTIVISDEVYGHLAFGSKPFVPMGVFGSTVPVLTLGSLSKRWIVPGWRLGWFVTNDPSGTFREPKVVERIKKYFDLLGGPATFLQAAVPQIIANTEEIFFEKTIDNLRHTADICCKEIEDIPCIFCPYKPEGSMAMMVKLNLSLLEDISDDIDFCFKLAKEESVIILPGTAVGLKDWLRITFAADPSALGEGMRRIKSFYQRHARKL

SEQ ID NO: 550 - protein, 63 aa, Glycine max
MAELSLGILIDIVDEEWMRDTLPDDDLPLPPTLVVRTDDTEDSNQETQQVNLDAWHDLAFGQE

SEQ ID NO: 551 - protein, 417 aa, Arabidopsis thaliana
MEKQAKLTRTQSSLLRSSSNLRSSYQSLSSIVEGEQDLEAGEKEEKQRRKPPKPFGSPNPKTGLTRINPGLAFTMVSLSFLSLSSFFFFVVFSQTDEILTSENLLLALIFVAVALFFASKNISLLNQTVIAIKNLGFQNRDSKSKPVQWYIGDDSKPEKKVIKRFVKEGVQFYSNGDFYEGEFNKGKCNGSGVYYYFVRGRYEGDWLDGRYDGHGIESWARGSRYKGQYRQGLRHGFGVYRFYTGDCYAGEWFNGQSHGFGVQSCSDGSSYLGESRFGVKHGLGSYHFRNGDKYAGEYFGDKIHGFGVYRFANGHCYEGAWHEGRKQGFGAYSFRNGDAKSGEWDSGVLVTSLPLTSEPVSRAVQAARETANKAVNRRRVDEQVSRAVAAANKAATAARVAAVRAVQNQMDGKFCQS

SEQ ID NO: 552 - protein, 344 aa, Medicago truncatula
MGTRSQQSCVDEDEEEFIGCGTTISGQSGSTSRSAGGLASSRSEQTIGTAAGDNTALRLNHLDIQDDDAASQGVVASKKKKRGQQRATGGDKSGRGLRQFSMKVCEKVESKGRTTYNEVADELVAEFADPINSVLTPDKQQYDEKNIRRRVYDALNVLMAMDIISKDKKEIQWKGLPRTSLNDIEELKTERLGLRNRIERKSSYLQELEEQFVGLQNLVKRNEQLYSSGNPPSGGVSLPFILVQTRPHATVEVEISEDMQLVHFDFNSTPFELHDDNYVLKAMEFGDRTQSDIVTHNVTDGGEGSSMSGMHQSQVPPSASSVSTRPPTSPPLPGILKARVKQEH

SEQ ID NO: 553 - protein, 249 aa, Solanum lycopersicum
MQSDYEMGGIHQECEDEPRFMVENNASTSSPFYPNYHFPPTSHPILQQIHSLPITQHFFPYQHAHYRSMSEEIRVDQSQTAELVAFPASEIRGGQEDALIRGSERYCTQPRQTCVAVWQNQEDSAMKQPVWKGEYSNGNAIEKNKQEEDEELYSLEETNKRRVVFGELEAICIRGIASESADNLPTNHNVTFPELALNEAMVNKMDNTMGKFHKRKRGKDEWGRFFKSLVKKLANHQEDLQRSLMETME

SEQ ID NO: 554 - protein, 234 aa, Arabidopsis thaliana
MVYFQNSISLVDQSPIMAHSPDFHHHSKQSRTSSSNRKSSSSSCSSNFSVCCDGSRSAAIDVVILIAVITSSGFLIFPYIKFITIKSVEIFSELSCLVKEEILRNPDPIVYGLIALSISCTALSAWMIVILLCSRHRCGKPNCKGLRKANAEFDIQLETEDCVKSSNSGKSVSKKGLFELPRDHHRELEAELKKMAPPNGRAVLVFRAKCGCSVGRLEVPGPKKQQLQQRKVKK

SEQ ID NO: 555 - protein, 67 aa, Arabidopsis thaliana
MCLEVVYHEEKTELGRQQAPGMCPYCGGKVSAVDIETKWLFCFLPLCFKVKRKYSCSSCERHLVLYY

SEQ ID NO: 556 - protein, 51 aa, Arabidopsis thaliana
MDPAPEPVTYVCGDCGQENTLKSGDVIQCRECGYRILYKKRTRRVVQYEAR

SEQ ID NO: 557 - protein, 71 aa, Solanum lycopersicum
MSRGNQRDRDRERAQARGNHKSKTPKNDGLTPEQRRERDAKALQEKAKKKAAQAEDGWNINKSESHNIKKK

SEQ ID NO: 558 - protein, 1200 aa, Arabidopsis thaliana
MVGGGTKRRRRRLQLSKLYTLTCAQACFKQDHSQIGGPGFSRVVYCNEPDSPEADSRNYSDNYVRTTKYTLATFLPKSLFEQFRRVANFYFLVTGVLAFTPLAPYTASSAIVPLLFVIGATMVKEGVEDWRRQKQDNEVNNRKVKVHRGDGSFDAKEWKTLSIGDIVKVEKNEFFPADLVLLSSSYEDAICYVETMNLDGETNLKVKQGLEVTSSLRDEFNFKGFEAFVKCEDPNANLYSFVGTMELKGAKYPLSPQQLLLRDSKLRNTDFIFGAVIFTGHDTKVIQNSTDPPSKRSMIEKKMDKIIYLMFFMVITMAFIGSVIFGVTTRDDLKDGVMKRWYLRPDSSSIFFDPKRAPVAAIYHFLTAVMLYSYFIPISLYVSIEIVKVLQSIFINQDIHMYYEEADKPARARTSNLNEELGQVDTILSDKTGTLTCNSMEFIKCSVAGTAYGRGVTEVEMAMGRRKGGPLVFQSDENDIDMEYSKEAITEESTVKGFNFRDERIMNGNWVTETHADVIQKFFRLLAVCHTVIPEVDEDTEKISYEAESPDEAAFVIAARELGFEFFNRTQTTISVRELDLVSGKRVERLYKVLNVLEFNSTRKRMSVIVQEEDGKLLLLCKGADNVMFERLSKNGREFEEETRDHVNEYADAGLRTLILAYRELDEKEYKVFNERISEAKSSVSADRESLIEEVTEKIEKDLILLGATAVEDKLQNGVPDCIDKLAQAGIKIWVLTGDKMETAINIGFACSLLRQDMKQIIINLETPEIQSLEKTGEKDVIAKASKENVLSQIINGKTQLKYSGGNAFALIIDGKSLAYALDDDIKHIFLELAVSCASVICCRSSPKQKALVTRLVKSGNGKTTLAIGDGANDVGMLQEADIGVGISGVEGMQAVMSSDIAIAQFRYLERLLLVHGHWCYRRISTMICYFFYKNITFGFTLFLYETYTTFSSTPAYNDWFLSLYNVFFSSLPVIALGVFDQDVSARYCLKFPLLYQEGVQNVLFSWRRILGWMFNGFYSAVIIFFLCKSSLQSQAFNHDGKTPGREILGGTMYTCIVWVVNLQMALAISYFTLIQHIVIWSSIVVWYFFITVYGELPSRISTGAYKVFVEALAPSLSYWLITLFVVVATLMPYFIYSALQMSFFPMYHGMIQWLRYEGQCNDPEYCDIVRQRSIRPTTVGFTARLEAKKRSVRISEPAS

SEQ ID NO: 559 - protein, 61 aa, Arabidopsis thaliana
MVRNGYSMNYMNSAWLAGKTRICKDSFLIHLVCGYVSVTFQTLMTEACVHSKLVIVVRFRY

SEQ ID NO: 560 - protein, 1254 aa, Arabidopsis thaliana
MGVGDPLPLPPEKNRREVNKPPDIASTSSSSASAVNNARLSDAPILLFVYFHKAFRAQLAELQFLAGDTVRSGSDLAVELRSKFEFLKLVYKYHSAAEDEVIFSALDTRVKNIVFNYSLEHDATDDLFTSVFHWLNVLEEEQGNRADVLREVVLCIGTIQSSICQHMLKEERQVFPLMIENFSFEEQASLVWQFICSVPVMVLEEIFPWMTSLLSPKEKSEVETCFKEVVPNELSLQLVINSWLIDDSQSSLTALTKIMKGVQSVEVSENMTNSQTNSSSSGVFQRFWQWSKKMSFSSPNTGHILVHGIHLWHNAIRKDLVDIQKGLCQLTFPSLSLDLNVLVVRLNFLADVLIFYSNAFKTFFYPVFEDMVDQQHSSSSKQFTIDGHVENFKKSLDLETRAGSDNFVITLQEKLESLILTVAKQFSIEETEVFPIISKNCNIEMQRQLLYRSIHFLPLGLLKCVIMWFSAQLPEDECQSIIHYLSSEDSFPNKPFAHLLLQWFRFGYSGKTPVESFWNELSFMFKPRCSFEEELTEEASGSFFQQSPQKLFKVSDPYSMDPPAGYMNETPYSSAMNQQILIPGKLRPLLHLPDLFGDKTIGEHLTMDLKPIDLIFYFHKAMKKDLDYLVRGSARLATDYSFLGEFQQRFHLIKFLYQIHSDAEDEIAFPALEAKGKLQNISQSYSIDHELEVEHLNKVSFLLNELAELNMLVLDHKNVKYEKLCMSLQDICKSIHKLLSEHLHREETELWCLFRDCFTIEEQEKIIACMLGRISGEILQDMIPWLMESLIPDEQHAVMSLWRQATRKTMFGEWLTEWYNSHAVEEETEEANKDPSENSDPLDVVWSYLFEGAADEYKGSICSKPLEETELKGIMNKPLGKAAPNNKVEFGNKEENHLEISGSKKVCTGADETKYKEQTDSNAQAFQMSHNTSQSGQDSRYECLLSMSQEDVEATIRRISRDSSLDPQKKSYIIQNLLMSRWIATQRIYNLEPSILSSNREAVPGQNPSYRDPHKLIFGCKHYKRSCKLLAPCCNKLYTCIRCHDEEVDHLLDRKQITKMMCMKCMIIQPVGASCSNISCSSSMGKYYCKICKLFDDDREIYHCPYCNLCRLGKGLSIDYFHCMKCNACMSRLIVEHVCREKCLEDNCPICHEYIFTSNSPVKALPCGHVMHSTCFQEYTCSHYTCPICSKSLGDMQVYFRMLDALLAEQKMPDEYLNQTQVILCNDCGRKGNAPYHWLYHKCSSCASYNTRLF

SEQ ID NO: 561 - protein, 134 aa, Solanum lycopersicum
MAKSTKILSSILILFFIFSLFSSSNALGGKLGGRTQIKDVKTNQEIQDLGKYCVEEHNRDLRHINGALSSLLSFSQVVEAEKQVVSGVKYYLKISAIVKSSSSPKLFDAVVVVKAWEKKKELLTFSPSPSPATK

SEQ ID NO: 562 - protein, 104 aa, Arabidopsis thaliana
MEGLEKFYSKMVKEAKSAASSSSSSLSDFADNLMQDKRAAAGNLTTTYDAGSGTLVTRPPSGVSVWTCSKLCAVFFVAGVFVGYTLKRRVRRWASKLLRRIKDD

SEQ ID NO: 563 - protein, 319 aa, Arabidopsis thaliana
MESEIASEFLPFCRIYKDGRVERLIGTDTIPASLDPTYDVVSKDVIYSPENNLSVRLFLPHKSTKLTAGNKLPLLIYIHGGAWIIESPFSPLYHNYLTEVVKSANCLAVSVQYRRAPEDPVPAAYEDVWSAIQWIFAHSNGSGPVDWINKHADFGKVFLGGDSAGGNISHHMAMKAGKEKKLDLKIKGIAVVHPAFWGTDPVDEYDVQDKETRSGIAEIWEKIASPNSVNGTDDPLFNVNGSGSDFSGLGCDKVLVAVAGKDVFVRQGLAYAAKLEKCEWEGTVEVVEEEGEDHVFHLQNPKSDKALKFLKKFVEFIIG

SEQ ID NO: 564 - protein, 115 aa, Arabidopsis thaliana
MRTLEESKISIVFLLLLLFSIFISSSHQANEVLPAEGDNEMMMVPLGEEKFMVMNETRRKLGSFQICSVCTCCGGAKGLCLPSPCCYAINCNIPNRPFGYCSFTPKTCNCFGCHI

SEQ ID NO: 565 - protein, 446 aa, Arabidopsis thaliana
MANDAAACAERATNDMLIGPDWAINIELCDLINMDPSQAKEAVKVLKKRLGSKNSKVQILALYALETLSKNCGENVYQLIIDRGLLNDMVKIVKKKPELNVREKILTLLDTWQEAFGGRGGRYPQYYNAYNDLRSAGIEFPPRTESSLSFFTPPQTQPDEDAAIQASLQGDDASSLSLEEIQSAEGSVDVLMDMLGAHDPGNPESLKEEVIVDLVEQCRTYQRRVMTLVNTTTDEELLCQGLALNDNLQHVLQRHDDIANVGSVPSNGRNTRAPPPVQIVDINHDDEDDESDDEFARLAHRSSTPTRRPVHGSDSGMVDILSGDVYKPQGNSSSQGVKKPPPPPPHTSSSSSSPVFDDASPQQSKSSEVIRNLPPPPSRHNQRQQFFEHHHSSSGSDSSYEGQTRNLSLTSSEPQKEEKPEDLLFKDLVEFAKTRSSKANNNNRSL

SEQ ID NO: 566 - protein, 62 aa, Arabidopsis thaliana
MPEEDVVDQKRYFEESCKPKCVKPLLEYQACVKRIQDDESGHKHCTGQYFDYWHCVDKCVSV

SEQ ID NO: 567 - protein, 647 aa, Arabidopsis thaliana
MTGLSVEKTGSTRSTVFFIIFNLSIFSLSIEARSRQQHASFPPRGWNSYDSFCWTISEAEFLQSAEIVSKRLLPHGYQYVVVDYLWYRKKVEGAYVDSLGFDVIDEWGRLHPDPGRWPSSRGGKGFTEVAEKVHRMGLKFGIHVMGGISTQAYNANSLVMDSVKGGAYEESGRQWRAKDIGIKERACVWMSHGFMSVNTKLGAGKAFLRSLYRQYAEWGVDFIKHDCVFGTDFNIEEITYVSEVLKELDRPVLYSISPGTSVTPTMAKEVSQLVNMYRITGDDWDTWKDVTAHFDISRDLSASSMIGARGLQGKSWPDLDMLPLGWLTDQGSNVGPHRACNLNLEEQKSQMTLWSIAKSPLMFGGDVRNLDATTYNLITNPTLLEINSYSSNNKEFPYITATRVSRNKHKGYPHHPTGKNISTKHAFGLTSCKEQKANTWFIVDKNRGQICWNQHSSEKLEKPFCLYNRKALLASDKKLKHNQLYQGKLHLHTNDKAQSCLAASSQQKLTSKDYSQGALSPCKLDANQMWELHSNGTLENSYSGLCAVLNPVKAAEASSNGVRSWIATGRRGEVYVAFFNLNQEKTKISAKISDIATALRGKKNLVGASCTSHELWSGKDFGPTKDSVSIQVEPHGPALFVLHCSNA

SEQ ID NO: 568 - protein, 315 aa, Arabidopsis thaliana
MEIDGGDRISGERPIIMVTNDDGIDAPGLRSLVRVLVSTNLYDVRVCAPDSEKSAVSHSIIWSRPLTAKRVEIDGATAYSVDGTPADCTGLGLSEALFPSRPDLVLSGINVGSNCGYNIVYSGTVAGAREAFLYDVPSASISYDFDWKRGEMNANDFALSAQACLPIINGILGAIKNKTHPMQCFLNIDLPTDIANHKGYKLTRQGKSMGKMGWRQVEEEAQGPKMLSTMTMDTESGVVSSENDTSAHAGKDSRLFKRELRASISEEGSDSHYLKEGFITVTPLGALSQTDVDCQNYYKEWLPKITNQSCSSSSL

SEQ ID NO: 569 - protein, 702 aa, Arabidopsis thaliana
MEGFLTDQQREMMKVATQTADDLPPSQKPHSVLLEHLPKPSGGGKASGASNAVKHRRSHAGRSIRSKKDGGGGKGNWGKLIDTDGDYHIDPNDPNYDSGEEPFELVGATLSDPLDDYKKAAASIINEYFSTGDVDVAAADLIELGSSEYHPYFIKRLVSVAMDRHDKEKEMASVLLSALYADVINPNQIRDGFVLLLESADDFVVDIPDAVNVLALFLARAVVDDILPPAFLPRAAKALPITSKGYQVVQTAEKSYLSAAHHAELVERRWGGQTRTTVEEVKKKIADILNEYVETGETYEACRCVRELGVSFFHHEVVKRALVTALENHAAEAPVLKLLNEAASENLISSSQMVKGFSRLRESLDDLALDIPSARTKFGLIVPKAVSGGWLDASFGYPSGECGRQQNEDEKLKRFKEDIVTIIHEYFNSDDIPELIRSLEDLGAPEYNPIFLKKLITLALDRKNHEKEMASVLLSSLHIEMFTTEDVADGFVMLLESAEDTALDILDASNELALFLARAVIDDVLAPFNLEEISSKLRPNSSGTETVKMARSLIFARHAGERLLRCWGGGSGWAVEDAKDKISNLLEEYESSGLVSEACKCIHELGMPFFNHEVVKKALVMGMEKKKDKMMLDLLQESFSEGLITTNQMTKGFTRVKDGLEDLALDIPNAKEKFNDYVEYGKKNGWVSSSFLTSLTEDANVG

SEQ ID NO: 570 - protein, 172 aa, Arabidopsis thaliana
MLSPIENERSEIPSPEKLKLVEEPSDDESKFSNYDSDDWETLSDDLRLLDEEWGKSGGFDVDFSKVRHRFGRGAVHLDDDNMVSEPHETNRDLLNRLSNMAISFYNDKTGIKLELVKVLRANFHPSAAITLYITFEANDPSDGNQTKRYQAVVRYLSFDIEVCSCNPEPSSS

SEQ ID NO: 571 - protein, 282 aa, Arabidopsis thaliana
MFGVSMRTLISPSLAPFSLHLHKPSLFSTALRFSFSINNITPTNSPPSTISTRKLQTKATRVTSSSSSQPLSSSSPGEIHVVVGPMFSGKTTTLLRRILAERETGKRIAIIKSNKDTRYCTESIVTHDGEKYPCWSLPDLSSFKERFGFDDYENRLDVIGIDEAQFFGDLYEFCREAADKEGKTVIVAGLDGDFMRRRFGSVLDLIPIADTVTKLTSRCEVCGKRALFTMRKTEEKETELIGGAEVYMPVCRSHYVCGQNVLETARAVLDSSNNHSVVASSL

SEQ ID NO: 572 - protein, 353 aa, Arabidopsis thaliana
MGSVTGFYSNEVFELDPKWVVDPQHLFVGPKIGEGAHAKIYEGKYKNKTVAIKIVKRGESPEEIAKRESRFAREVSMLSRVQHKNLVKFIGACKEPIMVIVTELLLGGTLRKYLVSLRPGSLDIRVAVGYALDIARAMECLHSHGVIHRDLKPESLILTADYKTVKLADFGLAREESLTEMMTAETGTYRWMAPELYSTVTLRHGEKKHYNHKVDAYSFAIVLWELIHNKLPFEGMSNLQAAYAAAFKNVRPSADDLPKDLAMIVTSCWKEDPNDRPNFTEIIQMLLRCLSTISSTELVPPAIKRVFSSENTVLPPESPGTCSLMTVRDKDQIPTDANSAQNEVRGSFFFFCC

SEQ ID NO: 573 - protein, 443 aa, Arabidopsis thaliana
MNPKIRKPNNSSSKKVTVSVLSVFLVFVFVNTFFYPSFYSDSGSIRRNLVDSRESFHFPGNFRKTKVYMYELPTNFTYGVIEQHGGEKSDDVTGLKYPGHQHMHEWYLYSDLTRPEVKRVGSPIVRVFDPAEADLFYVSAFSSLSLIVDSGRPGFGYSDEEMQESLVSWLESQEWWRRNNGRDHVIVAGDPNALKRVMDRVKNAVLLVTDFDRLRADQGSLVKDVIIPYSHRIDAYEGELGVKQRTNLLFFMGNRYRKDGGKVRDLLFKLLEKEEDVVIKRGTQSRENMRAVKQGMHTSKFCLHLAGDTSSACRLFDAIASLCVPVIVSDGIELPFEDVIDYRKFSIFLRRDAALKPGFVVKKLRKVKPGKILKYQKVMKEVRRYFDYTHLNGSVNEIWRQVTKKIPLIKLMINREKRMIKRDGSDPQCSCLCSNQTGIIHGV

SEQ ID NO: 574 - protein, 696 aa, Arabidopsis thaliana
MAKTNQAITICSLLLLLLLSETTSHLLCSDSKTPVNNNETLQFCDSYKERSCCNSKDDLQLQNRFNSMNISDSNCSSLLKSILCSKCDEFSGQLFGDDDSSLVPILCNSTSQDLCSKLWDSCQNISIVSSPFSPTLLGGATSPSTSSNSSTLTDLWKSQTEFCTAFGGPSQTNNNKTKCFNGEPVNRDTSDDDEDDVKTPKGICLEKIGTGSYLNMVAHPDGSNRAFFSNQPGKIWLGTIPDQDSGKPMEIDESTPFVDITDQVSFDTQFGMMGMAFHPKFAENGRFFASFNCDKVKSPGCSGRCACNSDVNCDPSKLPKDDGTTPCRYQTVVSEYTANGTSSSPSTAKIGKASEVRRIFTMGLPYSSSHGGQILFGPDGYLYLMTGDGGGVSDTHNFAQNKKSLLGKILRLDVDVMPSVSEISKLGLWGNYSIPKNNPFQGNENEQPEIWALGLRNPWRCSFDSERPDYFLCADVGKDTYEEVDIITMGGNYGWRTYEGPYVFSPLSPFGENVSSDSNLTFPILGYNHSEVNKHEGSASIIGGYFYRSNTDPCSYGTYLYADLYANAMWAAIESPEDSGNFTDSLIPFSCSKDSPMKCTAAPGGASSGPALGYIYSFGQDNNKDIHLLTSSGVYRIVRPSRCNLACSKENTTASAGKQNPAGSAPPQPLPSSARKLCFSVFLLLSLLMMFLTLLD

SEQ ID NO: 575 - protein, 344 aa, Brassica napus
MAEANKTSREIARSNSCVFPRDLLQRFISNSAEGEDGDHEEEDDEEIELNLGLSLGGRFGVDKSNKLVRSSSVVVTMPLFREAHQPETTKPAETAVARPRHTGLTRTTSLPAESEEEWRKRKEMQTLRRMAAKRRRSEKLRTGGGNSTKSTEANNNPGEAATTSRRRGRPSSGLPRWSATANSGGLLRQHSAGHESLQGSLESQGGGGGGVGSSSSVSELETKSHQASSEEARSLPSTQQQQEAIAKPNTRLRRLSSVDMKIEPPQGKGKNEMPCVFTKGDGPNGKRVDGILYRYGNGEEVRIMCVCHGDFLSPADFVKHAGGPHVDHPLRHIVVNTSSPSNLL

SEQ ID NO: 576 - protein, 564 aa, Brassica juncea
MVVFGNVSAANLPHQNGVLKAISSGGCDLMGHRSFKISTSFKTRTRRRSAGPLQVVCVDIPRPELENTVNFLEAASLSASFRSAPRPAKPLKVVIAGAGLAGLSTAKYLADAGHQPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVEQWMRKQGVPDRVTDEVFIAMSKALNFINPDELSMQCILIALNRFLQEKHGSKMAFLDGNPPERLCMPIVEHIRSLGGEVRLNSRIRKIELENDGTVKNFLLTDGTTIQGDAYVFATPVDILKLLLPDSWKEIPYFKRLEKLVGVPVINVHIWFDQKLKNTYDHLLFSRSNLLSVYADMSLTCKEYYDPNRSMLELVFAPAEEWISRTDSDIIDATMKELEKLFPDEISADQSKAKILKYHVVKTPRSVYKTIPDCEPCRPLQRSPIKGFYLAGDYTKQKYLASMEGAVLSGKFCSQSILQDYELLAASSGPQKLSEATLST

SEQ ID NO: 577 - protein, 320 aa, Brassica juncea
MACKNSLVVKQIIDLYDQISKLECLKPSKNVDTLFGQLVSTCLPTDTNIDVTKMSDEVKDMRSNLIKLCGEAEGYLEQHFSTILGSLPEDQNPLDHLNIFPYYNNYLKLGKLEFDLLSQHSSHVPNKIAFVGSGPMPLTSIVLAKFHLSNTTFHNFDIDSHANTLASSLVSRDPDLSKRMIFHTTDVLNATEGLDQYDVVFLAALVGMDKEAKVKAIEHLENHMAPGAILMLRSAHALRAFLYPIVDSSDLKGFQLLTIYHPTDDVVNSVVIARKLGGSTTTGVNGTRGCMFMPCNCSKVHAIMNNRCKKMMIEEFSAIE

SEQ ID NO: 578 - protein, 424 aa, Brassica juncea
MATTPKCTEWQFSGSEAAKEAAAATLGAYTSKLYALCDSNGKLILPPSNKAIETSHTAEKAVVKVVLSGTGNAYAPSIGLPLAKSAVAEYLNRDLPKKLTADDVFMTVGCKRAIDLAVDILAKPKANVLLPRPGFPWDVVRSIYKNLEVRYYDFIPENNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKIIQAANEFLQINAKPPTVIQAAMPDILERTPLHFFQDRGNFLKHKVDIGYSKAKHIPGLTCYMKPEACTFLWTKLDISCFADIEDDQDFCSKLAMEENLVVLPGIAFRQKNWLRHSIDMETPTVEDAFERLKSFCERHSVEGGASLKNVNGVN

SEQ ID NO: 579 - protein, 135 aa, Brassica juncea
MGLLDHLWDDTVAGPRPENGLGKLRRHHTFSFRPNSGSDQSDGGSVRSYGEESPEEALKVTRSIMIIKPPGYQGGSAPVSPAGSTPPVSPFSEQSQEERNPFGLGEGRRRTRSIREQQDQRMDQGTLLLLTACDL

SEQ ID NO: 580 - protein, 60 aa, Brassica juncea
MVSQKLEICIELVKFAVVFVATVAESVEKAFRKPLPALPAVHDGSRNTYSAVPIPLVGFM

SEQ ID NO: 581 - protein, 166 aa, Brassica juncea
MSGSVAQLHNVFVYGSFQEPEVVKVMLDRTPEIIPVTLPGFKRFRLKGRLYPCVIPCEDGEVKGQLLMGLTDEELENVDAVEGNEYERVTVGVVREDNSEKMTVKTYIWLNKDDPDIDGEWDFEEWKRLHMKKFIETFKEIMEWKRNPHGKGRDDFNHVLRDAPSA

SEQ ID NO: 582 - protein, 557 aa, Brassica juncea
MASLALSGSCSLAFPLKSRSLLLPRPPSSLNLLKKPLRRISSVKSPLSVSLTNSKRSTLVRASSVAAAASSSSSSSPSPAAPAPALWQGAAIKPLLASITTGVIIWFLPVPEGVTRSAWQLLAIFLATIVGIITQPLPLGAVALLGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGIVSLIVVPFLLHVIYPPTVKSSPDAPKLAQEKFDKMGPMSKNELIMAATWFLTVGLWIFGAKLSVDAVTAAILGLSVLLVTGVVTWKECLAESVAWDTLTWFAALIAMAGYLNKYGLIEWFSQTVVKFVGGLGLTWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 583 - protein, 214 aa, Brassica juncea
MATRGAAAAFVIWKHRNNPSLRSISSHHFYPIFKPQMIPKGCRYQIRAIQGESVDRGTQSKNNDEPKPKPENWKIKMLYDGDCPLCMREVDMLKERNEEYGTIKFVDISSNDYSPQENQGLNYETVMGQIHAIQSDGNVVTGVEAIRKLYELVGLGWVYSITKFEPIGKVADAVYDFWAKYRLQVTGRPPIEAILEARKKNKVETCGDSKACKT

SEQ ID NO: 584 - protein, 223 aa, Brassica juncea
MASNNSNDDLYAVLGLNKECTSTELRTAYKKLALRWHPDRCSSMGNLEFVDEAKKKFQAIQEAYSVLSDSNKRFLYDVGAYNSDDDVEDQNGMGDFLNEMAAMMNQSKPNDNNSGDSFEQLQDLFNEMFQGDAAAFPPSSSSFSASTFASSCNFVFDTNYQQSPFGMGSMGTSDPFGFDSRSHTFSLGVEHQQDFKKEKNNGGRRNRRKNNAQSSNNYGVPTS

SEQ ID NO: 585 - protein, 289 aa, Brassica juncea
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGSGRCFNCGLDGHWARDCTAGDWKNKCYRCGERGHIERNCKNSPKKLRRSGSYSRSPVRSRSPRRRRSPSRSRSLSRSRSYSRSRSPVKRRERSAEERSRSPKRMEDSLSPRGRDRSPIMDDEGSPRIIDGSPPPSPKLEKQDHDGGSPQDNGNGRKTNASPVVGRDSPREDRSPVDDDYEANRASPRGSESP

SEQ ID NO: 586 - protein, 54 aa, Brassica juncea
GLVASLYVVLQDHCLFLTSLLISLTSDMPRKGLLSDLSVVLLGYCEAETFSFSL

SEQ ID NO: 587 - protein, 464 aa, Medicago truncatula
MELSIMLCFFTSILFIVLFRIFIKSFVSKRHDLPLPPGSMGWPYIGETFQLYSQDPNVFFASKIKRYGSMFKSHILGCPCVMISSPEAAKFVLNKAQLFKPTFPASKERMLGKQAIFFHQGEYHANLRRLVLRTFMPVAIRNIVPDIESIAEDSLKSMEGRLITTFLEMKTFTFNVALLSIFGKDEIHYREQLKQCYYTLEKGYNSMPINLPGTLFHKAMKARKELAQILAQIISSRREKKEEYKDLLGSFMDEKSGLSDEQIANNVIGVIFATRDTTASVLTWIVKYLGENISALESVIEEQESILKSKEENGEEKGLNWEDTKKMVITSRVIQETLRVASILSFTFREAVEDVEYQGYLIPKGWKVLPLFRNIHHSPNNFKDPEKFDPSRFEAATKPNTFMPFGSGIHACPGNELAKMEILVLLHHLTTKYRWSVEGTKNGIQYGPFALPQNGLPITLYPKK

SEQ ID NO: 588 - protein, 331 aa, Medicago truncatula
MASFSAKSMTMFFLFTIIFGFGFLHASAQLQRFTHTPKTDGSLNFLVIGDWGRRGKYNQSEVAFQMGVVGEKLDIDFVVSTGDNFYDDGLTGEHDPNFEESFSKIYAAKSLQKQWYSVLGNHDYRGDVEAQLSPFLRQIDSRWLCLRSFIVDSELVEIFFVDTTPFVEEYFTVPEHHYDWNGVNPPQTYIANLLKDVEMALRESTAKWKIVVGHHAIRSAGHHGDTKELVNLLLPILQANHVDFYMNGHDHCLEHISDLSSPIQFLVSGAGSKAWRGDVRETTGNGVNFFYDGQGFMSVQLTRTDANIVFYDVSGQVLHKTTSSKQLHSSI

SEQ ID NO: 589 - protein, 488 aa, Glycine max
MSLSLAIKLHLASSSPSFSLLTLNNHQHANKLTTSETCSNTKVRPKPIYSTNPLIIPTCKVRPRVQYCGTMIKSSLIEPDGGALVDLVVPEGERGAKITLAESLPKVQLTRIDLEWVHVVGEGWASPLKGFMREDEYLQSLHFNSLRVKDGSVVNMSLPIVLAIDDETKERIGSSSHVGLLGPDGDCVAILRSIEIYKHNKEERIARTWGTTAPGLPYVEEVITPAGNWLIGGDLEVLKPIKYNDGLDNYRLSPKQLREEFDKRQADAVFAFQLRNPVHNGHALLMNDTRKRLLEMGYKNPILLLHPLGGFVKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTKVNKMAFFDPTRAKDFLSISGTKMRAFAKSGENPPEGFMCPSGWKVLVKYYESLQAEEPSQQPVLST

SEQ ID NO: 590 - protein, 324 aa, Glycine max
NETLLAIGTAYVQGEDVAARGRILLFSLGKNTDNPQTLVSEVYSKELKGAISALASLQGHLLIASGPKIILHKWNGTELNGIAFFDAPPLHVVSLNIVKNFILIGDIHKSIYFLSWKEQGAQLSLLAKDFGSLDCFATEFLIDGSTLSLMVSDDNRNIQIFYYAPKMSESWKGQKLLSRAEFHVGAHVTKFLRLQMLSTSDRAGAVPGSDKTNRFALLFGTLDGSIGCIAPLDEITFRRLQSLQRKLVDAVPHVAGLNPRAFRLFRSNGKAHRPGPDSIVDCELLCHYEMLPLEEQLEIAHQVGTTRSQILSNLSDLSLGTSFL

SEQ ID NO: 591 - protein, 465 aa, Glycine max
MKKIRNSILLLSFVLAASAAVSSAEQIPSAAYDRVLFPDRRCQKTASENMTRRGSSAAAAECEVWSESCSEAVLSVARRPETAEWLKKIRRKIHANPELAFEEIETSGLIREELDLMEVSYRYPLAKTGIRAWIGTGGPPFVAIRADMDALPIQEAVEWEYKSKVAGKMHACGHDAHVAMLIGAAKILKTREHLLKGTVILLFQPAEEAGNGAKRMMQDGALEDVEAIFAAHVSHEHPTGIIGSRPGPLLAGCGFFRAVISGKKGLAANPHRSVDPVLAASAAVISLQGIVSREANPLDSQVVSVTSFNGGNNLDMIPDSVVLLGTFRAFSNTSFYQLLERIEQVIVEQASVYRCLAEVDFFEKEYTIYPPTVNDNRMYEHVKKVSIDLLGHKNFRVVPPMMGAEDFSFYSEVVPSGFFYIGVRNETLGSTHTGHSPYFMIDEDVLPIGAAAHASIAERYLIEHG

SEQ ID NO: 592 - protein, 405 aa, Glycine max
MATSLQLFQCKLARPFRPFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPLVDASTLKREVAEGVDIMLIRELTGGIYFGEPRGFGTNENGEEIGFNTEIYATHEIDRIAHFAFKVAQKRCGKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAKRIENAVVDTLNRGFRTGDIYSAGTKLVGCKQLGEEILKSVESNVHAGAATV

SEQ ID NO: 593 - protein, 643 aa, Glycine max
MWSAVTDPIRAFFANFLRHFIHKDFHEAVARMTIIDAFLFVIVHSIDKLGIWPRLPVFLGLLYLAIRRRLHQEYNLFNVGTTPVGVRFNHSDFPYRTADGKYNDPFNEVAGSHGTFFGRNILPVDQKKKLLKPDPMVVATKLLARRTYKDTGKQFNVIAASWIQFMIHDWIDHLEDTNQIELIAPREVARQCPLKSFKFYKTKEIPTGFFEIKSGSSNIRTPWWDASAVYGSNGEVLQRVRTFKDGKIKISKDGHLLHNENGTAIAGDIRNSWAGVSTLQALFIQEHNAVCDNLKKHYPQLGDEELYRHARLVTSAVIAKVHTIDWTVELLKTDTLLAGMRANWYGLLGKKFKDTFGHVGGVILGGLVGLKRPENHGVTYSLTEEFVTVYRMHSLLPDNLQLRDISATPGPNKSPPLVKEIPMKNLIGLQGEKTLSEIGVARQLVSMGHQACGALELWNYPEWLRDLVPQNIDGTDRPDHVDLAALEIYRDRERSVARYNQFRRALLLIPISKWEDLTDDKEAIQVLEEVYGDDVEELDVLVGLMAEKKIKGFAISETAFVIFLLMATRRLEADRFFTSNFNEETYTKKGLEWVNTTESLKDVIDRHYPEMSHKWLNSSSAFSVWDSPPNSQNHIPLYLRVPH

SEQ ID NO: 594 - protein, 380 aa, Glycine max
MKELSQTQSVVVHGIAGAGSVALATAFTYPLDSIKVLIQVGSSTGKELDPAQALTRLLSVSGNAGLFNGFGWLLAGRIFGLGARFGVYEILTAFYKDGRENNYLFASEALLAGVVAGAVEAVISSPFELIKLRMQVTAASYVPSSNFALEKGARSPLIARLLHGRYPDKRALDLYVGLISILKTKNTNVTSALLEYPWTMTGSGRPPSVSNVRRPSDIISLEGWRTFWRGLRPGIVRDSVFSGIFFSTWQFLHQAMLDWKAVGMDPPPRLNEEVGPLSPLIVSLTAGFSASVAATASHSFDTTRSRSQCTVLPKYISMERKILKWKRPGTKFERITGIHPSDRGVLFRGIGWRMARSGLASFIIVGSYLFVADQLGSSLT

SEQ ID NO: 595 - protein, 597 aa, Glycine max
MSSSSSSRAFFFFFFFLINVSLLLTLSSAADPFVSYEFEVSYITASPLGVPQQVIAINNKFPGPTINVTTNNNVAVNVRNKLDESLLIHWSGIQQRRTSWQDGVLGTNCPIPAKWNWTYQFQVKDQIGSFFYFPSLHLQRAAGGFGGFIINNRPIIPIPFDTPHGDIVVFIGDWYTRNHTDLRKALDDGKDLGMPDGVLINGKGPYRYNDTLVPDGIDYETIEVHPGKTYRLRVHNVGVSTSLNFRIQSHNLLLAETEGSYTVQQNYTSLDIHVGQSYSFLLSTDQNASTDYYIVASARFVNESRWQRVTGVAILRYTNSKGKARGPLPPGPDDQFDKTYSMNQARSIRWNVSASGARPNPQGSFRYGSINVTDIYVLKNKPLEKINGKQRATLSGNSFVNPSTPIRLADQYKLKGVYKLDFPTKPLTGSPRTETSIINGTYRGFMEVILQNNDTKMHTYHMSGYAFFVVGMDFGDWSENSRGTYNKWDGIARTTAQVYPGAWTAILVSLDNVGVWNLRTENLDSWYLGQETYVRVVNPEVNNKTELPIPDNALFCGALSKLQKPQKVSSDAPSITGNKLKLLFTWLVVWAWIHIFQ

SEQ ID NO: 596 - protein, 303 aa, Glycine max
MEGGKRGTILVTNDDGIDAPGLRALVHSIVNANLFNVLVCAPDSEKSAVSHSITWLHPVAVKQVQIEGTTAFAVSGTPADCASLGISKALFPTVPDLVVSGINKGSNCGYHIVYSGTVAGAREAFFNDIPSISISYDWVKGKSNLHDFTLAAQVCIPIISAVLVETKHPSYPRKCFLNIDVPNNVPNHKGYKLTKQGKSIIKIGWRQATSETEGPKMSSDMTNTDTETSKNFDSSSVSPEHLLFAREVKGSVLDGDDTDYRCLQEGYITVTPLAGLSHAEVDCQAYFKNWLQSVPELPSSSSL

SEQ ID NO: 597 - protein, 233 aa, Glycine max
MDKSNGCSFSSISSIAVFSSAVFVVSLILVRLLYVLYCSSKPLSKRASKPFSTLIILGSGGHTAEMLNLLAVLQKGRFNPRFYIAAATDNMSLQKAQLLENSLAAENATRVTDTAQFMKIYRSREVGQSYITSVWTTFVAMVHALWLMIKIRPEVILCNGPGTCIPLCAIAFIFKVLGIRWSLIFYVESIARVRRLSLRGLLLYKLRMADKLFVQWPQLQRQYPRATYAGRLM

SEQ ID NO: 598 - protein, 192 aa, Solanum lycopersicum
MAALKLILLAAFLFLFNFTANSTALPTSFIKTSCKITTYPQVCVTSLSVYAPTIKRSPQQLAQTALSVSLDRAQSAHTFITKLNKFKGLKSREYAALKDCLEEMSETVDRINKSVKELTRMGSSRGKDVQWHMSNIQTWMSAAITNENSCADGFAGRALNGRIKSSIRARVTHVTQVTSNALALINQFPAKH

SEQ ID NO: 599 - protein, 682 aa, Solanum lycopersicum
MAHDSDLPCDGDGVCMACKVKPSENESLICKTCATPWHVSCLSTPPDSMGDAVNWECPDCSMPPAAVVVPVKQNAVATSSSEGRGDLIAAIRVIESDSTLTEQEKAQKRQDLMSGSSKDEDVAVEGANQDKDVLNILDGSLNCSMCMQLPERPVTTPCGHNFCLKCFQKWVGQRKSTCANCRTPIPAKMASQPRINSALVIAIRMARMMRSGASSGSSKVSHFVHNQNRPDKAFTTERAKKTGKANACSGKIFVTIPGDHFGPITAENDPERNVGVMVGETWEDRFECRQWGAHFPHVAGIAGQSDYGAQSVALSGGYEDDEDHGEWFLYTGSGGRDLSGNKRTNKLQSFDQKFEKLNEALRVSCLKGYPVRVVRSHKEKRSSYAPDKGVRYDGVYRIEKCWRKPGKQGFKVCRYLFVRCDNDPAPWTSDEQGDRPRALPSIKELKGATDMTERKGSPAWDYDEEKSCWMWKKAPPPSRKPVQCENEDGTKVRPVRPKRLTMSVKQRLLKEFTCHLCQEVMNNPLTTPCAHNFCKACLDGAFAGQSFTRQRTCEGRRTLRAQKNIMKCPSCPTDISDFLQNPQINRELMNVIESLKRQIEEENAALSADVDDGSLDGNEILAETDKSMEDDEEGAQPVNETEAKQTNKRKRSGSIDNASSPKKSIDKSDAVHNLEEVDPAHT

SEQ ID NO: 600 - protein, 66 aa, Solanum lycopersicum
MCLVFVCDEDERVLQRQAAPGACPYCGGMVQAVDMESQWRFCFVPYYFKTKRRYYCTLCTRRLIIQ

SEQ ID NO: 601 - protein, 238 aa, Sorghum bicolor
MLAVFSGEVVEVPAELVAAGSRTPSPKTKASELVARFLGTCPSAAVSVRLAADLGHLAYSNANQALLRPRSFAAKDEVFCLFEGVLDNLGRLSQQYGLSKGANEVLLVIEAYKTLRDRAPYPASFMLSQLAGTYAFVLFDKSTNSLLVASDPEGKVPLFWGITADGCVAFSDDIDMLKGSCGKSLAPFPQGCFYSNALGGLKCYENPKNKVTAVPADEEEVCGATFQVEGSTVLAALH

SEQ ID NO: 602 - protein, 445 aa, Arabidopsis thaliana
MEVGFKALLDDLDVLEKSLSDPALINKLRSHVENLATLSKCNPHRRSKVKELSSEVVDSNPYSRLMALQRMGIVDNYERIREFSVAIVGIGGVGSVAAEMLTRCGIGRLLLYDYDTVELANMNRLFFRPDQVGMTKTDAAVQTLAEINPDVVLESFTMNITTVQGFETFTSSLTNKSFCPSKEGGSGVDLVLSCVDNYEARMAVNQACNELRQTWMESGVSEDAVSGHIQLLVPGETACFACAPPLWNMGGFKDSVIQGIVVASGIDERTLKREGVCAASLPTTMGVVAGLLVQNSLKFLLNFGEVSPYLGYNSLKDFFPTMKMRPNPQCSNVACLERQKEYMLAKPERDAAAKAKMEADASTTIDEGPLHDDNEWNISVVDDENEKDTTKAASSSDTLPEGLTRELPVADEYEKAIAIASGSGETEEEDDLEDLKKQLEALNAA

SEQ ID NO: 603 - protein, 899 aa, Arabidopsis thaliana
MGSCFSLQVSDQTLNRIFNCLIGKSYIRTLEKNLRALQREMEDLRAIQHEVQNKVARDEARHQRRLEAVQVWLDRVNSVDIECKDLLSVTPVELQKLCLCGLCSKYVCSSYKYGKKVFLLLEEVKKLNSEGNFDEVSQPPPRSEVEERPTQPTIGQEDMLEKAWNRLMEDGVGIMGLHGMGGVGKTTLFKKIHNKFAEIGGTFDIVIWIVVSKGVMISKLQEDIAEKLHLCDDLWKNKNESDKATDIHRVLKGKRFVLMLDDIWEKVDLEAIGIPYPSEVNKCKVAFTTRSREVCGEMGDHKPMQVNCLEPEDAWELFKNKVGDNTLSSDPVIVELAREVAQKCRGLPLALNVIGETMSSKTMVQEWEHAIHVFNTSAAEFSDMQNKILPILKYSYDSLGDEHIKSCFLYCALFPEDGEIYNEKLIDYWICEGFIGEDQVIKRARNKGYAMLGTLTRANLLTKVGTYYCVMHDVVREMALWIASDFGKQKENFVVQAGVGLHEIPKVKDWGAVRKMSLMDNDIEEITCESKCSELTTLFLQSNKLKNLPGAFIRYMQKLVVLDLSYNRDFNKLPEQISGLVSLQFLDLSNTSIEHMPIGLKELKKLTFLDLTYTDRLCSISGISRLLSLRLLRLLGSKVHGDASVLKELQQLQNLQELAITVSAELISLDQRLAKLISNLCIEGFLQKPFDLSFLASMENLSSLRVENSYFSEIKCRESETESSYLRINPKIPCFTNLSRLEIMKCHSMKDLTWILFAPNLVVLLIEDSREVGEIINKEKATNLTSITPFLKLEWLILYNLPKLESIYWSPLPFPVLLTMDVSNCPKLRKLPLNATSVSKVEEFEIHMYPPPEQENELEWEDDDTKNRFLPSIKPVIISFNLLCLSYLYFLLMFLSRLA

SEQ ID NO: 604 - protein, 628 aa, Arabidopsis thaliana
MVDSKTPAKTKLLDSSSISNVRVVLRVRPFLPREISDESCDGRSCVSVIGGDGGDTSEVAVYLKDPDSCRNESYQLDAFYGREDDNVKHIFDREVSPLIPGIFHGFNATVLAYGATGSGKTFTMQGIDELPGLMPLTMSTILSMCEKTRSRAEISYYEVYMDRCWDLLEVKDNEIAVWDDKDGQVHLKGLSSVPVKSMSEFQEAYLCGVQRRKVAHTGLNDVSSRSHGVLVISVTSQGLVTGKINLIDLAGNEDNRRTGNEGIRLQESAKINQSLFALSNVVYALNNNLPRVPYRETKLTRILQDSLGGTSRALMVACLNPGEYQESLRTVSLAARSRHISNNVSLNPKVETPKVKIDMEAKLQAWLESKGKMKSAHRMMAIRSPLMGTNQTSISQSSVKKLLCHRSAIAESAKLAGTGQRDAFVTARNLFGVETLAASHLWEPIRNLQLASPTKEDERDTSGEENLLVSEASLRDNTLDVEKKYTELSPLREALSPIDSNAKPNSAHGSSPFLKPMTPKTPFLSTNPEIMQMEGTCQKFNAWSNNLKTSLIKEYIHFLNTANREELRELKGIGQKMAEYIIELRETSPLKSLTDLEKIGFTSRQVHNLFKKATEGVLEKPVSASTTP

SEQ ID NO: 605 - protein, 819 aa, Arabidopsis thaliana
MEDGEIEEGMVTADEFPTPEVTTIETIQPPREPGKSPLELLRESKTSVEEIVAKMLSMKKQGNHKSEIRELLTQMFLNFVNLRQANRAILTEEDKVKAETERAKAPVDFTTLQLHNLMYEKSHYVKAIKACRDFKSKYPDIDLVPEQDFFRHAPEAIKDQSLSSDSSHVLMPKRLNFELHQRKELCKHRARLEQQKKSLLETIAERKKFLSSLPLHLKSLKKASLPVQNHLGIQHTKKLKQHNLAELLPPPLYVLYSQLLAQKEAFEESIELEVVGSLKDAQAYARQQSRKDSGMSSNTESSRLEDDGPDDDDDGQRRRKRPKKLTSKEGSDKAGLYQVHPLKIVLHIYDDEIPDTKSLKLVILKFEYLLKLNVVCVGAEGSQDGPEKNIFCNLFPDDAGLEPPHQSTKLILGDGQTFDENRTSRPYKWVQHLAGIDISPVLLGQEAHNTDPAKSDTFVPDLSLYRQQHRVQTVLRRIRLRKKAHLALAEQLDLLMKHELPVVNCEDAPWALHKVLCALDSWLHIQSSASKSCSLTLNSVEQVPEPMEIDVDGRSISGKEDFESIREDGELPSLVTAAASLTSSNHTPSKVSNQARSRQLALMTKNLDSPISKGKSPSFKKYEDDLDLVLDDDSEIDEPTGRTEAHVEELCPEKADNSWVDYGSREFALVFSRKTDGGKLWKLEAMVQISMEYPLRPPLFSLSLHASSSSGNENGTNESDHYNELRAMEAEVNLHMLKIIPSDQENYLLSHQIRCLAMLFDYYVDDPSPDSKRGTATTVVDVGLCKPVDGKLLVRSFRGRDHRKMISWKGRGCASGYPC

SEQ ID NO: 606 - protein, 318 aa, Solanum lycopersicum
MGAEVSKQIERRKAIDTQKKNLCDLKEKNGCNFPGYDYNVQDRKNWMSTLGPEKLHVNQIVWPGTHDSATDEIGIPFISRPFGQCQSLSIYEQLVLGVRVLDIRVQEDRHVCHGILLCYHIDVVINDVKKFLSETHSEIIILEIRTEFGHDDPPNFDKYLEAQLGEFLIHQHDNVFNNTVAELLPKRIICVWKPGKSPKPRQGSPLWNSCYLKDDWIDTDLPEKKFESNMKYLSEQPPITSRKFFYRVENTVTPQADNPVLWVKPVTERIHPYARLFIMECISRGYADRLQIFSSDFIEEDFVDACIGLTNARIEGKL

SEQ ID NO: 607 - protein, 627 aa, Solanum lycopersicum
MASIPSPHTARLNSLLSSSSVNHNKPSNLSFLHASSNPSSIKLLHSVSPSISSSSTTVICNVLKTVESADISLSRDLHGVVSTSKPTILVSEKLGEAGLDLLKSFGNVDCSYDLSPQDLCAKISLCDALIVRSGTKVTRDVFEAAQGRLKVVGRAGVGIDNVDLQAATEFGCLVVNAPTANTIAAAEHGIALLTSMARNVAQSDASMKAGKWLRSKYVGVSLVGKTLAIMGFGKVGSEVARRAKGLGMHVIAHDPYAPADRARAIGVDLVSFEQAISTADFISLHMPLTPATNKVFNDDTFAKMKNGVRLINVARGGVIDEDALVRALDSGIVAQAALDVFTVEPPPKDSKLVQHENVTVTPHLGASTKEAQEGVAIEIAEAVVGALNGELSATAVNAPMVPPEVLSELAPYVVLAEKVGRLAVQLVTGGSGIQSVKVVYKSARDPDSLDTRLLRAMVTKGIIEPISDTIINLVNADFSAKQKGLRISEERIIVDSSPEYPVESIQVQISNVQSRFASALSENGNISIEGRVKYGVPHLTRVGPFSVDVSLEGNLILCKQVDQPGMIGKVGNILGESNVNVSFMSVGRTVKGKQAIMAIGVDEEPDKDTQKKIGEVSAVEEFVFLKL

SEQ ID NO: 608 - protein, 140 aa, Solanum lycopersicum
MASISGTIISTSFMPRKPVVTSFKAFPAILGVKYANGGKITCMATYKVKLITPSGAVEFDCPDDVYILDQAEEEGHEIPYSCRAGSCSSCAGKIVSGSVDQSDGNFLDDEQISSGYVLTCVAYPQSDVTIETHKEEELTS

SEQ ID NO: 609 - protein, 162 aa, Brassica juncea
MTIALTIGGNGFSGLPGSSFSSASSSLRLKNSRRKNTKMLNRKGVVCSSSSVMDPYKTLRIRPDSSEYEVKQAFRQLAKKYHPDVCRGSNCGVQFQTINEAYDIVLKQIKNQMEGTEEFEPFDVYDEGFNGMNDPDCDTWEEWMGWEGAGTRDYSSHVNPYA

SEQ ID NO: 610 - protein, 378 aa, Brassica juncea
MAKMMMMQQSQPSLSLLTSSLSDFNGAKLHLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVDGLTDSYNLDFGRGTFRKEADFTTDDMILSKKLVLQ

SEQ ID NO: 611 - protein, 196 aa, Brassica juncea
MATASVNMQSVFAGGLATRKINTNKLFFAGNFPNLKRNYPVGVRCMAEGEPMKDESAPSTSAAQPLSSSSPPPPPPRPTKPKVSTKFSDLLAFSGPAPERINGRLAMVGFVAALAVELSKGENVLAQISDGGVSWFLGTTAILTLASLVPLFKGITAESKSKGFMTSDAELWNGRFAMLGLVALAFTEFVKGGTLV

SEQ ID NO: 612 - protein, 228 aa, Brassica juncea
MEEGDFFSCFSEINSGMTMNKKKMRKGTNHKRFSEEQIKSLEVIFESETRLEPRKKVQLARELGLQPRQVAIWFQNKRARWKSKQLEKEYDILRANYNNLASQFEIIKKEKQALVSELQRLNEEMQQTKEERNDECCCGQRVALSSSTWSDNGKYEPEVRLNQGIVLCNDDIKTEYFGFEEESNHELINIVEQADDSGLTSSDNWGNFNSESLLDQSSSNYPWWDFWS

SEQ ID NO: 613 - protein, 213 aa, Brassica juncea
MALEVCVKAAVGAPDALGDCPFSQRVLLTLEEKNLPYKMHLINISDKRQWFLAISPEGKVPVLKNDDKWVSDSDVITGILEEKYPEPSLKTPPEFASVGSKIFGTFVTFLKSKDSSDGSEKALLDELEALETHLKTHDGPFIAGGKVSAVDLSLAPKLYHLKVALGHYKSWSVPESLPHVHGYMKALFSLDSFEKTKTEERYVIAGWEHKVNP

SEQ ID NO: 614 - protein, 508 aa, Brassica juncea
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVSEKPWTPEPTADGKSSSVPFFGEIFGAFKELKRPMWMLLIVTALNWIAWFPFLLFDTDWMGREVYGGNSDATASDASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 615 - protein, 195 aa, Brassica juncea
MAEETKNVHEHEVPKVATEESSAAAGEVTDRGLFNFLGKKKEETKPEETIDSEFEHKVHISEPVPEVKHEEKEEEKKHSLLEKLHRSDSSSSSSSEEEGEDGEKRKKKKDKKKVTTEGEVKTEEEEKKGFMEKLKEKLPGHGKKAEDASPAPVVAPPVEEAHPAEKKGILEKIKEKLPGYHAKTVEEEKKDKDDH

SEQ ID NO: 616 - protein, 97 aa, Brassica juncea
MVKMMWGSSLALAAALLLVTVANIPVAEGVTCSPTELTSCSSAFMSASPPSATCCAKLREQKPCLCGYLRNPALSQYVNSPNAKKVASSCNVATPKC

SEQ ID NO: 617 - protein, 150 aa, Brassica juncea
MQYYETRAKEYYDVAQGQSRQSYGQNHQGYGQSQSRPVYGHSPTLNYRSHGGFLDGLFKGKNGQKGQNGLGSFIGKHKNQDTNKDHEHGKLLGQHEKKTQETNKGVNGLGMFINCGEKKLKKQNEHKKKKNKDGHASGNESGSSSGSDSD

SEQ ID NO: 618 - protein, 169 aa, Brassica juncea
MGLVTEEVRAKAEKYTGDEICREKTKVFLKEISMPNGLLPLKDIEEVGYDRESGVVWLKQKQSITHKFETIDKLVSYGTEVTAVVQTGKIKKLTGVKAKELLIWVSVSEIYTEEKEKITFKSPTTLSRTFPVSAFVVPEEVEPAKEEPAKEKSSEAAAEVKEAVAVKEA

SEQ ID NO: 619 - protein, 179 aa, Brassica juncea
MANLSTLVGCIAIIFFTVVAPASSATHSVEWSLGKDYSSLATGKPYAIGDTIVFNYGAGHTVDEVSESDYKSCTLGNSISSDSSGTTSIALKTAGSHYFICAIPGHCAGGMKLSVNVGAAASSDGGGDSGDGNTPKTTPSPTVEGRKAAPSASATAMLKPFKALVVTCVAALLYALALS

SEQ ID NO: 620 - protein, 319 aa, Brassica juncea
MGFLSKSVLVSLIALWCFTSSAFTEEVNHVTQTPSSAPAPAPYHHGHHHPHPPHPHHPHPHPPAKAPVKPPVSPPAKPPVKPPVYPPAKAPVKPPTKPPVKPPVSPPVKPPVKPPVYPPTKAPVKPPVKPPVKPPVSPPAKPPVKPPVYPPTKAPTKPPTKPSVKPPVSPPAKPPVKPPVYPPKFNRSLVAVQGTVFCKSCKYASYDSLTGAKPVEGAVVRLLCKGKKNIVAETTTDKNGYFLLLAPKTVTNFGFRGCRAYLVKSKDYKCNKVSKLFGGDVGAELRPVKTPGKSAVVINKLTYGVFNVGPFAFDPVCPK

SEQ ID NO: 621 - protein, 220 aa, Brassica juncea
MGSEGPTAVTINITGFKKFHGVAENPTEKMANNLKEYLAKNTQSKDVVLGSCTVLETAGQGALASLYQLLQSAINTKESESVTCGKTIWVHFGVNSGATKFAIEQQAVNEATFRCPDELGWKPQHLPIVPSDGPISTVRKTTLPVEEITKALEKKGFEVITSDDAGRFVCNYVYYHSLRFAEQNKTYSLFVHVPLFVAVDEETQMRFTASLLEVLTSVCK

SEQ ID NO: 622 - protein, 234 aa, Brassica juncea
MLGIFSGAIVSLPEELVAAGNRTPSPKTTGAVLVNKFVEKNPSAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVASDQVGKVPLYWGITADGYVAFADDVELLKGACGKSLASFPQGCFYSTTLGGLRSFENPKNKITAIPAKEEEIWGATFKVEGATVLAD

SEQ ID NO: 623 - protein, 143 aa, Brassica juncea
MATTSTSTGDIEKTKSVEVNKKLNVLIVDDDTVTRKLHESIIKAIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 624 - protein, 225 aa, Brassica juncea
MATNESEHENRDTEETGANEDEDTGAQVAPIVRLEEVAVTTGEEDEDAVLDLKSKLYRFDKEANQWKERGAGTVKLLKHKSTGKIRLVMRQSKTLKICANHFVKQGMSVQEHVGNEKSCVWHARDFADGELKDELFCIRFASIENCKAFMQKFNEVAESEVEKEESKDASEAAGLLEKLTVEETKTEEKTVEKVKTEVEAEEKTKSEPEKADEEKKTEEVSAHST

SEQ ID NO: 625 - protein, 79 aa, Brassica juncea
MTINKSQGQSLKQAALYLPRNVFTHGQLYVALSRVTSPEGLKILDESSDSNGADGVTNIVYKEIFEGLQGSKGKKPMWS

SEQ ID NO: 626 - protein, 237 aa, Brassica juncea
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVAFIFEKVCVILPEEVKTREVPVEEVKAEEPAKTEEPVKTEETSGEKEKEIVEETKKEEIVATSAVEEKKPEVEKEEEKKPVVEEVKKEEAAPAPAVVETPVTAPETTTPAPVAEPPKP

SEQ ID NO: 627 - protein, 78 aa, Unknown
  Sequence found in Organisms: Brassica napus, Brassica juncea, Brassica oleracea
MGGGNAQKSKMAREKNLEKARQAGKGSQLEANKKAMSIQCKVCMQTFICTTSEVKCREHAEAKHPKADVVACFPHLSK

SEQ ID NO: 628 - protein, 245 aa, Solanum lycopersicum
MAEKNGEVQEIKHQEVGHKSLLQSDALYQYILETSVYPREPESMKELREVTAKHPWNLMTTSADEGQFLNMLLKLINAKNTMEIGVYTGYSLLATALAIPEDGKILAMDINRENYEIGLPIIEKAGVSHKIDFREGPALPLLDQLLEDKNNHGTYDFIFVDADKDNYINYHKRIIELVKVGGVIGYDNTLWNGSVAAPADAPMRKYVRYYRDFVLELNKALAEDQRVEICMLPIGDGITLCRRII

SEQ ID NO: 629 - protein, 851 aa, Zea mays
MRRWWPAALLGCAVAVSVLVAAVECAVTYDKKAVLIDGQRRILFSGSIHYPRSTPDMWEGLIQKAKDGGLDVIQTYVFWNGHEPTPGNYYFEERYDLVRFIKTVQKAGLFVHLRIGPYICGEWNFGGFPVWLKYVPGISFRTDNEPFKTAMQGFTEKIVGMMKSENLFASQGGPIILSQASIIFSLDLIENEYGPEGREFGAAGQAYINWAAKMAVGLGTGVPWVMCKEEDAPDPVINACNGFYCDAFSPNKPYKPTMWTEAWSGWFTEFGGTIRQRPVEDLAFAVARFVQKGGSFINYYMYHGGTNFGRTAGGPFITTSYDYDAPIDEYGLVREPKHSHLKELHRAVKLCEQALVSVDPAITTLGTMQEARVFQSPSGCAAFLANYNSNSYAKVVFNNEQYSLPPWSISILPDCKNVVFNSATVGVQTSQMQMWGDGASSMTWERYDEEVDSLAAAPLLTTTGLLEQLNVTRDSSDYLWYITSVDISSSENFLQGGGKPLSLSVQSAGHALHVFVNGQLQGSAYGTREDRRIKYNGNANLRAGTNKIALLSVACGLPNVGVHYETWNTGVGGPVVLHGLDEGSRDLTWQTWSYQVGLKGEQMNLNSIEGSSSVEWMQGSLIAQNQQPLAWYRAYFETPSGDEPLALDMGSMGKGQIWINGQSIGRYWTAYADGDCKECSYTGTFRAPKCQSGCGQPTQRWYHVPKSWLQPTRNLLVVFEELGGDSSKIALVKRSVSSVCADVSEDHPNIKNWQIESYGEREYHRAKVHLRCARGQSISAIKFASFGTPTGTCGDFQQGDCHSANSHTVLEKKCIGLQRCVVAISPESFGGDPCPSVTKRVAVQAVCSPVA

SEQ ID NO: 630 - protein, 718 aa, Arabidopsis thaliana
MEMGRLVFGLCLILIVGTFLEFSGGATAAKGVTYDGRSLIIDGQRKLLFSGSIHYPRSTPEMWPSLIKKTKEGGIDVIQTYVFWNLHEPKLGQYDFSGRNDLVKFIKEIRSQGLYVCLRIGPFIEAEWNYGGLPFWLRDVPGMVYRTDNEPFKFHMQKFTAKIVDLMKSEGLYASQGGPIILSQIENEYANVEGAFHEKGASYIKWAGQMAVGLKTGVPWIMCKSPDAPDPVINTCNGMKCGETFPGPNSPNKPKMWTEDWTSFFQVYGKEPYIRSAEDIAFHAALFVAKNGSYINYYMYHGGTNFGRTSSSYFITGYYDQAPLDEYGLLRQPKYGHLKELHAAIKSSANPLLQGKQTILSLGPMQQAYVFEDANNGCVAFLVNNDAKASQIQFRNNAYSLSPKSIGILQNCKNLIYETAKVNVKMNTRVTTPVQVFNVPDNWNLFRETIPAFPGTSLKTNALLEHTNLTKDKTDYLWYTSSFKLDSPCTNPSIYTESSGHVVHVFVNNALAGSGHGSRDIRVVKLQAPVSLINGQNNISILSGMVGLPDSGAYMERRSYGLTKVQISCGGTKPIDLSRSQWGYSVGLLGEKVRLYQWKNLNRVKWSMNKAGLIKNRPLAWYKTTFDGPNGDGPVGLHMSSMGKGEIWVNGESIGRYWVSFLTPAGQPSQSIYHIPRAFLKPSGNLLVVFEEEGGDPLGISLNTISVVGSSQAQSQFS

SEQ ID NO: 631 - protein, 356 aa, Brassica juncea
MEVSGVVLRQIPCVSGSVTDGRYSGLRFSGNTRTTVGFRTRRFRGIMCNNEFADKGHMSYYSGTARCGGEGKDKVKVMEKEKKKDMKKKAKVLKALSKNLNMFSSIGFGLDPDAGLVAEIQNKTISEATEILVKQLDQLKAEEKLLKKQRKEEKAKAKALKMMTEMDSESSSSSESSDSDCGKGKVVDMSSLRNKPILEPLEPESSVATLPRIEEYADSCKNTGEALKLALLQSAAASTAFPSIVNPGLPLKTVEAVPVVGLPSKRIEVCMGGKCKKSGGAVLLDEFQKAMTGMEGSAVGCKCMGKCRDGPNVRVVNETEDAVMTDSVRTPSKTVCVGVGLQDVETIVTSFFGEEF

SEQ ID NO: 632 - protein, 193 aa, Unknown
  Sequence found in Organisms: Brassica napus, Brassica juncea, Brassica oleracea, Brassica rapa, Raphanus sativus
MFVIDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRYHLGLSNFTTGKGKVNLVDSNVRPLEVFMCSIVRKMGYGEGFKWLSQYIK

SEQ ID NO: 633 - protein, 166 aa, Brassica juncea
MALRMWASSTANALKLSSSTSKSHLLPAFSISRCFSSVLEGLKYATSHEWVKHDGSVATIGITDHAQDHLGEVVFVELPEEKSSVSKEKNFGAVESVKATSEILSPISGEVIEVNTKLTDSPGLINSSPYEDGWMIKVKPSNPAELETLMGSKEYTKFCEEEDAAH

SEQ ID NO: 634 - protein, 628 aa, Brassica juncea
MATKPGILTDWPWTPLGNFKYIVIAPWAVHSTYKFVTDDPVDLGYSLVLPFLLFRILHNQVWISLSRYYTTKGKRRILDKGIDFNQVDRETNWDDQILFNGLLFYIGIMLLPQAKQLPLWRTDGVLMAAMLHAGPVEFLYYWLHKALHHHFLYSRYHSHHHSSIVTEPITSVIHPFAEHIAYFILFAIPLLTTLLTKTASIASFAGYVIYIDFMNNMGHCNFELVPKRLFHLFPPLKFLCYTPSFHSLHHTQFRTNYSLFMPLYDYIYGTMDETSDTLYEKSLERGEDRVDVVHLTHLTTPESIYHLRIGLASFASHPFSYRWFMRLLWPFTSLSMLFTLFYASLFVSERNSFEKLNLQSWIIPRYNLQYLLKWRKDAINNMIEKAILEANKKGVKVLSLGLMNQGEELNRNGEVYIHKHPEMKVRVVDGSRLTAAVVINSLPKSTTKIVMTGNLTKVAYTIASALCQRGVEVLTLLPEEYEKLRSFVPQECRDRLVLLTSETLASNKVWLMGEGTTREEQEMATKGTLFIPFSQFPLKQLRRDCIYHTPPALIIPKSLVNIHSCENWLPRKAMSATRVAGILHALEGWEMHECGTSNILLSDLDQVWEACLTHGFQPLLLPHHFQYP

SEQ ID NO: 635 - protein, 256 aa, Brassica juncea
MLSLVASPPVISAASLSKPLQSLSKAALSLSKRAKPTSPFPKTARSISVYKSPMNNLFTRLGFGSRPQPDPASAAIAQGPDDDVPSPGQQFAQFGAGCFWGAELAYQRVPGVTKTEVGYSHGFVDNPSYEDVCSETTGHNEIVRVQYDPQEVSFESLLDVFWKRHDPTTLNRQGNDVGTRYRSGIYFYTDEQEKLAREAMEKQQKNLNRKIVTEILPATKFYRAENYHQQYLAKGGRMGLSQSAEKGCNDPIRCYG

SEQ ID NO: 636 - protein, 170 aa, Brassica juncea
MARFTVLIAAVILAFVVAVPEVTAKKYTVGENKFWNPNINYTIWAQGKHFYLGDWLYFVFDRNQHNILEVNKTDYENCNADHPLVNWTRGAGRDIVALNVTKHYYLLDGKGGCYGGMKLAVKVEKLPPPPKAAPVKSIGSVSMATGVAQFVIPFALFSVSTVWDAILRMW

SEQ ID NO: 637 - protein, 170 aa, Unknown
  Sequence found in Organisms: Brassica napus, Brassica juncea, Brassica rapa
MDQILNKVGSYWLGKKANKQLDSVGDDINSLSTSIEGGTKWLVNKIKGKMQKPLPELLKEFGLPVGIFPRDATNYEFNEQTRKLTVFIPTICEVGYKDSSVLRFTTTVTGFLEKGKLADVEGMKTKVMIWVKVTSISADSSKVHFTAGMKKSRSRDAYEVLRDGVEIDKF

SEQ ID NO: 638 - protein, 261 aa, Sorghum bicolor
MATTATEAAKAAPAEQANGNANGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGSFDFVFVDADKDNYLNYHDRLLKLVKLGGLIGYDNTLWNGSVVLPDDAPMRKYIRFYRDFVLVLNKALAADERVEICQLPVGDGVTLCRRVK

SEQ ID NO: 639 - protein, 399 aa, Arabidopsis thaliana
MRTLMNSAATMRAVKKEFIVIDLDADKDEDVRCGKVKEEYMMDAGKTNPSNIQQVVSAVASDDDGDDDDDWGTKMDYQYIKLLDSFREDGSLNLSDNPLRSIRYEVDNGGYDKREFKAVFTNKRSREDRNTIRVTKKNVEPKPPHVQASTEKVTKEAGFKLRRRESLVSQKSVEAMLITSHVRRNSQHNNGDASEKENFEDDIVLDEVYRSYLKRLVENSKSSRTNPEKEIKVKCEEDHTVSLSDSDSDIIVVGDCPFLEEEDSPFVPSKSYKVIDLDEESSDQRNSWFRREIMNVLKQPYTVTELKELHKEASVHGVSSRHIELRDGTEFSFPTNKKKPSYLDRYPDFKKQYLDSLREKDERKALNLLRGFIFYITNVVRDDAFKPWLDQECLKIRCV

SEQ ID NO: 640 - protein, 167 aa, Arabidopsis thaliana
MATKEPESVYELSIEDAKGNNLALSQYKDKVLLIVNVASKCGMTNSNYTELNELYNRYKDKGLEILAFPCNQFGDEEPGTNDQITDFVCTRFKSEFPIFNKIEVNGENASPLYKFLKKGKWGIFGDDIQWNFAKFLVDKNGQAVQRYYPTTSPLTLEHDIKNLLNIS

SEQ ID NO: 641 - protein, 183 aa, Arabidopsis thaliana
MASKKVDGEGKGKAIANTRMLRSMDRKTRSDTKRDGSSSKLMKIESPEKKKRKTTKAKNVGAAKKKVKKEEVAVKIEKEEEEDDDAAEKEEDDDSDKKKIVIEHCKQCKSFKERANEVKEGLEEAVPGIIVTVNPDKPRRGCFEIREEGGETFISLLAMKRPFTPMKELNMEEVIADIVEKIK

SEQ ID NO: 642 - protein, 206 aa, Arabidopsis thaliana
MPRSSRWVNQRATSKIKKFILFLGVAFVFYLYRYPSSPSTVEQSSTSIYNISVKDIEGKDVSLSKFTGKVLLIVNVASKCGLTHGNYKEMNILYAKYKTQGFEILAFPCNQFGSQEPGSNMEIKETVCNIFKAEFPIFDKIEVNGKNTCPLYNFLKEQKGGLFGDAIKWNFAKFLVDRQGNVVDRYAPTTSPLEIEKDIVKLLASA

SEQ ID NO: 643 - protein, 549 aa, Arabidopsis thaliana
MVGMSMQPYGIQSMLKEGYRHLSGLDEAVIKNIEACKELSTITRTSLGPNGMNKMVINHLDKLFVTNDAATIVNELEIQHPAAKLLVLAAKAQQEEIGDGANLTISFAGELLQNAEELIRMGLHPSEIISGYTKAVSKAVEILEQLVETGSETMDVRNKDEVISRMRAAVASKQFGQEEIICSLVTDACIQVCPKNPTNFNVDNVRVSKLLGGGLHNSCIVRGMVLKSDAVGSIKRMEKAKVAVFAGGVDTTATETKGTVLIHSAEQLENYAKTEEAKVEELIKAVAESGAKVIVSGGSIGEMALHFCERYKIMVLKISSKFELRRFCRTAGAVAHLKLSRPSPEDLGYVDSISVEEIGGVTVTIARNEEGGNSISTVVLRGSTDSILDDLERAVDDGVNTYKAMCRDSRIVPGAAATEIELAQRLKEYANAEIGLDKYAITKYAESFEFVPKTLADNAGLNAMEIIAALYTGHGSGNTKLGIDLEEGACKDVSETKVWDLFATKLFALKYASDAACTVLRVDQIIMAKPAGGPRRDAAQAAGAGAEED

SEQ ID NO: 644 - protein, 200 aa, Arabidopsis thaliana
MAIDKLPLLLFLSILLCLNRPVLSDTDEEDILLTGINSYRTTQNLTILSKNENAECLADEIADQFKNKPCTNDTGSATVPGTEPQFANYPQILAKCHLNVSDTRDGSIMPACVPRLESNLVLTNFTKSQYSMSLNDSKFTGIGIGKEDDWIVVVLTTNTPEGSYSTATPTKQESNGFTFGIGLVSYLVIFMYSSFCFFLF

SEQ ID NO: 645 - protein, 463 aa, Arabidopsis thaliana
MNPSHGGDDKQRPAMYPQVDQSIPDNPFASTNPYVASSPYLYPSLSSHNLGPNLFPDHGDASNDQSPSAPPQATEEVLIRVPGAILNLIDKSYSVELACGDFTIVRIIQGQNIVAVLANVGNEIQWPLTKNEVAAKVDGSHYFFSIHPPKEKGQGSGSDSDDEQGQKSKSKSDDEILNYGLTIASKGQENVLLVLDQVLRDYSCFTEQRMSEKAKETGEEVLGNSVVADTSPEELKGERKDVVEGQCAAYWTTLAPNVEDYTHSTAKMIASGSGKLIRGILWCGDVTVERLKKGNEVMKNRLSRAEKEKDVSPETLRRIKRVKRVTQMTEKVATGVLSGVVKVSGFITGSMANSKAGKKLFGLLPGEIVLASLDGFSKICDAVEVAGKNVMSTSSTVTTELVNHRYGTKAAEATNEGLDAAGHAFGTAWVAFKIRKAFNPKNVIKPSSLAKSVSELKAKKGSK

SEQ ID NO: 646 - protein, 178 aa, Arabidopsis thaliana
MEKSGGRIVMDEIRSFEKAHLFDLGHPLLNRIADSFVKAAGVGALQAVSREAYFTVVDGAGFDSNNVGPPSEITGNKKHRFPNLRGESSKSLDALVKNTGKESLQWGLAAGLYSGITYGMTEVRGGAHDWRNSAVAGALTGAAMAMTTSERTSHEQVVQSALTGAAISTAANLLSSVF

SEQ ID NO: 647 - protein, 444 aa, Arabidopsis thaliana
MKFLMQSISGRNRSLVRALVSRRYFASSPEEIAKRNYANDLSEYNTAVNSVTAQRRHYLLRDVYDDMKLDGVQPTADIFHSFVVGTMKGARLSDAFFFREEMKAMGIAPDVNLYNFLISTCGKCKNGKEAIRVYDEMKRYDVKPNGQTFVCLLNACAVSGQLDLVYAIVRDMTAAGVGLNQFCYAGLITAHLNKQPRPDNLSTKILEFVEQSKGWSAIDSSRKSAEDVMFSISEEELYNIPTADYSHRTRFLQRNLTVYHVAFSALADLKDVKATEALLEMLKKDGKDTDTYCMLQIMRCYLHSQDFENGLKLFQDYMSADKIPAMELYTTLIEGAMTGYTDNGMKIAQDTLIQMNERNFFLDPRTGSNLLLKAAGEKTGGYTVANMIWDLMLARNILPTLAAVEAYYKGLKEREIPEDDPRLMLVTRTYNNLRLREGTLPNRR

SEQ ID NO: 648 - protein, 448 aa, Arabidopsis thaliana
MECSATPPKLYPTVDTSTTVAPLPKSSSSSSSTNNNNLYPSINVNDLVNNIFPDPTASDSASAPPLATEEVILTIHGAMVHLIDKSYSVELACGDLEILRLVQGDITVAVFARVGDEIQWPLTKDEPAVKVDESHYFFSLRPVKESESSDHSVNETENEMLNYGLTMASKGQEPMLEKLDKILADYSSFTAEEKQKEENVLDLTAAKETSPEELKGKRKKMVEKQCTAYWTTLAPNVEDYSGVAAKLIAAGSGQLIKGILWCGDLTMDRLMWGNDFMKKKLSKAEKERQVSPGTLKRLKRVKKMTKMTEKVANGVLSGVVKVSGFFSSSVINSKAGQKLFGLLPGEMVLATLDGFNKVCDAVEVAGRHVMKTTSDVTTEIVDHKYGAKTAQATNEGLSAAGHAFGTAWTVFKIRQALNPKSAMKPSSLAKTVVKTAAKERKKGKKSSK

SEQ ID NO: 649 - protein, 272 aa, Arabidopsis thaliana
MTGSQEDQPKIIIDQEQPKTLETEHQPEPSSSSPDQKKWGTHVMGAPAAPVAHPDNQQAAAWVAGDNQQTQYQPYVIYSPVEHPTTNNPLEPVIGMFHTWSRKAETVARNLWHNLKTGPSMSETAWGKVNLTAKAITKGGFESLFRQIFGTEPNETLKKTFACYLSTTTGPVAGTVYLSNARVAFCSDRPLYFTAPSGQESWSYYRVVVPLANVATVNPVVVKETPPEKYIQLTTVDGHDFWFMGFVNYEKATHHLLTSVSDFQTAHGSVSG

SEQ ID NO: 650 - protein, 186 aa, Arabidopsis thaliana
MTEKKEMEVVKGLNVERYMGRWYEIASFPSRFQPKNGVDTRATYTLNPDGTIHVLNETWSNGKRGFIEGSAYKADPKSDEAKLKVKFYVPPFLPIIPVTGDYWVLYIDPDYQHALIGQPSRSYLWILSRTAQMEEETYKQLVEKAVEEGYDISKLHKTPQSDTPPESNTAPEDSKGVWWFKSLFGK

SEQ ID NO: 651 - protein, 245 aa, Hordeum vulgare
MKGGDIEAGYADAAASKGAALYPGATESPELRWALIRKIYVILSLQLLLTAVVAVVVVRVRAIPRFFVSSYAGLGLYVFLLILPFIVLCPLSIYRQKHPVNLLLLGVFTVAISFSVGLTCAFNSGKVILEAGILTVVVVLSLTVYTFWAAKRGKDFSFLGPFLFASLSMLLVFGLIQIFFPLGKLSHTIYGALAALIFSGYIVYDTDNIIKRYTYDEYVWAAVSLYLDVINLFLALLTLFRAADS

SEQ ID NO: 652 - protein, 171 aa, Sorghum bicolor
MGAAESVPETSIHEFTVKDCNGKEVSLETYKGKVLLVVNVASKCGFTEVNYTQLTELYRKYRDKDFEILAFPCNQFLRQEPGSNQQIKDFACTRFKAEYPVFQKVRVNGPDAAPVYKFLKASKPGLFGSARVKWNFTKFLVDKNGKVVERYGTSTAPMSIEKDIQKALDEE

SEQ ID NO: 653 - protein, 248 aa, Sorghum bicolor
MFGYQKGVDVEAGTSAATGGGARQLYPGMQESPELRWALIRKIYVILSLQLLLTAVVAAVVVKVRAIPHFFTTTNAGLGLYIFLIILPFIVLCPLYFYHEKHPVNLILLGLFTVAISFSVGLTCAFTSGKVILESAILTTVVVLSLTAYTFWAVNRGKDFSFLGPFLFASLIVLLVFALIQILFPLGKLSQMIYGGLASLIFSGYIVYDTNNIIRRFTYDQYVWAAVSLYLDVINLFLSLMTLFRAAD

SEQ ID NO: 654 - protein, 250 aa, Sorghum bicolor
MYFRPPPKGPEWYAGDAETGQAARPLYPMMLEDPRLRWSFIRKVYSILSIQMLLTVAVAAVVVYVRPIALFFVSTPGGFGLYIFLIILPFIVLCPLYYYYQHHPVNLLLLGLFTVAISFAVGLTCAFTKGEVILESAILTAVVVLSLTAYTFWAAKRGHDFNFLGPFLFAAVMILMLFALIQLFFPLGRISLMIYGGLAALVFCGYIIYDTDNLIKRYSYDEYVWAAVALYLDVINLFLSLLTLFRAADS

SEQ ID NO: 655 - protein, 278 aa, Sorghum bicolor
MEGKDGKHDVPATTAAPPPAGAPQPAAPAPPAESARWGTRQMGPPAAPGAHPENQEAARWTAARGDQELPPYVVMGEPVAVQRGKGDSPMEHILDFFNTWSRKAEELASNIWFNLKTAPSMSDAAMGKLSLGAKALSEGGFDKLYKQTFSSSPEEHLKKTFACYLSTATGPVAGTLYLTNMNVAFCSDRPLSFTAPSGQTAWSYYKVIIPLGKIATVEPVTMKENPPEKYVHIVTVDSHDFWFMGFVSYDKAVHNLVEAVSQRSQSQHGAGVTAAGTK

SEQ ID NO: 656 - protein, 486 aa, Sorghum bicolor
MASASSNAKQSLYPDVDQSHPDLNTPFFAPTTSTGAGTTAVGSSLYPTVDPNELAENLFPETAEEDAAPPPPTTEETVVAVPGAQLHLVDPDRSLDLGAGTLSIVRLRQGDHSVAVLARLIPEKPHQRRGLFRLFSSGRSDGGAEQEPVQWPLTRDVAAVKLDPAHYFFSLHVPHTDHPDDKDDAEDAEADAEAALSYGLTVVGKGQDKVLEELDRVLEEYTTFSVKQVEAAAKEKSEVMDARAVAEITPEEAVGDKKEVVEEKSAAFWTTIAPNVDDYSSSVARLIARGSGQLVRGIIWCGDITAEGLRRGEEVVKKSVGPSAKPTQVKPSTLRRMKRARRVTKMSNRVANSILSGVLKVTGFVTSTVLNSKPAQKFFKLMPGEVILASLDGFGKVWDAVEVSGKNVMQTSSVVTTSVVTHRYGEQAGEATHNYLHATGNALGAAWAVFKIRKALDPKGNLKKSSFVSQAAHTVAKESIARQKKK

SEQ ID NO: 657 - protein, 453 aa, Solanum lycopersicum
MASKNPNSSSMYPQVAVVDQNVPFPSSTSRQNLYPTIDMNDLVENLFPQNDQTAPERQHYSPSAPPEILEETLLVIPGSILHLIDKHYSVELAIGDLFLHRLRQGNNIVAVLVRVGNEIQWPLTKDLAAVKLDDSHYFFSFQAPKDDESDKESSVSDLANDSLNYGLTIASKGQEKLLKELDDILENYSNFAVQKVEEKAAVALGGPVAKELSPADLKSEKKKEVLEERCAAYWTTLAPNVEEYNATAAKLVASGSGHLIKGILWCGDVTADRLKWGNEVLKNRFKTGSKTEVSPETLKRIKRVKRVTKMTEKVAVGVLSGAVKVSGFFTRSLANTKAGKKFFSLLPGEMVLATLDGFSRICDAVEVAGKNVMSTSGTVTTEFVSHRYGEEAANATSEGLDAAGHAFGTAWAAFKIRKALNPKSALKPTALAKSAAKAAATAAAADKKAKSSK

SEQ ID NO: 658 - protein, 443 aa, Solanum lycopersicum
MASQNPSPPKLYPEVIDSNPESSSPFITNTQKNKSSSSMYPTIDMKDLAENLFPETENSQPNQNSNFVSLEEVIVQIPGAIVHLIDKERSIELASGEFEIVQLKQGDNVVAVLARVGDQIQWPLARDEAAVKLDESHYFFTLRVPSEANDEDGYAENLLNYGLTIASKGQERLLKELDLVLEKYSAFRVEKVKKDKGVAEKWWMAPKDVSPEEMEKKKEDVERSSAAYWTTLAPNVEDYSSSIARMIAAGSGQLIKGILWCGDITVDRLKWGNDVLMKRMGKGSNSEISPEAMRRMRRVKKMTKMSEKVATGILSGVVKVSGFFTSSIANSKAGQRFFSLLPGEIVLASLDGFNKVCDAVEVAGKNVMSTTSVVTTGLVQQRHGDQAAQMTREGFDAAGHALGTAWAVFKIRKALNPKGAIKPTTVAKAAAQANLAKLKSKQK

SEQ ID NO: 659 - protein, 170 aa, Solanum lycopersicum
MAGQPEKKPESVYDFTLKDAKGNDVDLSTYKGKVLLIVNVASKCGLTDSNYKDLNHLHEKYKDQGLEILAFPCNQFGAQEPGSNDEIVEFACTRFKSEFPIFDKIEVNGENTSPLYKFLKSAKWGLLGDNIQWNFAKFLVDKNGQVSDRYYPTTSPLSMERDIKVLLEIE

SEQ ID NO: 660 - protein, 239 aa, Solanum lycopersicum
MLCSTARVLLIPKQNLSILRRFSSILRQTQFNSVFNLPVSSFSKPIRTVLPNSLVTSKGFELWGLRSDHTMASQSSNPQSVYDFTVKDAKGKDVDLSIYKGKVLIIVNVASQCGLTNSNYTDMTELYKKYKDQGLEILAFPCNQFGGQEPGNIEDIQQMVCTRFKAEYPIFDKVDVNGDNAAPLYRFLKSSKGGFFGDGIKWNFSKFLIDKEGHVVDRYSPTTSPASMEKDIKKLLGVA

SEQ ID NO: 661 - protein, 242 aa, Solanum lycopersicum
MWNEAYRKDDVEFGTAPLYPAMLESPELRWSFIRKVYSIISIQLLLTIAVASVVVTVHPISHFFAATNAGLALYIVLIITPFITLCPLYYYHQKHPVNYLLLGLFTVSLAFTIGLTCAFTSGKVILEAVILTTAVVISLTLYTFWAAKRGQDFNFLGPFLFGALIVLLLFSFIQILFPLGKISVMIYGCLASIIFCGYIVYDTDNLIKRYTYDEYIWAAICLYLDVINLFLSLLSIFRAADN

SEQ ID NO: 662 - protein, 169 aa, Hordeum vulgare
MAAAGDAGEKRMVTLKSSDGEEFEVEEAVAVESQTIRHLIEDDCADNGIPLPNVNSKILSKVIEYCNKHVQAKPADAAGAGASDAPPPADDLKNWDAEFVKVDQATLFDLILAANFLNIKGLLDLTCQTVADMIKGKTPEEIRKTFNIKNDFTPDEEEEIRRENQWAFE

SEQ ID NO: 663 - protein, 234 aa, Hordeum vulgare
MDSTADSKGKRPLFQPDDVSAAASVPDEAEAEPSSSSEEVKETEPGAQKQQEEKPALVLVAEDGVEVRISEPAARMSQMLRHMMEDGCADGRIPTANIHSDILEMVVEYCEKHGPYYDPEASERDRYPFPPFPVELTPTVSSIKPVTYVDPDPHGLKDWDSDFISLDNSTLFEIILAANYLNIEDLLDLGTSAVADKMRGRKPEEIREIFEIENDYTPEQEAEVRKENAWAFED

SEQ ID NO: 664 - protein, 165 aa, Arabidopsis thaliana
MEELVGLLRIRVKRGINLAQRDTLSSDPFVVITMGSQKLKTRVVENNCNPEWNEELTLALRHPDEPVNLIVYDKDTFTSHDKMGDAKIDIKPFLEVHKMGLQELPDGTEIKRVVPNRENCLAEASSIVSNNGKIVQNMILLLRNVECGEVEIQLEWIDIPGSRGL

SEQ ID NO: 665 - protein, 192 aa, Arabidopsis thaliana
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMELVGESEKLRMIKLEELSKSIETV

SEQ ID NO: 666 - protein, 435 aa, Arabidopsis thaliana
MSVTAGVSESAIAVREKLKGGIGQTKVRRYWPGKAPEWAEEAEEDDDVRMQKVSVLDRAFPKNDDLGVARKDDPRLRRLAKTKVENRDEVRADHRRIRQAEIIYTEEEESRNQENRDEDDDEDALEERRRRIREKNLRRAQEEAALLPLEEEDEIQEEEEEEEESEYETDSEDDMPGIAMIKPVFVPKAERDTIAERERLEAEEEALEELAKRKLEQRKLETKQIVVEEVRKDEEIRKNILLEEANIGDVETDDELNEAEEYEVWKTREIGRIKRERDAREAMLREREEIEKLRNMTEQERRDWERKNPKPLSAQPKKKWNFMQKYYHKGAFFQADPDDEAGSAGTDGIFQRDFSAPTGEDRLDKSILPKVMQVKHFGRSGRTKWTHLVNEDTTDWSNPWTSNDPLREKYNKKMAGMDAPIAKPKGSKKMKDWES

SEQ ID NO: 667 - protein, 499 aa, Brassica juncea
MAFTPLFSLLSVITLSLLITTDASSRSLLPSHETTVLDVVSSLQQTQHILSLDPTLTSLTTTTSIPGSDPVFLNSSSPLSLELHSRDTLVASQHKDYKSLVLSRLERDSSRVAGITAKIRFAVEGIDRSDLKPVYNDETSYQPEDLTTPVVSGASQGSGEYFSRIGVGTPAKEMFMVLDTGSDINWIQCQPCSDCYQQSDPVFDPASSSTFKSLSCSAPQCGSLEVSACRSDKCLYQVSYGDGSFTVGDYATDTVTFGTNGKVNDVALGCGHDNEGLFTGAAGLLGLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKTLNLPAKNYLIPIDDAGTFCFAFAPTSSPLSIIGNVQQQGTRITYDLANHLIGLSANKC

SEQ ID NO: 668 - protein, 239 aa, Brassica juncea
MASYYRFQSGFCPLSPCPSLLLGNFVERIKDACHFLVSAVLGTIISAVLTFFFSLVGTLLGALTGALIGQETESGFIRGAAIGAITGAVFSIEVFESSLDLWKSDESCFGCLLYLIDVIVSLLSGRLVRERIGPAMLSAVQSQMGALDAPYDDLSSLFETGGAKGLTGDLVEKIPKLTITDNNNTDASENRESCSVCLQDFQLGETVRSLPHCHHMFHLPCIDKWLLRHGSCPMCRHDL

SEQ ID NO: 669 - protein, 125 aa, Brassica juncea
MAGRLSGVASRIMGGNGVVARSAASSLRQRAGMGLPVGKHIVPDKPLSVNDELMWDNGTAFPEPCIDRIADTVGKYEALGWLCGGLGFFATLGMLAVVNDKASKVPFTPRVYPYDNLRVELGGEP

SEQ ID NO: 670 - protein, 389 aa, Brassica juncea
MANGGGRVDLDGKPIKPITICMIGAGGFIGSHLCEKLMTETPHKVLALDVYNDKIKHLLEPDTVEWKDRIQFHRINIKHDSRLEGLVKMADLTINLAAICTPADYNTRPLDTIYSNFIDALPVVKYCSENNKRLIHFSTCEIYGKTIGSFLPKDHPLREDPSFYVLKEDVSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGEGAIETPTVDVSSKEFYGEGYDDSDKRIPDMTIINRQLGWNPKTSLWDLLESTLTYQHRTYAEAVKKATSKPVAS

SEQ ID NO: 671 - protein, 388 aa, Brassica juncea
MADNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDYTSPTFASSMQNSVPAITFLMAALLRIEKVRLNRRDGISKVLGTALCVAGASVITLYKGPTIYTPTSHLHAHLLTTNSAVSAVLAPLGDAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRGSITTPLLHQSTNNV

SEQ ID NO: 672 - protein, 496 aa, Brassica juncea
MAMIGLLEVFAAFLFFLVFKHFFLHKKSPGQPIIKSWPVLGMLPGMLPHIPRIFEWTFEVLEATNLTFFFKGPWLSGTDMLFTADPRNIHHILSLISGNYPKGPEFKKIFDVLGDGILSVDLELWEDLRKSNHAISHHPDFLKLSASSNTLKLKEGLVPFLDNAAHENIVIDLQDVFKRFMFDTSSISLTGFDPMSLSTEMPEVEYGEAAETGEEAIYYRHFKPVILWRLQNWLGIGLERKMRSSLVTVNRMFAKIISTRREEIRRGEGVQSMDALTYYMHVDTTKYKLLKPSDDTFIRDVAFSLVLAGRDTTSSVLTWFFWLLSKHPHVMTKIRQEINTKFDPTDLEKLVYLHATLNETMRLYPPVPFNHKSPLKSDVLPSGHKVKAESKIVICIYALGRMRSIWGEDALDFKPERWISKGGELKHEPSYKFMAFNAGPRACLGKHLALSQMKMVAVELIQNYDFKVTEGHKIEAVPSIVLRMKNGLSVTVTKKM

SEQ ID NO: 673 - protein, 349 aa, Brassica juncea
MSYEKELAAAKKAVSLASHLSQGVQRTLLQSEVWTKSNKTPVTAADYGSQAVVSIVLERELKPVTLSLVAEEVDTGDLRKKGSEVFLEGITKLVRDALASDESYADSTITTEDVLNAIDCGQSQGGSNGCHWVLDPIDGTRGFVRGEQYAVGLALLVEGKVVVGVMACPNLPLSSAVVERDDKSCQDNVGCLFFATTGSGAYVQPLNGNSPPHEVRVSSNENLEEAKFLESYHMPIPLHSSIAKKLGITALPVRIDSQAKYAAVSRGDAEMYLRFTLVGYREWIWDHAAGSIITTEAGGVVCDAEGTPLDFSKGKRLDHNRGIIVTTKKLKPLILKAVRESMEEENLRV

SEQ ID NO: 674 - protein, 1077 aa, Brassica juncea
MLRTASCSASLTSASPFFRHFPLSYSSLSSSTGALRAPGRNLRRVASPASTGRRVFLRRGLRVPSTAGRGVNRQLSRLSVRAVATQPAPSYPDVGQDEAEKLGFEKVSEEFISECKSKATLFKHKKTGCEVMSVSNEDENKVFGIVLRTPPKDSTGIPHILEHSVLCGSRKYPLKEPFVELLKGSLHTFLNAFTYPDRTCYPVASTNTKDFYNLVDVYLDAVFFPKCVDDVHTFQQEGWHYELNDPSEDISYKGVVFNEMRGVYSQPDIILGRIAQQAISPDNTYGVDSGGDPKDIPNLTFEEFKEFHRKYYHPSNARIWFYGDDDPLQRLRILSEYLDMFEASPSRDTSKIETQKLFSEPIRIVEKYPAGRDGDLKKKNMVCINWLLSEKPLDLETQLALGFLDHLMLGTPASPLRKILLESGLGEALVSSGMSDELLQPQFSVGMKGVSEDNVQKVEELIMSTLKKLAEEGFESDAVEASMNTIEFSLRENNTGSFPRGLSLMLQSIAKWIYDMDPFEPLKYTEPLKALKARIAEEGSKAVFSPLIEQFILNNSHRVTIEMQPDPEKASQEEAEEKSILEKVKAGMTEEDLAELARATEELRLKQETPDPPEALRCVPNLNLSDIPKEPTYVPTEVGDINGVKVLRHDLFTNDIVYAEVVFDMGSPKHELLPLVPLFCQSLLEMGTKDLSFVQLNQLIGRKTGGISVYPLTSSVRGKDEPCSKIIVRGKSMAGRADDLFNLMNCLLQEVQFTDHQRFKQFVSQSIARMENRLRGSGHGVAAARMDAMLNIAGWMSEQMGGLSYLEFLRTLEKKVDEDWEGISSSLEEIRRSLLAKNGCIVNMTADGKSLTNIEKSLEKFLDLLPENPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVDSYQLPDAKGYSSLMRHLLGVTDEERLRKREEILTTSLKDFKDFAEAIDVVRDNGVAVAVASAEDIDAANNARSNFFEVKKAL

SEQ ID NO: 675 - protein, 1032 aa, Brassica juncea
MKETRISSRKRRADRGEDRRKDKEKEQAGGGVVNERLPLRLFATDRYPSKRHNCNSSLEYLLLVRDVLEGTDEMEQMMVSRFGHLFRLPLRRCAFSGKLVHGMLTRQLVTKKRFELWPVFGGMPTRFSLAEFGHVTGLPCGEFEAGYVVDDQTRPKKSDYAYWDILFGGKRDVTIADVAAMVASDKEMPASRKLKLCLIIIVDGVLLATTQYPKPTVKHVKRLANLRSFLSFPWGRESFWWTISSMLPPPRVMGRCDDPEGEFCRKLRQKTLSLAGFPLALQLWAFEAIPGLVKRLGGTISRILLSYAGEKLPQHTGLSLSAVLDAEFDPELSVQPMVEVAEDKEEGWGEFDCEINDRKVVYMVEQLKTGHRFEKWAWGGGDSGEPEYVHEVVEKEKEKKRKTRHPGNKEVEAPVLKQRRLSRYFNRKGDGDGGRLAALEVKMEEMSGVVADLKKIVARQGRMLRKRRTLDRKTGKFSRSMLSRQRKSQRNVATGQRRLFDESDAKDSEEEGALDKETDFGGNDSEPEGMKESAIVPLKVAKRGDATKDGHQVYFGSSSNTFYVTEDKDGDVSGDIGIEGAAAACGTYVDLGGLDQLVGAIVHGAEAEGKGGESKGADVEDKCRGQNVPEVEKEKDGKRQTVGDGAAKEDAVNREEGERERKIGEVEEKEMVAGKKDGSVDKKGEDDEGEAGREDVAAKGERGSPEQQVPATEADDYSRDDEHGLDAADEVMELSDSSPCKRSAKHEPAEREGDLASLLLAKESFTLDKIVPETEDGDFPFFERVLLANPKVLHLNAGEYDLENHFFLDLATAEKWVSTKHMEVLVDYVASRHEERLKERRSLFLPPWFAAHLQGKSRRFNAARANKGKVLVDGRLTGLLTKEGKRWGHEVDRLYAPMIWDENHWVGLCISLVDWRVLVLDPNPGLRDMSAVGILMDPVLKMLPYLVEKVCPPPAEGAYKLDPFNCERMGGVYENTRSGDCGPVSIKFMELHAVGNPHPGMEGLSDALVDIMRKQFAMDVYKDWVVPLYIGG

SEQ ID NO: 676 - protein, 483 aa, Brassica juncea
MGKKKFIDKKKAATFELCPRDTSDPLYSDAPGGDKIFLRVDQNPVNINGFTEEGDNSQFDDAPEEEEDLAYGYSSFVGSSSNNPLPADVRKEILELGYPDDGYNYLDHLREIKNTGGGSNFYANPKFEGEYLPRDVKAYDASRVKVSGVVVDGDGGEDDKLMYSVASKTVNVKVKKAIDPEVAALLEDSDGSEFGSDVEDLEEDFVVRANLAEEGEGCSGVSHEEEFARPPVAAENNPRVPRQIDELFDQLELNEYGSESDYDGEEGEEFKAQSVGDLIYEKPKDYELDEKYMNPADLLKNSDSVKDKEELEYIIRRSVQYGENLVNSNEDEFVEVVEESSDESEKWDCETIVTTYSNLDNHPGLICDPDRARKKLSEALAKAKSLNGGGSRIITLQGKEKLPVEFLPGRRAEQTSVKPKAEPVKRKTHGQETKEEKKERKAAVKTEKREARKMKKETKELYRYETQRAQKAVAVSGPSSIPL

SEQ ID NO: 677 - protein, 413 aa, Brassica juncea
ISGLCLPKSLKPLLPVFLQGLISGSAELREQAALGLGELIEVTSEEALKEFVIPITGPLIRIIGDRFPWQVKSAILATLIILIQRGGMALKPFLPQLQTTFVKCLQDSTRTIRSSAALALGKLSALSTRIDPLVGDLTTSFVAADSGVREAILSAMRGVIKHAGKSIGPAVRIRIFDLIKELMHNDDDQVRIFATSMLGVLSQYLEAAQVSVLLQEIISLSTSPKWSSRHGSVLCIASLLKHNPSTIMTSPLFSAVLNSLKSSLKDEKFPLRETSTKALGRLLLHQLEMEPSSTARVVIDILSSIVSALHDDSSEVRRRALSSLKAFAKNNPAATIANVSVIGPPLAECLKDGSTPVRLAAERCAMHVFQLTKGAENVQAAQKYITGLDARRLSKLPEQSDDSDDSEDDNGRG

SEQ ID NO: 678 - protein, 359 aa, Brassica juncea
MAEHHHRIRVYLASAILLLAVINTGIAAENLSQQKLTSRILQNEIVKEVNENPNAGWIAAFNDRFANSTVAEFKRLLGVKPTPKNEFLGVPVVSHDIDISLKLPKEFDARTAWSQCSSIGRILDQGHCGSCWAFGAVESLSDRFCIKYNMNISLSVNDLLACCGFLCGQGCNGGYPISAWRYFKHHGVVTEECDPYFDNTGCSHPGCEPAYPTPKCVRKCVSGNQLWRESEHYGVSAYKVRHGPQDIMAEVYKNGPVEVAFTVYEDFAHYKSGVYKHITGANIGGHAVKLIGWGTSDDGEDYWLLANQWNRSWGDDGYFKIKRGTNECGIEHGVVAGLPSDRNVFNGINTSDDVLVSSF

SEQ ID NO: 679 - protein, 656 aa, Brassica juncea
MKSFAAKVEDGVRGENGKPSVGPVYRNLLSEKGFPPIDSDITTAWDIFSKSVKKFPDNKMLGWRRIVDEKVGPYMWKTYKEAYEEVLQIGSALRTLGAEPGCRVGIYGVNCPQWIIAMEACAAHTLICVPLYDTLGSGAVDYIVDHAEIDFVFVQETKIKGTAKCARRLKAIVSFTNVSEEHNLKASEVGVKTYSSFDFLQMGCEKLEETTPPKPFNICTIMYTSGTSGDPKGVVLTHEAVATYIVGMDLFMDQFEDKMTDEDVYLSFLPLAHILDRMNEEYFFRKGASIGYYHGDLNVLRDDIQELKPTYLAGVPRVFERIHEGIQKALQELNPRRRFIFNALYKHKLAWLNRGYSHSKASPMADFIAFRKIRDKLGGRIRLLVSGGAPLSTEIEEFLRVTCCCFVVQGYGLTETLGGTAMGFPDEMCMLGTVGIPAVYNEIRLEEVAEMGYDPLGENPAGEICIRGKCLFSGYYKNPELTQEVMKDGWFHTGDIGEIQSNGVLKIIDRKKNLIKLSQGEYVALENLENIYGQNSLVQDMWVYGDSFKSMLVAVIVPNQETVKRWAKELGFTKPFEELCSLSELQEHIISELKSTAEKNKLRKFEYIKAVTVETKPFDVARDLVTATLKNRRNNLLKYYQVQIDEMYKKLASKKI

SEQ ID NO: 680 - protein, 739 aa, Brassica juncea
MGTSVQVSPLCGVYNENPLAYLVSIDGFNFLLDCGWNDLFDPSLLEPLSRVASTVDAVLLSHPDTLHLGALPYAMKQLGLSAPVYATEPVHRLGLLTMYDQYLSRKQVSDFDLFTLDDIDSAFQNVIRLTYSQNFHLSGKGEGIVIAPHVAGHMLGGSIWKITKDGEEVVYAVDYNHRKERHLNGTVLQSFVRPAVLITDAYNALYTNQTQSHHRDTEFLDTISKHLEVGGNVLLPVDTAGRVLELLLILEQHWSQRAFSFPIYFLTYVSSSTIDYVKSFLEWMSDSISKSFETSRDNAFLLRHVTLLINKTDLDNAPPGPKVVLASMASLEAGFARDIFVEWANDPRNLVLFTETGQFGTLARMLQAAPPPKFVKVTMSKRVPLAGEELIAYEEEQNRLKREEALRASLVKEDETKASHGPDDNSSEPMVIDTKTTHDVVGSHGPAYKDILIDGFVPPSSSIAPMFPFYDSTADWDEYGEVINPDDYVIKDEDMDRGAMHAGGDVDGRLDEATASLMLDTRPSKVISNELIVTVSCSLVKIDYEGRSDGRSIKSTIAHVSPLKLVLVHATAEATEHLKQHCLNSICPHVYAPKIEETIDVTSDLCAYKVQLSEKLMSNVIFKKLGDSEVAWVDSEVGKTESEKRCLQPMASAAAPHKPVLVGDLKMQDFKQFLSSKGVQVEFAGGGALRCGEYVTLRKVGPTGQKGGASGPQQILIEGPLCEDYYKIRDYLYSQFYLL

SEQ ID NO: 681 - protein, 70 aa, Brassica juncea
MTRGSQRERDRERAQARAGGKGKTKDDGLTPEQRRERDAKALQEKAAKKAAQAAGAATSGGGGKGNNNKK

SEQ ID NO: 682 - protein, 704 aa, Brassica juncea
MATCPPFDFSAKYYNGGGSGCERRSSFFGDTTVLDQGVGYAVILGFGAFFAVFTSVLVWLEKRYVGAQHTSEWFNTAGRNVKTGLIASVIVSQWTWAATILQSSNVAWQYGVGGPFWYASGATIQVLLFGVMAIEIKRKAPNAHTVCEIVKARWGTATHIVFLVFCLATNVVVTAMLLLGGSAVVNALTGVNIYAASFLIPLGVIVYTLAGGLKATFLASYVHSVIVHVVLVVFVFLVYTSSSELGSPSVVYDRLRDMAAKSRICTEPLSHHDQAFGPVDGNYKGSYLTMLSSGGAVFDIINIVGNFGTVFVDNGYWVSAIAARPSSTHEGYLLGGLVWFAVLFSLATSLGLGALALDLPISADEANRGLVPPATAIALMGKSGSLLLLTMLFMAVTSAGSSELIAVSSLFTYDIYRTYINPRATGKQILKVSRSAVLGFGCFMGILAVILNKAGVSLGWMYLAMGVLIGSAVIPIAFMLLWSKANAFGAILGSISGCVLGIVTWLSTAKIQYGRVDLDTTGRNAPMLAGNLVAILTGGLIHAVCSLVQPQNYDWSTTREIKVVEAEAPGDDIDVPVEELKEEKLRRAKAWIVKWGLVFTLLIVVIWPVLSLPARVFSRGYFWFWAIVAIAWGTIGSIVIIGLPLIESWETIKSVCMGMFTNDRLMNKLDDLNHRLQALTKAVPEAERIYLLEIEKTKKTDEES

SEQ ID NO: 683 - protein, 339 aa, Brassica juncea
MGVDYYNVLQVDRNASEDDLKKAYRKLAMKWHPDKNPNNKKDAEAKFKQISEAYEVLSDPQKKAVYDQYGEEGLKGNVPPPGADGATYFSTGDGPTSFRFNPRNADDIFAEFFGFSRPFGGGGGGGGTRFSSSMFGDNIFASFGEGGVGVGGAMHHGGARKAAPIENKLPCSLEDLYKGTTKKMKISREIADVSGKTMPVEEILTIDVKPGWKKGTRITFPEKGNEQPGVTPADLVFIIDEKPHPVFTREGNDLIVTQRISLAEALTGYTVNLTTLDGRRLTIPVTNVIHPEYEEVVPKEGMPLQKDQTKRGNLRIKFNVKFPTRLTLEQKTGVKKLLG

SEQ ID NO: 684 - protein, 680 aa, Brassica juncea
MDSESWKLLRSVCILSFLLGSFSVYQSLHAVVAAQEQQDTQPAVTLQVNASNGAGRLIPETLFGIFFEEINHAGAGGLWAELVSNRGFEAGGQNTPSNIWPWSIVGDHSSVYVATDRSSPFERNKIALRMDVICDGNGCPSGGVGVYNPGYWGMNIEEGMKYKVAFYVRSSDDIDLSVSLTSSNGSLTLASEKIIASASDVSKWTKKEVLLEAKGTDHGARLQLTTTKKGSLWIDQVSAMPVDTYKGHGFRNDLYQMMVDIKPRFIRFPGGCFVEGEWLSNAFRWKETVGPWEERPGHFGDVWKYWTDDGLGHFEFFQLAEDIGAAPIWVFNNGISHNDEVETASIMPFVQEALDGIEFARGDANSTWGSVRAAMGRQEPFELKYVAIGNEDCGKTYYRGNYIVFYDAIKKAYPDIKIISNCDGSSRPLDHPADYYDFHIYTSASSLFSMYHQFDRTSRKGPKAFVSEYAVTGKDAGKGSLLAALAEAAFLIGLEKNSDIVEMASYAPLFVNTNDRRWNPDAIVFNSSHLYGTPSYWVQRFFAESSGSTLLSSELKGNSSSIVASAISWKNSSQDYIRIKAVNFGDSSVNMKVLVTGLDPNVMKVSGSKRTVLTSTNVMDENSFTQPEKVVPQESLLEMAEEDLTVVLPPHSFSSFDLLKEPAKIRKPVSDSSYQKTSTM

SEQ ID NO: 685 - protein, 458 aa, Brassica juncea
MERKLLLTVSVILNLVFTFHILYKKSTTWNPTWTSRAAIEAEDAASVSCSGHGRAYVDGIGVLGGKQPPCECNNCYTGKDCSILLSDCPVNANSGDTLFLEPFWMRQAESSAALVSGWHRMSYIYQDGTYVSEALETVIRKLHSVVGNAVTDNRFVIFGSGSTQLLAAAVHALSLTNSSSSGPARLLASVPYYAMYKEQAEFFDSVHLKFEGDAFAWKNSERNDNTTQVIEVVTSPNNPDGKLKRAVLDGPNVKTIHDYAYYWPYFSPITVPADEDLSLFSLSKTTGHAGSRFGWGLVKDKTVYEKMKRYITLSSMGVSRTTQLHVLQLLNVVVRDGGDNIFHFGHETLKKRWETLNKVLSLSTRFSLQKIKPEYCNYFKKVRDFTPSYAWVKCERPGDANCYEIFREAKITGRDGKVFGSEESFVRLSLIRSQDDFDHLIDMLKKLVFQEGVEAHSI

SEQ ID NO: 686 - protein, 269 aa, Brassica juncea
MGDLYALDFDGVLCDSCGESSLSAVKAARVRWPGLFVGVDSALEEWIVDQMHIVRPVVETGYENLLLVRLLLETKMPSIRKSSVAEGLTVDGILESWGKIKPVIMEAWDEDDKDALIDLFGSVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKEPELDKWNLYLSNWGYNTEKERAEAESIPRIQVIELSTFSNKLK

SEQ ID NO: 687 - protein, 272 aa, Brassica juncea
MTTIINSGGAIAIREVWAENLESEFELISGIIDDYPFVSMDTEFPGVIFKSDLRRGNPADLYRLLKSNVDALSLIQVGLTLSDADGNLPDLGDGRRFIWEFNFKDFDVARDAHAPDSIELLRRQGIDFERNRRDGVDSERFAELMMSSGLVCNEEVSWVTFHSAYDFAYLMKILTRRELPCALGEFQRVMRALFGERVYDMKHMMRFCERKLYGGLDRVARTLEVNREVGKCHQAGSDSLLTWHAFQRMRDLYFHQDGPEKHAGVLYGLEVF

SEQ ID NO: 688 - protein, 482 aa, Brassica juncea
MNKQDVMKLQTCVLKVNVHCEGCKHKVKKQLQKIEGVYSVKADVEQGKVTVTGNVDPAILVKKLSKSGKHAEIIGGGGGGKESNGKANGGGGGQPMQLTPQQIQQIMMMKAAHGGGGKDMKMMMPPVASKDHQKKSVKFEEEEEDDEFSEEDDDEFSDEFSEDDYDDDEFDEDDEDDDERGGHGHGGGGGMPPNKVMMMPNKMPQMGDGGGAKGPNEIMMMMNGLKAGGGGGGGGGFEIPVKMKGMGEGKMGKEEKANKGGGGKTGKADAKSGGGLLGFFKKGKSEKGGEKKGGGKKEDGGGDKVKASGGGGGGDDNGPKKGGGKSKGAAHGAHDIDELMKHVKAGGGGNKGNHNHISAKGMGGPMVQGGPMGMMGHQSGSFPAVQGLPMSGGGGYYPPPPQAMNQQQYMQMMMQQQHQQQQAAFHGGYGGGGHGGDMYHPMMYARPYPAVNYAHPPPMPPPHSGPYTDMFSDENPAGCSIM

SEQ ID NO: 689 - protein, 265 aa, Arabidopsis thaliana
MARVFESDSGSGCSNVLSLDLIRESLIRQEDTIVFSLIERAKFPLNSPAFEESRCLDSGSFSSLTEFFVRETEIIQAKVGRYEYPEENPFFLENIPHSVFPTHKYPSALHPKALSVNINKQIWDIYFKELLPLFVKPGDDGNYPSTAASDLACLQALSRRIHYGKFVAEVKFRDAPQDYEPAIRAQDREALMKLLTFEKVEEMVKKRVQKKAETFGQEVKFNSGYGDESKKKYKVDPLLASRIYGEWLIPLTKLVEVEYLLRRLD

SEQ ID NO: 690 - protein, 246 aa, Brassica juncea
MKLKVYADRMSQPSRAVIIFCKVNGIEFDEVLIILAKRQQLSPEFKEINPLGKVPTIVDGRLKLFESHAILIYLSSAFPSVADHWYPNDLSKRAKIHSVLDWHHTNLRPGAAGYTMNSVLAPFLGGSLDSKAAAEAEQILTKSLSTLETFWLKGNAKFLLGSNQPSIADLSLVCELMQLQVLDEKDRLRLFSPYKKVEEWIENTRKVTQPHFDVVHKTLYGAKDKVEKQRKMGTTTVSKPGFQSKM

SEQ ID NO: 691 - protein, 63 aa, Brassica napus
MISVVVITELLVEYTAALAKLTAGILPRRQGDRDVVRIGGFSLRYPPRSTTTIPDFSSHLVDF

SEQ ID NO: 692 - protein, 1442 aa, Arabidopsis thaliana
MSFAAYKMMHWPTGVENCASGYITHSLSDSTLQIPIVSVHDDIEAEWPNPKRGIGPLPNVVITAANILEVYIVRAQEEGNTQELRNPKLAKRGGVMDGVYGVSLELVCHYRLHGNVESIAVLPMGGGNSSKGRDSIILTFRDAKISVLEFDDSIHSLRMTSMHCFEGPDWLHLKRGRESFPRGPLVKVDPQGRCGGVLVYGLQMIILKTSQVGSGLVGDDDAFSSGGTVSARVESSYIINLRDLEMKHVKDFVFLHGYIEPVIVILQEEEHTWAGRVSWKHHTCVLSALSINSTLKQHPVIWSAINLPHDAYKLLAVPSPIGGVLVLCANTIHYHSQSASCALALNNYASSADSSQELPASNFSVELDAAHGTWISNDVALLSTKSGELLLLTLIYDGRAVQRLDLSKSKASVLASDITSVGNSLFFLGSRLGDSLLVQFSCRSGPAASLPGLRDEDEDIEGEGHQAKRLRMTSDTFQDTIGNEELSLFGSTPNNSDSAQKSFSFAVRDSLVNVGPVKDFAYGLRINADANATGVSKQSNYELVCCSGHGKNGALCVLRQSIRPEMITEVELPGCKGIWTVYHKSSRGHNADSSKMAADEDEYHAYLIISLEARTMVLETADLLTEVTESVDYYVQGRTIAAGNLFGRRRVIQVFEHGARILDGSFMNQELSFGASNSESNSGSESSTVSSVSIADPYVLLRMTDDSIRLLVGDPSTCTVSISSPSVLEGSKRKISACTLYHDKGPEPWLRKASTDAWLSSGVGEAVDSVDGGPQDQGDIYCVVCYESGALEIFDVPSFNCVFSVDKFASGRRHLSDMPIHELEYELNKNSEDNTSSKEIKNTRVVELAMQRWSGHHTRPFLFAVLADGTILCYHAYLFDGVDSTKAENSLSSENPAALNSSGSSKLRNLKFLRIPLDTSTREGTSDGVASQRITMFKNISGHQGFFLSGSRPGWCMLFRERLRFHSQLCDGSIAAFTVLHNVNCNHGFIYVTAQGVLKICQLPSASIYDNYWPVQKIPLKATPHQVTYYAEKNLYPLIVSYPVSKPLNQVLSSLVDQEAGQQLDNHNMSSDDLQRTYTVEEFEIQILEPERSGGPWETKAKIPMQTSEHALTVRVVTLLNASTGENETLLAVGTAYVQGEDVAARGRVLLFSFGKNGDNSQNVVTEVYSRELKGAISAVASIQGHLLISSGPKIILHKWNGTELNGVAFFDAPPLYVVSMNVVKSFILLGDVHKSIYFLSWKEQGSQLSLLAKDFESLDCFATEFLIDGSTLSLAVSDEQKNIQVFYYAPKMIESWKGLKLLSRAEFHVGAHVSKFLRLQMVSSGADKINRFALLFGTLDGSFGCIAPLDEVTFRRLQSLQKKLVDAVPHVAGLNPLAFRQFRSSGKARRSGPDSIVDCELLCHYEMLPLEEQLELAHQIGTTRYSILKDLVDLSVGTSFL

SEQ ID NO: 693 - protein, 2540 aa, Arabidopsis thaliana
MASPLESLLSISGSVSTSSTLIRLRIFRHDIPEILQNSDMTSDIAPVIVDMIFQTLAIYDDRASRKAVDDLIVKGLGNVTFMKTFAAMLVQVMEKQLKFCFDTVCYRLLIWSCLLLEKSQFATVSKNAFVRVASTQASLLRIIMESSFRMRRACKRFMFHLFSQSQAIYSLYMDEVKGSRIPYKDSPELLGLLLEFSCSSPALFEQSKAIFVDIYVKDVLNSREKQKPNLSNCFKPLLQRLSHEEFQTVILPAAVKMLKRNPEIVLESVGFLLANVNIDLSKYALELLPVILPQARHTDEDRRLGALSMVMCLSEKSSNPDTIEAMFASVKAIIGVQELASAPEGKYIGSLSRTICSFLIACYKDEASWASRSSVAIQPNLVSFIAAGLKEKEALRRGHLRCISDLLSPLIQLVKTGFTKAVQRLDGIYALLIVSKIAACDIKAEDTMVKEKLWTLISQNEPSLVQITLASKLSSDDCVVCVDLLEVLLVEHSSRVLEAFSLKSLSQLLLFLLCHPSWNVRKTAYNSVTKIFLATSQLATTLLDEFSDFLSITGDQIVSSRTSDADNPADHQAPFVPSVEVLVKALIVISSAAVAGPPSSWIVRAIFCSHHPSIVGTGKRDAVWKSLLGPMGLTSAKTPEQQAAVYSLSTMMSLAPEDTFTVFKMHLQDLPDRLSHDMLSETDIKIFHTPEGMLLSEQGVYVAQTIGAKYTKQEPSSNHSLKKGLASRETANSGRRDTAKLTKKADKGKTAKEEARELMLKEEASTRENVHRIQKSLSLVLHALGEMGLANPVFCHSQLPFLATFLDPLLRSPIVSAAAFENLVKLARCTVQPLCNWALEISTALRLIAIDEVDTSFDFRPSVDKAGKTYEGLFERIVNGLSISCKSGPLPVDTFTFIFPILERILLSSKRTKLHDDVLQILYMHLDPMLPLPRLRMISVLYHVLGVVPAYQASVGPALNELCLGLQADDVANALYGVYSKDVHVRLACLNAVKCIPAVSKCSLPQNVKIATNIWIALHDPEKSVAESADDLWARYGHDLGTDYSGIFKALSHINLNVRLAAAEALADALHESPSSIQLSLSTLFSLYIRDATSGEDVFDAGWIGRQGIALALQSAADVLTTKDLPAVMTFLISRALADPNTDVRGKMINAGIMIIDKHGKENVSLLFPIFENYLNKEASDEEEYDLVREGVVIFTGALAKHLARDDPKVHNVVEKLLEVLNTPSESVQRAVSTCLSPLVLSKQEEAPALFLRLLDKLMKSDKYGERRGAAFGLAGVVMGFGISSLKKYGLIVTLQEALIDRNSAKRREGALLAFECLCEKLGKLFEPYVIKMLPLLLVSFSDQVGAVREAAECAARAMMSQLSAYGVKLVLPSLLKGLEDKAWRTKQSSVQLLGAMAFCAPQQLSQCLPRVVPKLTEVLTDTHPKVQSAGQLALQQVGSVIKNPEISSLVPTLLLALTDPNEYTRHALDTLLQTTFVNSVDAPSLALLVPIVHRGLRERSSETKKKASQIVGNMCSLVTEPKDMIPYIGLLLPEVKKVLVDPIPEVRSVAARAVGSLIRGMGEDNFPDLVPWLFETLKSDTSNVERYGAAQGLSEVIAALGTDYFENILPDLIRHCSHQKASVRDGYLTLFKFLPRSLGAQFQKYLQLVLPAILDGLADENESVRDAALGAGHVLVEHHATTSLPLLLPAVEDGIFNDNWRIRQSSVELLGDLLFKVAGTSGKALLEGGSDDEGASTEAQGRAIIDILGMDKRNEVLAALYMVRTDVSLSVRQAALHVWKTIVANTPKTLKEIMPILMSTLISSLASPSSERRQVAGRSLGELVRKLGERVLPLIIPILSKGLKDPDVDKRQGVCIGLNEVMASAGRSQLLSFMDQLIPTIRTALCDSALEVRESAGLAFSTLYKSAGLQAMDEIIPTLLEALEDDEMSTTALDGLKQIISVRTAAVLPHILPKLVHLPLSALNAHALGALAEVAGAGFNTHLGTILPALLSAMGGENKEVQELAQEAAERVVLVIDEEGVETLLSELLKGVSDSQASIRRSSAYLIGYFFKSSKLYLIDEAPNMISTLIVMLSDSDSTTVAVSWEALARVIGSVPKEVLPSYIKLVRDAVSTARDKERRKRKGGYVVIPGLCLPKSLKPLLPVFLQGLISGSAELREQAAIGLGELIEVTSEQALKEFVIPITGPLIRIIGDRFPWQVKSAILATLIILIQRGGMALKPFLPQLQTTFVKCLQDSTRTIRSSAAVALGKLSALSTRIDPLVGDLMTSFQAADSGVREAILSAMRGVIKHAGKSIGPAVRVRIFDLLKDLMHHEDDQVRISATSMLGVLSQYLEAAQLSVLLQEVNDLSASQNWGARHGSVLCISSLLKHNPSTIMTSSLFSSMLNSLKSSLKDEKFPLRESSTKALGRLLLKQLATDPSNTKVVIDVLSSIVSALHDDSSEVRRRALSSLKAFAKDNPSATMANISVIGPPLAECLKDGNTPVRLAAERCALHVFQLTKGAENVQAAQKYITGLDARRLSKFPEQSDDSESDDDNVSG

SEQ ID NO: 694 - protein, 660 aa, Arabidopsis thaliana
MKSFAAKVEEGVKGIDGKPSVGPVYRNLLSEKGFPPIDSEITTAWDIFSKSVEKFPDNNMLGWRRIVDEKVGPYMWKTYKEVYEEVLQIGSALRAAGAEPGSRVGIYGVNCPQWIIAMEACAAHTLICVPLYDTLGSGAVDYIVEHAEIDFVFVQDTKIKGLLEPDCKCAKRLKAIVSFTNVSDELSHKASEIGVKTYSWIDFLHMGREKPEDTNPPKAFNICTIMYTSGTSGDPKGVVLTHQAVATFVVGMDLYMDQFEDKMTHDDVYLSFLPLAHILDRMNEEYFFRKGASVGYYHGNLNVLRDDIQELKPTYLAGVPRVFERIHEGIQKALQELNPRRRFIFNALYKHKLAWLNRGYSHSKASPMADFIAFRKIRDKLGGRIRLLVSGGAPLSPEIEEFLRVTCCCFVVQGYGLTETLGGTALGFPDEMCMLGTVGIPAVYNEIRLEEVSEMGYDPLGENPAGEICIRGQCMFSGYYKNPELTEEVMKDGWFHTGDIGEILPNGVLKIIDRKKNLIKLSQGEYVALEHLENIFGQNSVVQDIWVYGDSFKSMLVAVVVPNPETVNRWAKDLGFTKPFEELCSFPELKEHIISELKSTAEKNKLRKFEYIKAVTVETKPFDVERDLVTATLKNRRNNLLKYYQVQIDEMYRKLASKKI

SEQ ID NO: 695 - protein, 619 aa, Arabidopsis thaliana
MAREHAIGEATGKRKKRGRVEEAEEYCNDGIEEQVEDEKLPLEVGMFYYPMTPPSFIVSDALEPDFPLIYVNRVFEVFTGYRADEVLGRNCRFLQYRDPRAQRRHPLVDPVVVSEIRRCLEEGIEFQGELLNFRKDGTPLVNRLRLAPIRDDDGTITHVIGIQVFSETTIDLDRVSYPVFKHKQQLDQTSECLFPSGSPRFKEHHEDFCGILQLSDEVLAHNILSRLTPRDVASIGSACRRLRQLTKNESVRKMVCQNAWGKEITGTLEIMTKKLRWGRLARELTTLEAVCWRKFTVGGIVQPSRCNFSACAVGNRLVLFGGEGVNMQPLDDTFVLNLDAECPEWQRVRVTSSPPGRWGHTLSCLNGSWLVVFGGCGRQGLLNDVFVLDLDAKHPTWKEVAGGTPPLPRSWHSSCTIEGSKLVVSGGCTDAGVLLSDTFLLDLTTDKPTWKEIPTSWAPPSRLGHSLSVFGRTKILMFGGLANSGHLKLRSGEAYTIDLEDEEPRWRELECSAFPGVVVPPPRLDHVAVSMPCGRVIIFGGSIAGLHSPSQLFLIDPAEEKPSWRILNVPGKPPKLAWGHSTCVVGGTRVLVLGGHTGEEWILNELHELCLASRQDSDL

SEQ ID NO: 696 - protein, 839 aa, Oryza sativa
MAAHTVTDPLEELWNHTMSMDKTHLMCFYPSKITMGGVWTGDNPLDFSIPLLLFQILLITSTTRAATLLLSPLRLPTYISQILAGFLLGPSVLGHLPHFSNLVFPVRSLFVLESMALLGLVYYTFIVGVEIEVSAITRAGIRSFGFAIGCTLPPFLVGALTGYVALSTDDKHKGDTFLNKLSFPIFLGSTFSSTAFAVLARNIAELKLAGTDVGQLTLSASLINDTFAWTGLTVATVLGHSRCTITQTTWTLTSGVVIFGASYLLLRPMLLRLARRAAEGEAVGEDRECWILIGVMVAALVADAGGTHAIFGAFVFGLAVPNGPVGVALVEKVEDFVVGALLPLFFALSGLRTDTAKITNMHSAVLLMVAAMVAAVLKVVAAIGVAGVFGMPLGDGTSIGLLLNTKGIIELVILNIARNKGIMSDQSFTVLVFVSALITAMVSPFLGMVVKPARRLVFYKRRTVAWAHPESELRVLACVHVPRDVPALLTLLDVVTPSSRSPVGVLALHLIEFVGRSSALLLINASAPSSSSYDASVHGRSHTEMQFKHISHAFMAYEEQSVGVSARTMAAVSPYASMHEDITSAAENQHSALILLPFHKYRSVDGGLEVSHPAIQPLNCSVQSFSPCTVGILVDRGLAAVPGGGYRVVALFFGGSDDREVAALATRMVRNPTIDLTLLRFVQKGGSFTASEFDALKERKADEGCLRDFLERANEGGGATVEYRERGVFNASEMVGEIQSVEAMGNKDLFVVGKVPGGSGLTAGMAEWSESPELGPIGDLLASKDFQTTASVLVLQAYGRPAAVVGAGAGAMSVDFGGDSVAMAERTASGRRPWARPGV

SEQ ID NO: 697 - protein, 139 aa, Hordeum vulgare
MASKLVLLVATLACVLGGAEAKLGRLVVSGVVPCNTGSLIDIATSPAFPNAEVELRCAGQVVAGATTNTNGSFTMEADLTSALAAFIGRCSLVVDTPLIKCDAQLPPAGRLVSYLQGPLTRLLGGIFHLFPAGFSFHSR

SEQ ID NO: 698 - protein, 436 aa, Arabidopsis thaliana
SLSFNNLFSIFLYSQSSSCWPAIIMSLIGRLNLGRRFCTAVPRRSEDIMSNPDCRPSDLCLRVSYLIRCVGDLDTAAKYARLAVFTSIKSESTTTICQSIIGGMLRDKRLKDAYDLYEFFFNQHNLRPNSHCWNYIIESGFQQGLVNDALHFHHRCINSGQVHDYPSDDSFRILTKGLVHSGRLDQAEAFLRGRTVNRTTYPDHVAYNNLIRGFLDLGNFKKANLVLGEFKRLFLIALSETKDDLHHSNYENRVAFLMATFMEYWFKQGKQVEAMECYNRCVLSNRLLVCAETGNALLKVLLKYGEKKNAWALYHELLDKNGTGKGCLDSDTIKIMVDECFDMGWFSEAMETYKKARPKNDYLSDKYIITRFCENRMLSEAESVFVDSLADDFGYIDVNTYKTMIDAYVKAGRIHDAIKTSNKMIDATLKEVSHLF

SEQ ID NO: 699 - protein, 302 aa, Medicago truncatula
MQDSSGLKYVSIFKPTDEEPMAFNNPRGLPISVDGEGLKKGTQVGQGALREVAAYILDHPRKGPRSYHNNEEKGFAGVPPTVMVRCMHEGFHHPEGYKNVSSNVKIGSLQMFMRNIGSCEDMGPRTFPVEEVHKISVLDMRLVNADRHAGNILVAKNGEDGPIVLIPIDHGYCLPKSFEDCTFDWLYWPQAQEPYSLDTTEYIKSLDAEEDIKLLKSHGWELPLECARILRISTMLLQKGAEKGLTPFTIGSIMCRETLKKKSVIEQIIHKAEEAALPGTSEAKFLDLVSVIMDNHLEGLFP

SEQ ID NO: 700 - protein, 171 aa, Solanum lycopersicum
LIAVSTTRLAKKELVRFGIIQTIGKILSNSETARAVVEKSLKLLETVATCAEGRTAIGKGEECLSAIVTRLMKSSKAATEHGVTVLWSVCCLFRHTAAREVVGKANGLTKVLLVMQSDCSAAVRQMCGELVKALRVVNTFSVRTEEVIKIKNYSKSCLASYDTQTTHIMPY

SEQ ID NO: 701 - protein, 309 aa, Solanum lycopersicum
LDDEIWRLKKIAKDGASHKRLSKEGISCVKEFLRLFVTDPSLLRKMLACGNNIWEKITEHVSTCPLDNSEWYVYNAGESIVLLFNCIYELVGAILDGQNFQSIDKLDIFQKRMVEDFKRSVYKNLNCLAPLEDHSLIGQAILTSNLQNGLNHIPSSSQQNMNYSDEQGQVEFQSNSDHATISSPLAYTAQQDSPTTVSMPESFNGIQAFNSTLASSFLVGEPCSSIYPGDYDWGSNGSLDSLGMTDYLPPNNNYQFETPVWQGNELLASSSVQPVSPNIGFHITRRGNPRAIWCTIRAVLKWKTLVKRK

SEQ ID NO: 702 - protein, 104 aa, Solanum lycopersicum
NPADIPAGILGGRALELLRTGQVDGGGAAITAAESSGFKADEDMSPRLFGVSIGVKRVRRSSEEESEDQDQVQPHGSDMKSEPLDSGSAQHDDQPWIDRLDLGC

SEQ ID NO: 703 - protein, 112 aa, Solanum lycopersicum
MNSDNFRVQDEGVFLLASSQPKKRAGRKKFKETRHPVYKGVRRRDNNKWVCEVREPSEQKRIWLGTYPTPEMAARAHDVAALALRGNLATLNFADSSWRLSVPISKDPDELR

SEQ ID NO: 704 - protein, 257 aa, Solanum lycopersicum
MEEIIEEKKMKILCLHGFRTSGNFLKKQLSKWDPSIFANSEMDFPDGIFAAKGKSDIEGIFPPPYFEWFQYNEDFTEYENLEECITYLCEYITSKGPFDGLLGFSQGATLSGLLLGYMEQGEILKEHPPMKLFVSISGAKFRDPNICNIAYKDMMKVKSVHFIGEKDWLKLPSQELTTDFENPIIIRHPQGHTVPRIDEAAVETLKSWTREVALSSNESCVGGGPNEACKHVNIENGGEQGKKLEKPNEVEIQKAQE

SEQ ID NO: 705 - protein, 334 aa, Solanum lycopersicum
ESLRLCFHNFLSFHLSIIAKIFRWLFSSLPTIKRFPLFVPFIDAYISLLFRFANLSPCTLDLDDQTTIHFWAPNHRRYDKPNLVLIHGYGGDAKWQFMYQVKSLAESFNLYIPDLLFFGKSYTTRKERTEEFQAKCVVQGLKELGVRNCSMFAISYGGFVGYRMAEMNPQMVEKVVILSSGVGCSKDQKEEQLKKIGRDPVELLIPEKPEDLHVLVNLSIYKYNPFKWAPDYFLQEFIDMISRTYLKEKQELVHHLLSNHTDCRLPILNQETLLIWGDKDRVFPLMFGYQLQRHLGPRAKLEVIKNTGHAANIESPDSVNALIKAFILPQSKDL

SEQ ID NO: 706 - protein, 230 aa, Solanum lycopersicum
MADDDFLQLLKRIGAFLTLKISNLSQTLDSRCAGAIAGLAFAIVFIWKIMRSPSGPQRRHPKQQAVTPGSSGVSSHFSENVPSSEVSPPSENSNAQNVIDEFFQPVKPALGQIVRQRLGEGRKVTCRLLGVILEETSPEELQKQATVRSSALEVLLEITKFCDLYLMERVLDDESEKKVLLALEDAGVFTSGGMVKDKVLFCSIENGRTSFVRQLEPDWHIDTNPEIVSN

SEQ ID NO: 707 - protein, 536 aa, Solanum lycopersicum
DTRTGEPITYIEYYKKRHGINICFEEEPLLRGKHICKVHNYLQRSRTQKAKDSTDSSVELPPEICSLIMSPLSISTLNTYSYVPSIMHRIESLVMASNLKRMHLDHCTLNVPIPTATILEAMTTKKCLEKFHLESLETLGDSFLKYAASIKLFKTYENHHEGLLTVKKTQIISNAALCKLGCARKIPGFIRNEPFDLKAWIIPGDNSQVHSFDEVLLTSSDKMYSRVKQKIRSKRVADVVEALIGAYLSSGGEVAALSFMKWLGVDINFVDAPMSRHFPMNAEKLVNVRYLESLLHYKFNDPSLLVEALTHGSYMIPEIPRCYQRLEFLGDAVLDYVVTAHLYFKYPGLTPGLITDLRSASVNNECYAQSAVKAGLHKHILHASQDLQRQICSTVEDFDKLNLDSTFGWEAETTFPKVLGDVIESLGGAIFVDSGFDKETTFQCIRPLLEPLVTPQTLKPHPVRELSELCDQKGYIRKKDVVSRENGIAYITVEVEANGVVHKSTCSGRDKLIAKKVASKNVLKSLKECPSNATEQ

SEQ ID NO: 708 - protein, 168 aa, Solanum lycopersicum
MVDKLNVFWPSLTKQDPKDMWKEAWNTYGTCTIERFKTPIQYFNRASRLDSEIGDLLQSHLISSNGIVPCDSATYNNVEILNSFKQVAKDKDVSFTCKDINTTHAYLNQVTFCYTNDAKNFVNCPTSLINKRCRVQNIIVPRPSPPKPIKQQEKSLDQIAYGDSWSIV

SEQ ID NO: 709 - protein, 219 aa, Solanum lycopersicum
MAESQLVHPPLFTYISMITLLTLVPPFVILMWYTNVHADGSVLQTYNYLKENGLQGLIDIWPRPTAIAGKIIICYALFEATLQLLLPGKRVEGPISPTGHRPVYKANGMAAYTVTLITYLSLWWFGIFNPTIVYDHLGEILSTLNFGSLIFCLFLYIKGHVAPSSTDHGSSGNIIVDYYWGMELYPRIGKHFDIKVFTNCRFGMISWGLLPITYCIKQY

SEQ ID NO: 710 - protein, 103 aa, Solanum lycopersicum
YKKDIINIHHGLLPSFKGSNPSKQAFDAGVKLIGATTHFVSEELDSGPIIEQLVERVSHRDNLRTFIQKSEDVEKRCLAKAIKSYCELRIFPYEANKTVVFRS

SEQ ID NO: 711 - protein, 136 aa, Solanum lycopersicum
KTFNCNFYIFLLLILPLIFESCCLARVQVHIINKLPDGLAMTLHCQSHDNDLGQLRLTGGDEASWTFSVNFWGTTMFYCDAQWDDSSTTYRFVTYDAARDARRCQTECWWMISEEETLYGYNQESEYWELFPFTSA

SEQ ID NO: 712 - protein, 96 aa, Solanum lycopersicum
SCPGFISDGLNRVRWANKAYKAMVGDGAGEVVVWLVMKDDVRLPESKSMAAFTCRVRVVRCGKEKNSLILPCDVWRMDGGGFAWRLDTEAALSLGR

SEQ ID NO: 713 - protein, 209 aa, Solanum lycopersicum
MWRNSCNLLKRTVTLVARTNTVNNGVRPFLGVDYKFGCYCGPTRMVGGYYFSSGSNGGGENKNGDSITHEEAKRLMRLVNVEELKWKLGMKNTEVIGYMDLLKACKNMGVAKTHDEAVGFARVLDEAGVILLFRDKVYLHPDKVVDEIRKAVPLALLPEDDPTIEQLKILQENKDKIDELAHRHVRRVLWAGLGAGLLPVGLFFRLTFW

SEQ ID NO: 714 - protein, 213 aa, Solanum lycopersicum
MASNTLMSYGIAPVYPSILSSSKSKFATALPVSTGVTNDTSRFSMSANWMPGQPRPSYLDGSDPGDFGFDPLGFGEVPENLERYKESELIHCRWAMLAVPGIIVPEALGLGNWVKAQEWAAIPGGQATYLGQPVPWGTLPTILAIEFLAIAFVEHQRSMEKDSEKKKYPGGAFDPLGYSKDPAKFEELKVKEIKNGRLALLAFVGFCVQQSAY

SEQ ID NO: 715 - protein, 109 aa, Solanum lycopersicum
IEKNKQEEDEELYSLEETNKRRVVFGELEAICIRGIASESADNLPTNHNVTFPELALNEAMVNKMDNTMGKFHKRKRGKDEWGRFFKSLVKKLANHQEDLQRSLMETME

SEQ ID NO: 716 - protein, 59 aa, Arabidopsis thaliana
MLELLCLVRTDNQLHSNPCRQSFPWTWLESKEQWGLRDYYETLYVILASKCMVKFKLKK

SEQ ID NO: 717 - protein, 134 aa, Solanum lycopersicum
MAKSTKILSSILILFFIFSLFSSSNALGGKLGGRTQIKNVKTNQEIQDLGKYCVEEHNRDLRHINGALSSLLSFSQVVEAEKQVVSGVKYYLKISAIVKSSSSPKLFDAVVVVKAWEKKKELLTFSPSPSPATK

SEQ ID NO: 718 - protein, 444 aa, Arabidopsis thaliana
KMNPKIRKPNNSSSKKVTVSVLSVFLVFVFVNTFFYPSFYSDSGSIRRNLVDSRESFHFPGNFRKTKVYMYELPTNFTYGVIEQHGGEKSDDVTGLKYPGHQHMHEWYLYSDLTRPEVKRVGSPIVRVFDPAEADLFYVSAFSSLSLIVDSGRPGFGYSDEEMQESLVSWLESQEWWRRNNGRDHVIVAGDPNALKRVMDRVKNAVLLVTDFDRLRADQGSLVKDVIIPYSHRIDAYEGELGVKQRTNLLFFMGNRYRKDGGKVRDLLFKLLEKEEDVVIKRGTQSRENMRAVKQGMHTSKFCLHLAGDTSSACRLFDAIASLCVPVIVSDGIELPFEDVIDYRKFSIFLRRDAALKPGFVVKKLRKVKPGKILKYQKVMKEVRRYFDYTHLNGSVNEIWRQVTKKIPLIKLMINREKRMIKRDGSDPQCSCLCSNQTGIIHGV

SEQ ID NO: 719 - protein, 277 aa, Brassica napus
WTPAVRSGIPGRARVRSSPETTKPAETAVARPRHTGLTRTTSLPAESEEEWRKRKEMQTLRRMAAKRRRSEKLRTGGGNSTKSTEANNNPGEAATTSRRRGRPSSGLPRWSATANSGGLLRQHSAGHESLQGSLESQGGGGGGVGSSSSVSELETKSHQASSEEARSLPSTQQQQEAIAKPNTRLRRLSSVDMKIEPPQGKGKNEMPCVFTKGDGPNGKRVDGILYRYGNGEEVRIMCVCHGDFLSPADFVKHAGGPHVDHPLRHIVVNTSSPSNLL

SEQ ID NO: 720 - protein, 165 aa, Brassica juncea
SGSVAQLHNVFVYGSFQEPEVVKVMLDRTPEIIPVTLPGFKRFRLKGRLYPCVIPCEDGEVKGQLLMGLTDEELENVDAVEGNEYERVTVGVVREDNSEKMTVKTYIWLNKDDPDIDGEWDFEEWKRLHMKKFIETFKEIMEWKRNPHGKGRDDFNHVLRDAPSA

SEQ ID NO: 721 - protein, 207 aa, Brassica juncea
KNELIMAPLVSSLLVFGFLVAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 722 - protein, 124 aa, Brassica juncea
DMLKERNEEYGTIKFVDISSNDYSPQENQGLNYETVMGQIHAIQSDGNVVTGVEAIRKLYELVGLGWVYSITKFEPIGKVADAVYDFWAKYRLQVTGRPPIEAILEARKKNKVETCGDSKACKT

SEQ ID NO: 723 - protein, 137 aa, Brassica juncea
PVRSRSPRRRRSPSRSRSLSRSRSYSRSRSPVKRRERSAEERSRSPKRMEDSLSPRGRDRSPIMDDEGSPRIIDGSPPPSPKLEKQDHDGGSPQDNGNGRKTNASPVVGRDSPREDRSPVDDDYEANRASPRGSESP

SEQ ID NO: 724 - protein, 55 aa, Brassica juncea
TELLLEYTAALAKLTAGILPRRQGDRDVVRIGGFSLRCPPRSLPIPDFSSHLVDF

SEQ ID NO: 725 - protein, 158 aa, Glycine max
MREDEYLQSLHFNSLRVKDGSVVNMSLPIVLAIDDETKERIGSSSHVGLLGPDGDCVAILRSIEIYKHNKEERIARTWGTTAPGLPYVEEVITPAGNWLIGGDLEVLKPIKYNDGLDNYRLSPKQLREEFDKRQADAVFAFQLRNPVHNGHALLMNDT

SEQ ID NO: 726 - protein, 178 aa, Solanum lycopersicum
LFNFTANSTALPTSFIKTSCKITTYPQVCVTSLSVYAPTIKRSPQQLAQTALSVSLDRAQSAHTFITKLNKFKGLKSREYAALKDCLEEMSETVDRINKSVKELTRMGSSRGKDVQWHMSNIQTWMSAAITNENSCADGFAGRALNGRIKSSIRARVTHVTQVTSNALALINQFPAKH

SEQ ID NO: 727 - protein, 233 aa, Solanum lycopersicum
VVRSHKEKRSSYAPDKGVRYDGVYRIEKCWRKPGKQGFKVCRYLFVRCDNDPAPWTSDEQGDRPRALPSIKELKGATDMTERKGSPAWDYDEEKSCWMWKKAPPPSRKPVQCENEDGTKVRPVRPKRLTMSVKQRLLKEFTCHLCREVMNNPLTTPCAHNFCKACLDGAFAGQSFTRQRTCEGRRTLRAQKNIMKCPSCPTDISDFLQNPQINRELMNVIESLKRQIEEEMQH

SEQ ID NO: 728 - protein, 889 aa, Arabidopsis thaliana
MGSCFSLQVSDQTLNRIFNCLIGKSYIRTLEKNLRALQREMEDLRAIQHEVQNKVARDEARHQRRLEAVQVWLDRVNSVDIECKDLLSVTPVELQKLCLCGLCSKYVCSSYKYGKKVFLLLEEVKKLNSEGNFDEVSQPPPRSEVEERPTQPTIGQEDMLEKAWNRLMEDGVGIMGLHGMGGVGKTTLFKKIHNKFAEIGGTFDIVIWIVVSKGVMISKLQEDIAEKLHLCDDLWKNKNESDKATDIHRVLKGKRFVLMLDDIWEKVDLEAIGIPYPSEVNKCKVAFTTRSREVCGEMGDHKPMQVNCLEPEDAWELFKNKVGDNTLSSDPVIVELAREVAQKCRGLPLALNVIGETMSSKTMVQEWEHAIHVFNTSAAEFSDMQNKILPILKYSYDSLGDEHIKSCFLYCALFPEDGEIYNEKLIDYWICEGFIGEDQVIKRARNKGYAMLGTLTRANLLTKVGTYYCVMHDVVREMALWIASDFGKQKENFVVQAGVGLHEIPKVKDWGAVRKMSLMDNDIEEITCESKCSELTTLFLQSNKLKNLPGAFIRYMQKLVVLDLSYNRDFNKLPEQISGLVSLQFLDLSNTSIEHMPIGLKELKKLTFLDLTYTDRLCSISGISRLLSLRLLRLLGSKVHGDASVLKELQQLQNLQELAITVSAELISLDQRLAKLISNLCIEGFLQKPFDLSFLASMENLSSLRVENSYFSEIKCRESETESSYLRINPKIPCFTNLSRLEIMKCHSMKDLTWILFAPNLVVLLIEDSREVGEIINKEKATNLTSITPFLKLEWLILYNLPKLESIYWSPLPFPVLLTMDVSNCPKLRKLPLNATSVSKVEEFEIHMYPPPEQENELEWEDDDTKNRFLPSIKPYKYFVYPGMSFLTV

SEQ ID NO: 729 - protein, 640 aa, Arabidopsis thaliana
NHLSPFFKHTQRMVDSKTPAKTKLLDSSSISNVRVVLRVRPFLPREISDESCDGRSCVSVIGGDGGDTSEVAVYLKDPDSCRNESYQLDAFYGREDDNVKHIFDREVSPLIPGIFHGFNATVLAYGATGSGKTFTMQGIDELPGLMPLTMSTILSMCEKTRSRAEISYYEVYMDRCWDLLEVKDNEIAVWDDKDGQVHLKGLSSVPVKSMSEFQEAYLCGVQRRKVAHTGLNDVSSRSHGVLVISVTSQGLVTGKINLIDLAGNEDNRRTGNEGIRLQESAKINQSLFALSNVVYALNNNLPRVPYRETKLTRILQDSLGGTSRALMVACLNPGEYQESLRTVSLAARSRHISNNVSLNPKVETPKVKIDMEAKLQAWLESKGKMKSAHRMMAIRSPLMGTNQTSISQSSVKKLLCHRSAIAESAKLAGTGQRDAFVTARNLFGVETLAASHLWEPIRNLQLASPTKEDERDTSGEENLLVSEASLRDNTLDVEKKYTELSPLREALSPIDSNAKPNSAHGSSPFLKPMTPKTPFLSTNPEIMQMEGTCQKFNAWSNNLKTSLIKEYIHFLNTANREELRELKGIGQKMAEYIIELRETSPLKSLTDLEKIGFTSRQVHNLFKKATEGVLEKPVSASTTP

SEQ ID NO: 730 - protein, 183 aa, Brassica juncea
KPPVSPPAKPPVYPPTKAPTKPPTKPPVKLPVSPPAKPPVKPPVYPPKFNRSLVAVQGTVFCKSCKYASYDSLTGAKPVEGAVVRLLCKSKKNIVAETTTDKNGYFFLLAPKTVTNFGFRGCRAYLVKSKDYKCNKVSKLFGGDVGAELRPVKTPGKSAVVINKLTYGVFNVGPFAFDPVCPK

SEQ ID NO: 731 - protein, 83 aa, Brassica juncea
LCHAMTINKSQGQSLKQAALYLPRNVFTHGQLYVALSRVTSPEGLKILDESSDSNGADGVTNIVYKEIFEGLQGSKGKKPMWS

SEQ ID NO: 732 - protein, 171 aa, Brassica juncea
MVRFTVLIAAVILAFVVAVPPEVTAKKYTVGENKFWNPNINYTIWAQGKHFYLGDWLYFVFDRNQHNILEVNKTDYENCNADHPLVNWTRGAGRDIVALNVTKHYYLLDGKGGCYGGMKLAVKVEKLPPPPKAAPVKSIGSVSMATGVAQFVIPFALFSVSTVWDAILRMW

SEQ ID NO: 733 - protein, 325 aa, Arabidopsis thaliana
MDYQYIKLLDSFREDGSLNLSDNPLRSIRYEVDNGGYDKREFKAVFTNKRSREDRNTIRVTKKNVEPKPPHVQASTEKVTKEAGFKLRRRESLVSQKSVEAMLITSHVRRNSQHNNGDASEKENFEDDIVLDEVYRSYLKRLVENSKSSRTNPEKEIKVKCEEDHTVSLSDSDSDIIVVGDCPFLEEEDSPFVPSKSYKVIDLDEESSDQRNSWFRREIMNVLKQPYTVTELKELHKEASVHGVSSRHIELRDGTEFSFPTNKKKPSYLDRYPDFKKQYLDSLREKDERKALNLLRGFIFYITNVVRDDAFKPWLDQECLKIRCV

SEQ ID NO: 734 - protein, 232 aa, Sorghum bicolor
MASASSNAKQSLYPDVDQSHPDLNTPFFAPTTSTGAGTTAVGSSLYPTVDPNELAENLFPETAEEDAAPPPPTTEETVVAVPGAQLHLVDPDRSLDLGAGTLSIVRLRQGDHSVAVLARLIPEKPHQRRGLFRLFSSGRSDGGAEQEPVQWPLTRDVAAVKLDPAHYFFSLHVPHTDHPDDKDDAEDAEADAEAALSYGLTVVGKGQDKVLEELDRVLEEYTTFSVKQVEAA

SEQ ID NO: 735 - protein, 279 aa, Solanum lycopersicum
MASKNPNSSSMYPQVAVVDQNVPFPSSTSRQNLYPTIDMNDLVENLFPQNDQTAPERQHYSPSAPPEILEETLLVIPGSILHLIDKHYSVELAIGDLFLHRLRQGNNIVAVLVRVGNEIQWPLTKDLAAVKLDDSHYFFSFQAPKDDESDKESSVSDLANDSLNYGLTIASKGQEKLLKELDDILENYSNFAVQKVEEKAAVALGGPVAKELSPADLKSEKKNEVLEERCAAYWTTLAPNVEEYNATAAKLVASGSGHLIKGILWCGDVTADRLKWGNE

SEQ ID NO: 736 - protein, 169 aa, Solanum lycopersicum
MASQSSNPQSVYDFTVKDAKGKDVDLSIYKGKVLIIVNVASQCGLTNSNYTDMTELYKKYKDQGLEILAFPCNQFGGQEPGNIEDIQQMVCTRFKAEYPIFDKVDVNGDNAAPLYRFLKSSKGGFFGDGIKWNFSKFLIDKEGHVVDRYSPTTSPASMEKDIKKLLGVA

SEQ ID NO: 737 - protein, 214 aa, Brassica juncea
GLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKTLNLPAKNYLIPIDDAGTFCFAFAPTSSPLSIIGNVQQQGTRITYDLANHLIGLSANKC

SEQ ID NO: 738 - protein, 84 aa, Brassica juncea
SLFETGGAKGLTGDLVEKIPKLTITDNNNTDASENRESCSVCLQDFQLGETVRSLPHCHHMFHLPCIDKWLLRHGSCPMCRHDL

SEQ ID NO: 739 - protein, 317 aa, Brassica juncea
EVWTKSDKTPVTAADYGSQAVVSLVLERELKPVTLSLVAEEDTGDLRKKGSEEFLEGITKLVRDTLASDESYADSPITKEDVLNAIHCGKSQGGSTGCHWVLDPIDGTRGFVRGEQYAVGLALLVEGKVVVGVMACPNLPLSSAVVEKDDKSCQDNVGCLFFATTGSGAYVQPLNGNSPPQEVRVSSNENLEEAKFLESYHMPIPLHSSIAKKLGITALPVRIDSQAKYAAVSRGDAEMYLRFTLVGYREWIWDHAAGSIITTEAGGVVCDAEGTPLDFSKGKRLDHNRGIIVTTKKLKPLILKAVRESMEEENLRV

SEQ ID NO: 740 - protein, 321 aa, Brassica juncea
QRFKQFVSQSIARMENRLRGSGHGVAAARMDAMLNIAGWMAKQMGGLRYFEFLRTLEKKVDEDWEGISSSLEEIRRSLLARKGCIVNMTADGKSLTNIEKSLEKFLDLLPENPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVGSYQLPDAKGYSSLMRHLLGVTDEERLRKREEILTTSLKDFKDFAEAIDVVRDNGVAVAVASAEDIDAANNARSNFFEVKKAL

SEQ ID NO: 741 - protein, 90 aa, Brassica juncea
LPYLVEKVCPPPAEGAYKLDPFNCERMGGVYENTRSGDCGPVSIKFMELHAVGNPHPGMEGLSDALVDIMRKQFAMDVYKDWVVPLYIGG

SEQ ID NO: 742 - protein, 82 aa, Brassica juncea
RFANSTVAEFKRLLGVKPTPKNEFLGVPVVSHDIDISLKLPKEFDARTAWSQCSSIGRILDQGHCGSCWAFGAVESLSFQVS

SEQ ID NO: 743 - protein, 88 aa, Brassica juncea
KELGFTIPFEELCSLSELQEHIISELKSTAEKNKLRKFEYIKAVAVETKPFDVARDLVTATLKNRRNNLLKYYQVQIDEMYHKLASKK

SEQ ID NO: 744 - protein, 49 aa, Brassica juncea
CGEYVTLRKVGPTGQKGGASGPQQILIEGPLCEDYYKIRDYLYSQFYLL

SEQ ID NO: 745 - protein, 180 aa, Brassica juncea
APMLAGNLVAILTGGLIHAVCSLIQPQNYDWSTTREIKVVEAEAPGDDIDVPVEELKEEKLRRAKAWIVKWGLVFTLLIVVIWPVLSLPARVFSRGYFWFWAIVAIAWGTIGSIVIIGLPLIESWETIKSVCMGMFTNDRLMNKLDDLNHRLQALTKAVPEAERIYLLEIEKTKKTDEES

SEQ ID NO: 746 - protein, 122 aa, Brassica juncea
ITFPEKGNEQPGVTPADLVFIIDEKPHPVFTREGNDLIVTQRISLAEALTGYTVNLTTLDGRRLTIPVTNVIHPEYEEVVPKEGMPLQKDQTKRGNLRIKFNVKFPTRLTLEQKTGVKKLLG

SEQ ID NO: 747 - protein, 269 aa, Brassica juncea
MGDLYALDFDGVLCDSCGESSLSAVKAARVRWPGLFVDVDSALEEWIVDQMHIVRPVVETGYENLLLVRLLLETKMPSIRKSSVAEGLTVDGILESWGKIKPVIMEAWDEDDKDALIDLFGKVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKEPELDKWNLYLSNWGYNTEKERAEAESISRIQVIELSTFSNKLK

SEQ ID NO: 748 - protein, 249 aa, Brassica juncea
VGRGGEEKKWGGFEIPVQMKGMGEGKMGKEEKANKGGGGKTGKADAKSGGGLLGFFKNGKSEKGGGKKGDGGGDKVKSSGGGGGGGEVHHYDDGPKKGGGKSKGGAHDIDELMKQIKAGGGGNKGNHNHISAKGMGGPMVQGGPMGMMGHQSGSFPAVQGLPMSGGGGYYPPPPQAMNQQQYMQMMMQQQAAAYGGYGGGHGGDMYHPMMYARPYPAVNYAHPPPMPPPHSGPYTDMFSDENPAGCSIM

SEQ ID NO: 749 - protein, 1453 aa, Arabidopsis thaliana
RISESQIPVEKMSFAAYKMMHWPTGVENCASGYITHSLSDSTLQIPIVSVHDDIEAEWPNPKRGIGPLPNVVITAANILEVYIVRAQEEGNTQELRNPKLAKRGGVMDGVYGVSLELVCHYRLHGNVESIAVLPMGGGNSSKGRDSIILTFRDAKISVLEFDDSIHSLRMTSMHCFEGPDWLHLKRGRESFPRGPLVKVDPQGRCGGVLVYGLQMIILKTSQVGSGLVGDDDAFSSGGTVSARVESSYIINLRDLEMKHVKDFVFLHGYIEPVIVILQEEEHTWAGRVSWKHHTCVLSALSINSTLKQHPVIWSAINLPHDAYKLLAVPSPIGGVLVLCANTIHYHSQSASCALALNNYASSADSSQELPASNFSVELDAAHGTWISNDVALLSTKSGELLLLTLIYDGRAVQRLDLSKSKASVLASDITSVGNSLFFLGSRLGDSLLVQFSCRSGPAASLPGLRDEDEDIEGEGHQAKRLRMTSDTFQDTIGNEELSLFGSTPNNSDSAQKSFSFAVRDSLVNVGPVKDFAYGLRINADANATGVSKQSNYELVCCSGHGKNGALCVLRQSIRPEMITEVELPGCKGIWTVYHKSSRGHNADSSKMAADEDEYHAYLIISLEARTMVLETADLLTEVTESVDYYVQGRTIAAGNLFGRRRVIQVFEHGARILDGSFMNQELSFGASNSESNSGSESSTVSSVSIADPYVLLRMTDDSIRLLVGDPSTCTVSISSPSVLEGSKRKISACTLYHDKGPEPWLRKASTDAWLSSGVGEAVDSVDGGPQDQGDIYCVVCYESGALEIFDVPSFNCVFSVDKFASGRRHLSDMPIHELEYELNKNSEDNTSSKEIKNTRVVELAMQRWSGHHTRPFLFAVLADGTILCYHAYLFDGVDSTKAENSLSSENPAALNSSGSSKLRNLKFLRIPLDTSTREGTSDGVASQRITMFKNISGHQGFFLSGSRPGWCMLFRERLRFHSQLCDGSIAAFTVLHNVNCNHGFIYVTAQGVLKICQLPSASIYDNYWPVQKIPLKATPHQVTYYAEKNLYPLIVSYPVSKPLNQVLSSLVDQEAGQQLDNHNMSSDDLQRTYTVEEFEIQILEPERSGGPWETKAKIPMQTSEHALTVRVVTLLNASTGENETLLAVGTAYVQGEDVAARGRVLLFSFGKNGDNSQNVVTEVYSRELKGAISAVASIQGHLLISSGPKIILHKWNGTELNGVAFFDAPPLYVVSMNVVKSFILLGDVHKSIYFLSWKEQGSQLSLLAKDFESLDCFATEFLIDGSTLSLAVSDEQKNIQVFYYAPKMIESWKGLKLLSRAEFHVGAHVSKFLRLQMVSSGADKINRFALLFGTLDGSFGCIAPLDEVTFRRLQSLQKKLVDAVPHVAGLNPLAFRQFRSSGKARRSGPDSIVDCELLCHYEMLPLEEQLELAHQIGTTRYSILKDLVDLSVGTSFL

SEQ ID NO: 750 - protein, 2579 aa, Arabidopsis thaliana
LSLNPSSHRDEEEEEASPFYPFTIVLTYQPGPGQSPWKEMASPLESLLSISGSVSTSSTLIRLRIFRHDIPEILQNSDMTSDIAPVIVDMIFQTLAIYDDRASRKAVDDLIVKGLGNVTFMKTFAAMLVQVMEKQLKFCFDTVCYRLLIWSCLLLEKSQFATVSKNAFVRVASTQASLLRIIMESSFRMRRACKRFMFHLFSQSQAIYSLYMDEVKGSRIPYKDSPELLGLLLEFSCSSPALFEQSKAIFVDIYVKDVLNSREKQKPNLSNCFKPLLQRLSHEEFQTVILPAAVKMLKRNPEIVLESVGFLLANVNIDLSKYALELLPVILPQARHTDEDRRLGALSMVMCLSEKSSNPDTIEAMFASVKAIIGVQELASAPEGKYIGSLSRTICSFLIACYKDEASWASRSSVAIQPNLVSFIAAGLKEKEALRRGHLRCISDLLSPLIQLVKTGFTKAVQRLDGIYALLIVSKIAACDIKAEDTMVKEKLWTLISQNEPSLVQITLASKLSSDDCVVCVDLLEVLLVEHSSRVLEAFSLKSLSQLLLFLLCHPSWNVRKTAYNSVTKIFLATSQLATTLLDEFSDFLSITGDQIVSSRTSDADNPADHQAPFVPSVEVLVKALIVISSAAVAGPPSSWIVRAIFCSHHPSIVGTGKRDAVWKSLLGPMGLTSAKTPEQQAAVYSLSTMMSLAPEDTFTVFKMHLQDLPDRLSHDMLSETDIKIFHTPEGMLLSEQGVYVAQTIGAKYTKQEPSSNHSLKKGLASRETANSGRRDTAKLTKKADKGKTAKEEARELMLKEEASTRENVHRIQKSLSLVLHALGEMGLANPVFCHSQLPFLATFLDPLLRSPIVSAAAFENLVKLARCTVQPLCNWALEISTALRLIAIDEVDTSFDFRPSVDKAGKTYEGLFERIVNGLSISCKSGPLPVDTFTFIFPILERILLSSKRTKLHDDVLQILYMHLDPMLPLPRLRMISVLYHVLGVVPAYQASVGPALNELCLGLQADDVANALYGVYSKDVHVRLACLNAVKCIPAVSKCSLPQNVKIATNIWIALHDPEKSVAESADDLWARYGHDLGTDYSGIFKALSHINLNVRLAAAEALADALHESPSSIQLSLSTLFSLYIRDATSGEDVFDAGWIGRQGIALALQSAADVLTTKDLPAVMTFLISRALADPNTDVRGKMINAGIMIIDKHGKENVSLLFPIFENYLNKEASDEEEYDLVREGVVIFTGALAKHLARDDPKVHNVVEKLLEVLNTPSESVQRAVSTCLSPLVLSKQEEAPALFLRLLDKLMKSDKYGERRGAAFGLAGVVMGFGISSLKKYGLIVTLQEALIDRNSAKRREGALLAFECLCEKLGKLFEPYVIKMLPLLLVSFSDQVGAVREAAECAARAMMSQLSAYGVKLVLPSLLKGLEDKAWRTKQSSVQLLGAMAFCAPQQLSQCLPRVVPKLTEVLTDTHPKVQSAGQLALQQVGSVIKNPEISSLVPTLLLALTDPNEYTRHALDTLLQTTFVNSVDAPSLALLVPIVHRGLRERSSETKKKASQIVGNMCSLVTEPKDMIPYIGLLLPEVKKVLVDPIPEVRSVAARAVGSLIRGMGEDNFPDLVPWLFETLKSDTSNVERYGAAQGLSEVIAALGTDYFENILPDLIRHCSHQKASVRDGYLTLFKFLPRSLGAQFQKYLQLVLPAILDGLADENESVRDAALGAGHVLVEHHATTSLPLLLPAVEDGIFNDNWRIRQSSVELLGDLLFKVAGTSGKALLEGGSDDEGASTEAQGRAIIDILGMDKRNEVLAALYMVRTDVSLSVRQAALHVWKTIVANTPKTLKEIMPILMSTLISSLASPSSERRQVAGRSLGELVRKLGERVLPLIIPILSKGLKDPDVDKRQGVCIGLNEVMASAGRSQLLSFMDQLIPTIRTALCDSALEVRESAGLAFSTLYKSAGLQAMDEIIPTLLEALEDDEMSTTALDGLKQIISVRTAAVLPHILPKLVHLPLSALNAHALGALAEVAGAGFNTHLGTILPALLSAMGGENKEVQELAQEAAERVVLVIDEEGVETLLSELLKGVSDSQASIRRSSAYLIGYFFKSSKLYLIDEAPNMISTLIVMLSDSDSTTVAVSWEALARVIGSVPKEVLPSYIKLVRDAVSTARDKERRKRKGGYVVIPGLCLPKSLKPLLPVFLQGLISGSAELREQAAIGLGELIEVTSEQALKEFVIPITGPLIRIIGDRFPWQVKSAILATLIILIQRGGMALKPFLPQLQTTFVKCLQDSTRTIRSSAAVALGKLSALSTRIDPLVGDLMTSFQAADSGVREAILSAMRGVIKHAGKSIGPAVRVRIFDLLKDLMHHEDDQVRISATSMLGVLSQYLEAAQLSVLLQEVNDLSASQNWGARHGSVLCISSLLKHNPSTIMTSSLFSSMLNSLKSSLKDEKFPLRESSTKALGRLLLKQLATDPSNTKVVIDVLSSIVSALHDDSSEVRRRALSSLKAFAKDNPSATMANISVIGPPLAECLKDGNTPVRLAAERCALHVFQLTKGAENVQAAQKYITGLDARRLSKFPEQSDDSESDDDNVSG

SEQ ID NO: 751 - protein, 1150 aa, Arabidopsis thaliana
MIPNGELRLPALKVREDRVSPSAPIPVTRTLVADTDVTSDDDMSTNSEDVSLDSSPENSRVSSAVGRSYGRNSSYYTYSEVSSSRETLVGAREQTGPRFDGDTEEDESTDSASSTQFSPPPAAGRINDGVSQVEQTHFPKTDRRATVEKEFDETFSSEEVSDIPSAPPFSGAAEESEEIKPATSSVQVSEVKTGDCVESRKTGHFTRPSAASESSGPPDQHPARLPTFHASSRGPWHAVVSYDACVRLCLHAWSTGCMEAPMFLENECALLREAFGLQQLLLQSEEELLAKRSSQAPHEGVAPKPKKNIGKMKVQVRRVKTVMDGPTGCSISSLKPSLIKFEKIRIHFSNMSTRLFSGWRALRKIHVRVPANGSSLPRQSLAYVHASTQYLKQVSGLLKTGVTSLRNNSTSYDIVQETYSCKLRLKSLAEDNAIMMQPGSGESHVFFPDSHGDDLIVEILDPMGKDFGRVLVQLANISEDSAEKLRWWSVFREPEHQHVGKLQLYIDYSASFDDNSHLKCASVAETVAYDLVLEVALKMQRFQQRNLLLYGSWKWLLEEFATYYGISDVYTKLRYLSYVMDVATPTSDCLHLVHDLLTPVIMKGNGKSALSHQENRILNEIKDQIEQILKLVFENYKSLDESSFSGMIDVVNSASGVPAPALIPAVKLYTLLHDVLSPEDQTHLCHYFQAAAKKRSRRHMGETDEFVANNSEPNFWDMSAMSAAYQKMTMACKNVKNEIYTDIEIQNEDILPSFLDLPNLSASIYSTDLCNRLRAFLVACPPSGPSPTVAELVIATADFQRDLSSWNISPIQGGVDAKELFHLYIMIWIQDKRLSLLESCKLDKVKWSGVRTQHSTTPFVDEMYKRLNETIQDYQVIISRWPEYIFVLESAIADVEKATVEALEKQYADVLSPLKENLAPKKLSFKYVQKLTKRSVIPYVVPDELGILLNSMKRMLDVLRPNIEAKFKAWSSCIPDGGNAAPGDRLSEVTVMLRAKFRSYLQAVVEKLVENSKLQKTTMLKKILQDSKESVGESDIRSKMNNLKEQLTNTVNHLHSVCETHVFIALSRGYWDRMGQIVLSFLENRKENRAWYKGSRVAVSILDDTFAAQMQQLLGNSLREQDLEPPRSIMEVRSILCKDPADNKAKSFYY

SEQ ID NO: 752 - protein, 276 aa, Brassica napus
MESSTSLAIVLHQSSNHDELFMQQTLQFSQTLKDLKNLGKQLYSAAEYFETSYGKEEHKETVIETLKEYAAKALVNTVDHLGSVSDKFNSFLSDNSAHFSTTRLRLSSLEQRMKLCREYMGKSGSSQHRFQVQSPHHHKRYFFPQHGRGTSFAAGDDSHRFKSAVRSTILENHPNNARKTNKTGSFSFLHNNISNITPSKITKSPMRFPLIRSGSLLKRSSSPSQPRLLALPEPQRAISMSTSREIVEIQQKSSLRKGKKSLMLKALMSMSSKSRN

SEQ ID NO: 753 - protein, 358 aa, Medicago truncatula
MGKNWWCLIFVTWLCLFDFSDGRELKTRHTSHLAQYNHTLATILVEYASAVYLSDLTQLFTWTCSRCGDLTKGFEIMELVVDVEHCLQAFVGVADDPRAIIIAFRGTNEHSLQNWIEDLYWKQHEINYPDMDDAMVHRGFYTAYHNTTIRPAVLGAVERAKKFYGDIPIIALGHSMGGAMAAFCGLDLTVNKQEKNVQVMTFGQPRIGNGVFVSLYSKLIPNTIRVTNDHDIVPHLPPYYYYLPQKTYQHFPREVWLYNIGLGSLVYRVEKICDGSGEDPSCSRSVSGNSITDHLVYYGVDMGSDDPQTCRIVMNSDVPSTSSIRDSRGNFILSRDPTSSLLKLSREFDNQEKAVSVY

SEQ ID NO: 754 - protein, 277 aa, Medicago truncatula
MTVVRGSVFQLGRRLRLGILNSLKPETNHNNLNTNCSRCLGTSTTPSFQPRNHNAFFSSSASPFPSPFSTGQRRTMFIQTQSTPNPESLMFHPGKPVMDVGSADFPNPRSAMNSPLAKSIFTIDGITRVFFGSDFVTVTKSEDASWEFLKPEIFAAIMDFYSSGEPLFLDSQAASSKDTAIHDDDSETVAMIKELLETRIRPTVQDDGGDIVYCGFDPDTGIVKLKMQGACSGCPSSSVTLKSGIENMLMHYVPEVKGVEQELDGEEEEAALSGQTE

SEQ ID NO: 755 - protein, 1709 aa, Medicago truncatula
MKLNQAGSQLPGLAQLNGNGQMPSLGGVSRSALNMDPEFLRAREFIQEKICETLFRRHQQPISEMQKRRIKDLAKRLEEGMLKYADSKEEYMNLETLESRLSLFLRQATMNNRSQQYPQLVSSSPIGTMIPTPGMSHGPNSNMVVASSIDASMISSSGGNSVVSTTFNGVNILPTGGIHGSSLNRSDGLSNGYQQSSTSFSAGSVGNMSSMSVPRPSSQMIPTPGYTVNSNHSHMNVDSSTNGNVFSSAESTMVPLSQLQQQKQHVSHQSQVLPNIGSQMSSGMRSGLLHKQFTNSNGAVNSGLGLIGNNIQLANEPVTSDGYASSYANSPKHIHQHFDQNQKPVMQGDGYGLNNVDPFASGNFYSSATSSGSMMNTRNTNSVQLPSIPKTSSLISGHSNLHGMQQSAHIKSEAINQLEKLNFQSSSTSRDALLHSQQQYQQRPHQFQQSEQYPQSQQQFQLKLHSQQPQHLVNDNAFNQSQLSSNLENQVKSEPGIEHHKDVLSSHVPEQFHMSEIQNQFQQNSSEDCSRAQYLSFPSGQHNLSSSVPQSSQQMLHPHQLVAESQNKFSCLTVGAQSNSKQWTDSQDGNPMSNNSSHDHHLHVDFHQRISGKDEAHCNNLSSDVSMGQAVAPRGASEPLDPGSTTKNAHRNQQRWLLFLLHARRCSAPEGRCQERFCSFAQKLCRHMDGCTLRHCPYPRCHHTKELFHHFIHCKDPCCPVCVFVKKCRRACQLKAQIQPPSESSLPSVVNGSCKSYNITATSSRLISKPTLVVETSEDLHPSVKRIKIEHSTQSVNLEKDNSASSVSANCDSLVSKDAQSQTYPNAEKSISIKSEITEVKAEVLAHAKLSEMKMDSSNADDKIPDGEPVKNDDPGNLARPENMKTEKEVGQDKQEHVMQPGENAAGTKSGKPKIKGVSLTELFTPEQVREHITGLRQWVGQSKSKAEKNQAMEHSMSENSCQLCAVEKLTFEPPPIYCTTCGVRIKRNNMYYTMGTGDTRHYFCIPCYNDARSEHIVVDGTPIAKSRLEKKKNDEETEEWWVQCDKCEAWQHQICALFNGRRNDGGQAEYTCPNCYIEEVERGERMPLPQSAVLGAKDLPRTILSDHIEQRLFKRLKHERQERARFHGKSYDEVPGADSLVVRVVSSVDKKLEVKQRFLEIFQEENYPTEFPYKSKVVLLFQKIEGVEVCLFGMYVQEFGAESQFPNQRRVYLSYLDSVKYFRPEIKSVTGEALRTFVYHEILIGYLEYCKLRGFTSCYIWACPPLKGEDYILYCHPEIQKTPKSDKLREWYLAMLKKAAKENVVVNITNLYDHFFTSTGECRAKVTAARLPYFDGDYWPGAAEDLIYQLRQEEDGRKQNKKGTTKKTITKRALKASGHSDLSGNASKDLLLMHKLGETISPMKEDFIMVHLQHACTHCCILMVCGNRWVCNQCQNFEICDKCYEAELKREERERHPINQREKHSLYPVEITDVPSDTKDKDDILESEFFDTRQAFLSLCQGNHYQYDTLRRAKHSSMMVLYHLHNPTAPAFVTTCNICYLDIETGQGWRCEVCPEYDVCNSCYQKGGIDHPHKLTNHPSVADRDAQNKEARQVRVLQLRKMLDLLVHASQCRSPHCQYPNCRKVKGLFRHGMHCKTRASGGCVLCKKMWYLLQLHARACKESECHVPRCRDLKEHLRRLQQQSDSRRRAAVMEMMRQRAAEVANNAG

SEQ ID NO: 756 - protein, 427 aa, Solanum lycopersicum
MVRNRREELYVTVPPLFRCPISMDVMKSPISLCTGVTYDRNSIQTWLSQGHNTCPATMQILPSTDFTPNLTLRRLINVWIQHQPASSPGSTTPSSSSVTKTEVVEIVENLNGEVDRLSSLAKIGEFVKCSGENRSFFVNLSDAIANIVGVLVDCDVVEVCEAVVAVLDLVVSENGVKEQLNKEILKSYQKFLPKFLLVLRKGKLSSRIQTARILEFIALDADSQRKMVEEQGLLYELHVFTSTETNRFAIEVGLSTLIAVSTTRLAKKELVRFGIIQTIGKILSNSETARAVVEKSLKLLETVATCAEGRTAIGKGEECLSAIVTRLMKSSKAATEHGVTVLWSVCCLFRHTAAREVVGKANGLTKVLLVMQSDCSAAVRQMCGELVKALRVVNTFSVRTEEVIKIKNYSKSCLASYDTQTTHIMPY

SEQ ID NO: 757 - protein, 569 aa, Solanum lycopersicum
MQKTTLTSTRLLVSLPNWTLMVLKRNINQDSDENSEFPPRESKRQHPSNAFFSGLRSYSSPQELARKLEPLIRSWVREEIEQTLQSTLRSSLNDDETSKSRDIQLLFDDVFPSSLFTGSKLSMENRPIKVLLYDASSNQRITSGPLSSAKVDVVVLNGEFNPSNLEDWSEEEFSKMVIRAREGKRPLLTGDLIIQLRDGVGYLGDLSFTDNSSWIKSRTFRLGVKLNNRSGEFRVREGVSKPFTVRDHRGEAYKKHYPPTLDDEIWRLKKIAKDGASHKRLSKEGISCVKEFLRLFVTDPSLLRKMLACGNNIWEKITEHVSTCPLDNSEWYVYNAGESIVLLFNCIYELVGAILDGQNFQSIDKLDIFQKRMVEDFKRSVYKNLDCLAPLEDHSLIGQAILTSNLQNGLNHIPSSSQQNMNYSDEQGQVEFQSNSDHATISSPLAYTAQQDSPTTVSMPESFNGIQAFNSTLASSFLVGEPCSSIYPGDYDWGSNGSLDSLGMTDYLPPNNNYQFETPVWQGNELLASSSVQPVSPNIGFHITRRGNPRAIWCTIRAVLKWKTLVKRK

SEQ ID NO: 758 - protein, 276 aa, Solanum lycopersicum
MAEDGHKVILNVYDLSQGLARQLSTTFLGKAIEGIWHTGVVVYGHEYYFGGGIQHAPAGTTPYGTPIKVVDLGVTHIPKDVFEMYLQEISPRYTAETYSLLTHNCNNFSNEIAQFLVGATIPEYILNLPNEVTNSPMGALIMPMIQQLESTLRANAVPQAPQFRPATVAPASQPTLSVGKSSSSGINQSKKPESQDGEKKNVNVPSAVKPVEEQEKTPANAVVKDPLGDARNKVQEEITREFAAIMATGTLRASEAAALATKKVMQRYGDTFAAMN

SEQ ID NO: 759 - protein, 257 aa, Solanum lycopersicum
MEEIIEEKKMKILCLHGFRTSGNFLKKQLSKWDPSIFANSEMDFPDGIFAAKGKSDIEGIFPPPYFEWFQYNEDFTEYENLEECITYLCEYITSKGPFDGLLGFSQGATLSGLLLGYMEQGEILKEHPPMKLFVSISGAKFRDPNICNIAYKDMMKVKSVHFIGEKDWLKLPSQELTTDFENPIIIRHPQGHTVPRIDEAAVETLKSWTREVALSSNESCVGGGPNEACKHVNIENGVEQGKKLEKPNEVEIQKAQE

SEQ ID NO: 760 - protein, 124 aa, Solanum lycopersicum
MEVHKRKYIHDGEIEAKKQMKTEEIDGTAAPVTAAAVVEDDEVEEFYAILRRIRVAVKYFEKGNAEGSGAGRNLTAAKPWSPNFRQEELKRAVDGVKERETVEDNAGLDLNADPVTDPSSSEAN

SEQ ID NO: 761 - protein, 310 aa, Solanum lycopersicum
MDGRGGCCIARYAGGAYDMSKVDRIMLKFRPIAPKPAAAGASVSGTTTPPQKSEVPVRTGRWKRRYVKDNKNSNNNKRSSSGGCSPTPSRRKRKARSVEENDSSAKSVSGGETAVTLPLLSEIPERKDNSVDMMKKNAPIWLSFGGNQGNNNDNSNNNNGQLQGVAMDRSVVMFPQPVRVVGSWVKVESVTDAWVEGYGLGRTDEEKLINLERDSCPGFISDGLNRVRWANKAYKGMVGDGAGEVVVWLVMKDAVRLPESKSTAAFTCRVRVVRCGKEKNSLILPCDVWRMDGGGFAWRLDTEAALSLGR

SEQ ID NO: 762 - protein, 243 aa, Brassica napus
MCGGAVISDFAPNVTKAKGRKLTAEELWSELDASAANDFWGFHSTSKTQSTNQQVTLKEEAAEKEKEKEPVTEKRRKRKNVYRGIRKRPWGKWASEIRDPRKGARVWLGTFNTAEEAAMAYDVAAKRIRGDKAKLNFPDLLHHPTRSPATPLASSPVSEVQPPAKKHCVVSQSELTQPSFPVEYSGVGSGDEFQLDYDLKQQISSLESFLELDGDTVEQPSQLDESVSEVDMWMIDDVFASYQ

SEQ ID NO: 763 - protein, 466 aa, Medicago truncatula
MASSITNLNSPKLLPISKEQTNPFSHFPPNTLKFASLSSRTCSNVSCSVTRDTSSVLPLEVENGSVVLQRPDSFGRFGKFGGKYVPETLMHALTLLEASFHSLASDEDFQKELAGILKDYVGRETPLYFAERLTEHYKNANGEGPLIYLKREDLNHTGAHKINNAVAQALLAKKLGKKRIIAETGAGQHGVATATVCARFGLECIIYMGAQDMERQALNVFRMRLLGAEVRPVHAGTATLKDATSEAIRDWVTNVETTHYILGSVAGPHPYPMMVREFHAVIGKETRKQALEKWGGKPDILIACVGGGSNAMGLFHEFVDDSDVRLIGVEAAGFGLNSGKHAATLTKGEVGVLHGAMSYLLQDDDGQIVEPHSISAGLDYPGVGPEHSFLKDLGRAEYHSITDDEALEAFKRVSRLEGIIPALETSHALAYLEKICPTLPNGTKVVVNFSGRGDKDVQTVTKYLKL

SEQ ID NO: 764 - protein, 344 aa, Medicago truncatula
MGTRSQQSCVDEEEEEFIGCGTTISGQSGSTSRSAGGLASSRSEQTIGTAAGDNTALRLNHLDIQDDDAASQGVVASKKKKRGQQRATGGDKSGRGLRQFSMKVCEKVESKGRTTYNEVADELVAEFADPINSVLTPDKQQYDEKNIRRRVYDALNVLMAMDIISKDKKEIQWKGLPRTSLNDIEELKTERLGLRNRIERKSSYLQELEEQFVGLQNLIKRNEQLYSSGNPPSGGVSLPFILVQTRPHATVEVEISEDMQLVHFDFNSTPFELHDDNYVLKAMEFGDRTQSDIVTHNVTDGGEGSSMSGMHQSQVPPSASSVSTRPPTSPPLPGILKARVKQEH

SEQ ID NO: 765 - protein, 762 aa, Arabidopsis thaliana
MVGGGTKRRRRRLQLSKLYTLTCAQACFKQDHSQIGGPGFSRVVYCNEPDSPEADSRNYSDNYVRTTKYTLATFLPKSLFEQFRRVANFYFLVTGVLAFTPLAPYTASSAIVPLLFVIGATMVKEGVEDWRRQKQDNEVNNRKVKVHRGDGSFDAKEWKTLSIGDIVKVEKNEFFPADLVLLSSSYEDAICYVETMNLDGETNLKVKQGLEVTSSLRDEFNFKGFEAFVKCEDPNANLYSFVGTMELKGAKYPLSPQQLLLRDSKLRNTDFIFGAVIFTGHDTKVIQNSTDPPSKRSMIEKKMDKIIYLMFFMVITMAFIGSVIFGVTTRDDLKDGVMKRWYLRPDSSSIFFDPKRAPVAAIYHFLTAVMLYSYFIPISLYVSIEIVKVLQSIFINQDIHMYYEEADKPARARTSNLNEELGQVDTILSDKTGTLTCNSMEFIKCSVAGTAYGRGVTEVEMAMGRRKGGPLVFQSDENDIDMEYSKEAITEESTVKGFNFRDERIMNGNWVTETHADVIQKFFRLLAVCHTVIPEVDEDTEKISYEAESPDEAAFVIAARELGFEFFNRTQTTISVRELDLVSGKRVERLYKVLNVLEFNSTRKRMSVIVQEEDGKLLLLCKGADNVMFERLSKNGREFEEETRDHVNEYADAGLRTLILAYRELDEKEYKVFNERISEAKSSVSADRESLIEEVTEKIEKDLILLGATAVEDKLQNGVPDCIDKLAQAGIKIWVLTGDKMETAINIGYHFLGLLVVCSDKT

SEQ ID NO: 766 - protein, 353 aa, Arabidopsis thaliana
MGSVTGFYSNEVFELDPKWVVDPQHLFVGPKIGEGAHAKIYEGKYKNKTVAIKIVKRGESPEEIAKRESRFAREVSMLSRVQHKNLVKFIGACKEPIMVIVTELLLGGTLRKYLVSLRPGSLDIRVAVGYALDIARAMECLHSHGVIHRDLKPESLILTADYKTVKLADFGLAREESLTEMMTAETGTYRWMAPELYSTVTLRHGEKKHYNHKVDAYSFAIVLWELIHNKLPFEGMSNLQAAYAAAFKNVRPSADDLPKDLAMIVTSCWKEDPNDRPNFTEIIQMLLRCLSTVSSTELVPPAIKRVFSSENTVLPPESPGTCSLMTVRDKDQIPTDANSAQNEVRGSFFFFCC

SEQ ID NO: 767 - protein, 564 aa, Brassica juncea
MVVFGNVSAANLPHQNGVLKAISSGGCDLMGHRSFKISTSFKTRTRRRSAGPLQVVCVDIPRPELENTVNFLEAASLSASFRSAPRPAKPLKVVIAGAGLAGLSTAKYLADAGHKPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVEEWMRKQGVPDRVTDEVFIAMSKALNFINPDELSMQCILIALNRFLQEKHGSKMAFLDGNPPERLCMPIVEHIRSLGGEVRLNSRIRKIELENDGTVKNFLLTDGTTIQGDAYVFATPVDILKLLLPDSWKEIPYFKRLEKLVGVPVINVHIWFDRKLKNTYDHLLFSRSNLLSVYADMSLTCKEYHDPDRSMLELVFAPAEEWISRTDSDIIDATMKELEKLFPDEISADQSKAKILKYHVVKTPRSVYKTIPDCEPCRPLQRSPIKGFYLARDYTKQKYLASMEGAVLSGKFCSQSILQDYELLAAASGPQKLSEATVST

SEQ ID NO: 768 - protein, 320 aa, Brassica juncea
MACKNNLVVKQIIDLYDQISKLECLKPSKNVDTLFGQLVSTCLPTDTNIDVTKMSDEVKDMRSNLIKLCGEAEGYLEQHFSTILGSLPEDQNPLDHLNIFPYYNNYLKLGKLEFDLLSQHSSHVPNKIAFVGSGPMPLTSIVLAKFHLPNTTFHNFDIDAHANTLASSLVSRDPDLSKRMIFHTTDVLNATEGLDQYDVVFLAALVGMDKEAKVKAIEHLEKHMAPGAILMLRSAHALRAFLYPIVDSSDLKGFQLLTIYHPTDDVVNSVVIARKLGGSSMTGVNGTRGCMFMPCNCSKVHAIMNNRCKKLMIEEFSAIE

SEQ ID NO: 769 - protein, 424 aa, Brassica juncea
MATTPMCTEWQFSGSEAAKEAAAAALGAYTSKLMSLCDPNGKPILPPSNKAVETSNSAEKAVVKVILSGTGNAYAPSIGLPLAKSAVAEYLNRDLPKKLTADDVFMTVGCKRAIDLAVDILAKPKANVLLPRPGFPWDVVRSIYKKLEVRYYDFIPEQNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKILQAAHEFLQINAKPPTVIQAAMPDILERTPKHFFHERGSFLKHKVDIGYSKVKHIPGLTCYMKPEACTFLWTKLDVSCFADIEDDQDFCRKLAMEENLVVLPGIAFRQKNWLRHSIDMETPTVEDAFERLKSFCERHSVEGGASLKNVNGVN

SEQ ID NO: 770 - protein, 134 aa, Unknown
  Sequence found in Organisms: Brassica napus, Brassica juncea, Brassica rapa
MGLLDHLWDDTVAGPRPENGLGKLRRHHTFSFRPSSGNDQSDGGSVRSYGEESPEEAVKVTRSIMIIKPPGYQGGSAPVSPAGSTPPVSPFSEQTQEERNPFGLGEGRRRTRSIREQDQRMDQGTLLLLTACDL

SEQ ID NO: 771 - protein, 166 aa, Brassica juncea
MSGSVAQLHNVFVYGSFQEPEVVKVMLDRTPEIIPVTLPGFKRFRLKGRLYPCVIPCEDGEVKGQLLMGLTDEELENVDAVEGNEYERVTVGVVREDNSEKMTVKTYIWLNKDDPDIGGEWDFEEWKRLHMKLFIEKFKEIMEWKRNPQGKGRDDFNHVLRDAPSA

SEQ ID NO: 772 - protein, 557 aa, Brassica juncea
MASLALSGSCSLAFPLKSRSLLLPRPPSSLNLLKKPLRRISSVKSPLSVSLTNSKRSTLVRASSVAAAASSSSSSSPSPAAPAPAPWQGAAIKPLLASIATGVIIWFLPVPEGVTRSAWQLLAIFLATIVGIITQPLPLGAVALLGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGIVSLIVVPFLLYVIYPPTVKSSPDAPKLAQEKLDKMGPMSKNELIMAATLFLTVGLWIFGAKLSVDAVTAAILGLSVLLVTGVVTWKECLAESVAWDTLTWFAALIAMAGYLNKYGLIEWFSQTVVKFVGGLGLTWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 773 - protein, 289 aa, Brassica juncea
MPRYDDRYGNTRLYVGHLSSRTRSRDLERLFNRYGRVRDVDMKRDYAFVEFSDPRDADDARHYLDGRDFDGSRITVEFSRGAPRGSRDYDSRGPPPGSGRCFNCGVDGHWARDCTAGDWKNKCYRCGERGHIERNCKNSPKKLRRSGSYSRSPVRSRSPRRRRSPSRSRSLSRSRSYSRSRSPVKRRERSAEERSRSPKRMEDSLSPRGRDRSPIMDDEGSPRIIDGSPPPSPKLEKQDHDGGSPQDNGNGRKTNASPVVGRDSPREDRSPVDDDYEANRASPRGSESP

SEQ ID NO: 774 - protein, 464 aa, Medicago truncatula
MELSIMLCFFTSILFIVLFRIFIKSFVSKRHDLPLPPGSMGWPYIGETFQLYSQDPNVFFASKIKRYGSMFKSHILGCPCVMISSPEAAKFVLNKAQLFKPTFPASKERMLGKQAIFFHQGEYHANLRRLVLRTFMPEAIRNIVPAIESIAEESLKSMEGRLITTFLEMKTFTFNVALLSIFGKDEVNYREQLKQCYYTLEKGYNSMPINLPGTLFHKAMKARKELAQILAQIISSRREKKQDYQDLLGSFMDEKSGLSDEQIADNVIGVIFAARDTTASVLTWIVKYLGENINVLESVIEEQESILKSKEENGEEKGLNWEDTKKMVITSRVIQETLRVASILSFTFREAVEDVEYQGYLIPKGWKVLPLFRNIHHSPNNFKDPEKFDPSRFEAATKPNTFMPFGSGIHACPGNELAKMEILVLLHHLTTKYRWSVEGTKNGIQYGPFALPQNGLPITLYPKK

SEQ ID NO: 775 - protein, 330 aa, Medicago truncatula
MASFSAKSMTVFFLFTIIFGFGFLHASAELQRFTHTPKTDGSLSFLVIGDWGRKGEYNQSDVAFQMGVVGEKLDIDFVISTGDNFYDDGLTGDHDTKFEESFTKIYTAKSLQKQWYSVLGNHDYRGNVEAQLSPFLRQIDNRWLCLRSFIVDSELVEIFFVDTTPFCEDYFTVPEHQYDWNGINPPKTYISNLLKDVEMALRESRAKWKIVVGHHAIRSVGHHGDTKELVNLLLPILQANHVDFYMNGHDHCLEHISDTNSPIQFLVSGAGSKAWRGDVRETGNDVNFFYDGQGFMSVQLTGTDADIVFYDVSGMVLHKTTSSKQLHSSI

SEQ ID NO: 776 - protein, 488 aa, Glycine max
MSLSLAIKLHLASSSPSFSLLTLNNHQHANKLTTSETCSNTKVRPKPIYSTNPLIIPTCKVRPRVQYCGTMIKSSLIEPDGGALVDLVVPEGERGAKITLAESLPKVQLTRIDLEWVHVVGEGWASPLKGFMREDEYLQSLHFNSLRVKDGSVVNMSLPIVLAIDDETKERIGSSSHVGLLGPDGDCVAILRSIEIYKHNKEERIARTWGTTAPGLPYVEEVITPAGNWLIGGDLEVLKPIKYNDGLDNYRLSPKQLREEFDKRQADAVFAFQLRNPVHNGHALLMNDTRKRLLEMGYKNPILLLHPLGGFVKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTKVNKMAFFDPTRAKDFLFISGTKMRAFAKSGENPPEGFMCPSGWKVLVKYYESLQAEEPSQQPVLST

SEQ ID NO: 777 - protein, 682 aa, Solanum lycopersicum
MAHDSDLPCDGDGVCMACKVKPSENESLICKTCATPWHVSCLSTPPDSMGDAVNWECPDCSMPPAAVVVPVKQNAVATSSSEGRGDLIAAIRVIESDSTLTEQEKAQKRQDLMSGSSKDEDVAVEGANQDKDVLNILDGSLNCSMCMQLPERPVTTPCGHNFCLKCFQKWVGQRKSTCANCRTPIPAKMASQPRINSALVIAIRMARMMRSGASSGSSKVSHFVHNQNRPDKAFTTERAKKTGKANACSGKIFVTIPGDHFGPITAENDPERNVGVMVGETWEDRFECRQWGAHFPHVAGIAGQSDYGAQSVALSGGYEDDEDHGEWFLYTGSGGRDLSGNKRTNKLQSFDQKFEKLNEALRVSCLKGYPVRVVRSHKEKRSSYAPDKGVRYDGVYRIEKCWRKPGKQGFKVCRYLFVRCDNDPAPWTSDEQGDRPRALPSIKELKGATDMTERKGSPAWDYDEEKSCWMWKKAPPPSRKPVQCENEDGTKVRPVRPKRLTMSVKQRLLKEFTCHLCREVMNNPLTTPCAHNFCKACLDGAFAGQSFTRQRTCEGRRTLRAQKNIMKCPSCPTDISDFLQNPQINRELMNVIESLKRQIEEENAALSADVDDGSLDGNEILAETDKSMEDDEEGAQPVNETEAKQTNKRKRSGSIDNASSPKKSIDKSDAVHNLEEVDPAHT

SEQ ID NO: 778 - protein, 431 aa, Arabidopsis thaliana
MEVGFKALLDDLDVLEKSLSDPALINKLRSHVENLATLSKCNPHRRSKVKELSSEVVDSNPYSRLMALQRMGIVDNYERIREFSVAIVGIGGVGSVAAEMLTRCGIGRLLLYDYDTVELANMNRLFFRPDQVGMTKTDAAVQTLAEINPDVVLESFTMNITTVQGFETFTSSLTNKSFCPSKEGGSGVDLVLSCVDNYEARMAVNQACNELRQTWMESGVSEDAVSGHIQLLVPGETACFACAPPLVVASGIDERTLKREGVCAASLPTTMGVVAGLLVQNSLKFLLNFGEVSPYLGYNSLKDFFPTMKMRPNPQCSNVACLERQKEYMLAKPERDAAAKAKMEADASTTIDEGPLHDDNEWNISVVDDENEKDTTKAASSSDTLPEGLTRELPVADEYEKAIAIASGSGETEEEDDLEDLKKQLEALNAA

SEQ ID NO: 779 - protein, 819 aa, Arabidopsis thaliana
MEDGEIEEGMVTADEFPTPEVTTIETIQPPREPGKSPLELLRESKTSVEEIVAKMLSMKKQGNHKSEIRELLTQMFLNFVNLRQANRAILTEEDKVKAETERAKAPVDFTTLQLHNLMYEKSHYVKAIKACRDFKSKYPDIDLVPEQDFFRHAPEAIKDQSLSSDSSHVLMPKRLNFELHQRKELCKHRARLEQQKKSLLETIAERKKFLTSLPLHLKSLKKASLPVQNHLGIQHTKKLKQHNLAELLPPPLYVLYSQLLAQKEAFEESIELEVVGSLKDAQAYARQQSRKDSGMSSNTESSRLEDDGPDDDDDGQRRRKRPKKLTSKEGSDKAGLYQVHPLKIVLHIYDDEIPDTKSLKLVILKFEYLLKLNVVCVGAEGSQDGPEKNIFCNLFPDDAGLEPPHQSTKLILGDGQTFDENRTSRPYKWVQHLAGIDISPVLLGQEAHNTDPAKSDTFVPDLSLYRQQHRVQTVLRRIRLRKKAHLALAEQLDLLMKHELPVVNCEDAPWALHKVLCALDSWLHIQSSASKSCSLTLNSVEQVPEPMEIDVDGRSISGKEDFESIREDGELPSLVTAAASLTSSNHTPSKVSNQARSRQLALMTKNLDSPISKGKSPSFKKYEDDLDLVLDDDSEIDEPTGRTEAHVEELCPEKADNSWVDYGSREFALVFSRKTDGGKLWKLEAMVQISMEYPLRPPLFSLSLHASSSSGNENGTNESDHYNELRAMEAEVNLHMLKIIPSDQENYLLSHQIRCLAMLFDYYVDDPSPDSKRGTATTVVDVGLCKPVDGKLLVRSFRGRDHRKMISWKGRGCASGYPC

SEQ ID NO: 780 - protein, 162 aa, Brassica juncea
MTIALTIGGNGFSGLSGSSFSSSSSSFRLKNSRRKDTKMLNRTGVVCSSSSVMDPYKTLQIRPDSSEYEVKQAFRQLAKKYHPDVCRGSNCGVQFQTINEAYDIVLKQIKNQMEGTEEFEPFDVYDEGFNGMNDPDCDTWEEWMGWEGAGTRDYSSHINPYA

SEQ ID NO: 781 - protein, 378 aa, Brassica juncea
MAKMMMMQQSQPSLSLLTSSVSDFNGAKLHLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVDGLTDSYNLDFGRGTFRKEADFTTDDMILSKKLVLQ

SEQ ID NO: 782 - protein, 228 aa, Brassica juncea
MEEGDFFSCFSEINSGMTMNKKKMRKGTNHKRFSEEQIKSLEVIFESETRLEPRKKVQLARELGLQPRQVAIWFQNKRARWKSKQLEKEYDILRANYNNLASQFEIIKKEKQALVSELQRLNEEMQKTKEERNEECCGEQRVALSSSTWSDNGKYEPEVRLNQGIVLCNDDIKTEYFGFEEESNHELINIVEQADDSGLTSSDNWGNFNSESLLDQSSSNYPWWDFWS

SEQ ID NO: 783 - protein, 195 aa, Brassica juncea
MAEETKNVEVPKVESEESSAAATEVTDRGLFDFLGKKKDETKPEETAIASEFEQKVHVSEPAPEVKHEEEEEEKKHHSLLEKLHRSDSSSSSSSEEEGEDGVKRKKKKDEKKVTTEGEVKTEEEEKKGFMDKLKEKLPGHGKKPEDATPAAPVVAPPVEEAHPAEKKGILEKIKEKLPGYHPKTVEEEKKDKDDH

SEQ ID NO: 784 - protein, 220 aa, Brassica juncea
MGSEGPTAVTINITGFKKFHGVAENPTEKMANNLKEYLAKNPQSKDVVLGSCTVLETAGQGALASLYQLLQSAINTKESESVTCGKTIWVHFGVNSGATKFAIEQQAVNEATFRCPDELGWKPQHLPIVPSDGPISTVRKTTLPVEEITKALEKKGFEVITSDDAGRFVCNYVYYHSLRFAEQNKTYSLFVHVPLFVAVDEETQMRFTASLLEVLTSVCK

SEQ ID NO: 785 - protein, 143 aa, Unknown
  Sequence found in Organisms: Brassica napus, Brassica juncea
MATTSTSTGDIKKTKSVEVKKKLNVLIVDDDTVIRKLHENIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 786 - protein, 225 aa, Unknown
  Sequence found in Organisms: Brassica juncea, Brassica rapa
MATNEPEHEHRYAEESGANEDEDTGAQVAPIVRLEEVAVTTGEEDEDAVLDLKSKLYRFDKEANQWKERGAGTVKLLKHKSTGKIRLVMRQSKTLKICANHFVKQGMSVQEHVGNEKSCVWHARDFADGELKDELFCIRFASIENCKAFMQKFNEVAESEVEKEESKDASDAAGLLEKLTVEETKTEEKPVEKVKTEVEPEEKTKTEPEKADEEKKTEEAVAPST

SEQ ID NO: 787 - protein, 249 aa, Brassica juncea
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVTFIFEKVCVFLPEEVKTREVPVEEVKAEEPAKTEEPVKTEEPAKTEEPVKTEETSGEKEKEIVEETKKEEIVATSAVEEKKPEVEKEEEKKPVVEEVKKEEAASAPAVVETPVTAPETTTPAPVAEPPKP

SEQ ID NO: 788 - protein, 842 aa, Zea mays
MRRWWPAALLGCAVAVSVLVAAVECAVTYDKKAVLIDGQRRILFSGSIHYPRSTPDMWEGLIQKAKDGGLDVIQTYVFWNGHEPTPGNYYFEERYDLVRFIKTVQKAGLFVHLRIGPYICGEWNFGGFPVWLKYVPGISFRTDNEPFKTAMQGFTEKIVGMMKSENLFASQGGPIILSQIENEYGPEGREFGAAGQAYINWAAKMAVGLGTGVPWVMCKEEDAPDPVINACNGFYCDAFSPNKPYKPTMWTEAWSGWFTEFGGTIRQRPVEDLAFAVARFVQKGGSFINYYMYHGGTNFGRTAGGPFITTSYDYDAPIDEYGLVREPKHSHLKELHRAVKLCEQALVSVDPAITTLGTMQEARVFQSPSGCAAFLANYNSNSYAKVVFNNEQYSLPPWSISILPDCKNVVFNSATVGVQTSQMQMWGDGASSMTWERYDEEVDSLAAAPLLTTTGLLEQLNVTRDSSDYLWYITSVDISSSENFLQGGGKPLSLSVQSAGHALHVFVNGQLQGSAYGTREDRRIKYNGNANLRAGTNKIALLSVACGLPNVGVHYETWNTGVGGPVVLHGLDEGSRDLTWQTWSYQVGLKGEQMNLNSIEGSSSVEWMQGSLIAQNQQPLAWYRAYFETPSGDEPLALDMGSMGKGQIWINGQSIGRYWTAYADGDCKECIYTGTFRAPKCQSGCGQPTQRWYHVPKSWLQPTRNLLVVFEELGGDSSKIALVKRSVSSVCADVSEDHPNIKNWQIESYGEREYHRAKVHVRCARGQSISAIKFASFGTPTGTCGDFQQGDCHSANSHTVLEKKCIGLQRCVVAISPESFGGDPCPSVTKRVAVQAVCSPAA

SEQ ID NO: 789 - protein, 354 aa, Brassica juncea
MEVSGVVLRQIPCVSGSVTDGRYSGLRFSGNTRTTVGFRTRRFRGIMCNNEFADKGHMSYYSGTARCGGEGKDKVKVMEKEKKKDMKKKAKVLKALSKNLNMFSSIGFGLDPDAGLVAEIQNKTISEATEILVKQLDQLKAEEKLLKKQRKEEKAKAKALKMMTEMDSESSSSSESSDSDCGKGKVVDMSSLRNKPILEPLEPESSVATLPRIEEYADSCKNTGEALKLALLQSAAASTAFPSIVNPGLPLKTVEAVPVVGLPSKRIEVCMGGKCKKSGGAVLLDEFQKAMTGMEGSAVGCKCMGKCRDGPNVRVVNETEDAVMTDSVRTPSKTVCVGVGLQDVETIVTSFFGE

SEQ ID NO: 790 - protein, 166 aa, Unknown
  Sequence found in Organisms: Brassica juncea, Brassica rapa
MALRMWASSTANALKLSSSASKSHLLPAFSISRCFSSVLEGLKYATSHEWVKHDGSVATIGITDHAQDHLGEVVFVELPEEKSSVSKEKNFGAVESVKATSEILSPISGEVIEVNTKLTDSPGLINSSPYEDGWMIKVKPSNPAELETLMGSKEYTKFCEEEDAAH

SEQ ID NO: 791 - protein, 628 aa, Brassica juncea
MATKPGILTDWPWTPLGNFKYIVIAPWAVHSTYRFVTDDPVDLGYSLVLPFLLFRILHNQVWISLSRYYTTKGKRRILDKGIDFNQVDRETNWDDQILFNGLLFYIGIMLLPQAKQLPLWRTDGVLMAAMLHAGPVEFLYYWLHKALHHHFLYSRYHSHHHSSIVTEPITSVIHPFAEHIAYFILFAIPLLTTLLTRTASIASFAGYVIYIDFMNNMGHCNFELVPKRLFHLFPPLKFLCYTPSFHSLHHTQFRTNYSLFMPLYDYIYGTMDETSDTLYEKSLERGEDRVDVVHLTHLTTPESIYHLRIGLASFASYPFSYRWFMRLLWPFTSLSMLFTLFYASLFVSERNSFEKLNLQSWIIPRYNLQYLLKWRKDAINNMIEKAILEANKKGVKVLSLGLMNQGEELNRNGEVYIHKHPEMKVRVVDGSRLTAAVVINSLPKSTTKIVMTGNLTKVAYTIASALCQRGVEVLTLLPEEYEKLRSLVPQECRDRLVLLTSETLASNKVWLMGEGTTREEQEMATKGTLFIPFSQFPLKQLRRDCIYHTPPALIIPKSLVNIHSCENWLPRKAMSATRVAGILHALEGWEMHECGTSNILLSDLDQVWEACLTHGFQPLLLPHHFQYP

SEQ ID NO: 792 - protein, 170 aa, Brassica juncea
MARFTVLIAAVVLAFVVAVPEVTAKKYTVGENKFWNPNINYTIWAQGKHFYLGDWLYFVFDRNQHNILEVNKTDYENCNADHPLVNWTRGAGRDIVTLNVTKHYYLLDGKGGCYGGMKLAVKVEKLPPPPKAAPVKSIGSVSMATGVAQFVIPFALFSVSTVWDAILRMW

SEQ ID NO: 793 - protein, 549 aa, Arabidopsis thaliana
MVGMSMQPYGIQSMLKEGYRHLSGLDEAVIKNIEACKELSTITRTSLGPNGMNKMVINHLDKLFVTNDAATIVNELEIQHPAAKLLVLAAKAQQEEIGDGANLTISFAGELLQNAEELIRMGLHPSEIISGYTKAVSKAVEILEQLVETGSETMDVRNKDEVISRMRAAVASKQFGQEEIICSLVTDACIQVCPKNPTNFNVDNVRVSKLLGGGLHNSCIVRGMVLKSDAVGSIKRMEKAKVAVFAGGVDTTATETKGTVLIHSAEQLENYAKTDEAKVEELIKAVAESGAKVIVSGGSIGEMALHFCERYKIMVLKISSKFELRRFCRTAGAVAHLKLSRPSPEDLGYVDSISVEEIGGVTVTIARNEEGGNSISTVVLRGSTDSILDDLERAVDDGVNTYKAMCRDSRIVPGAAATEIELAQRLKEYANAEIGLDKYAITKYAESFEFVPKTLADNAGLNAMEIIAALYTGHGSGNTKLGIDLEEGACKDVSETKVWDLFATKLFALKYASDAACTVLRVDQIIMAKPAGGPRRDAAQAAGAGAEED

SEQ ID NO: 794 - protein, 463 aa, Arabidopsis thaliana
MNPSHGGDDKQRPAMYPQVDQSIPDNPFASTNPYVASSPYLYPSLSSHNLGPNLFPDHGDASNDQSPSAPPQATEEVLIRVPGAILNLIDKSYSVELACGDFTIVRIIQGQNIVAVLANVGNEIQWPLTKNDVAAKVDGSHYFFSIHPPKEKGQGSGSDSDDEQGQKSKSKSDDEILNYGLTIASKGQENVLLVLDQVLRDYSCFTEQRMSEKAKETGEEVLGNSVVADTSPEELKGERKDVVEGQCAAYWTTLAPNVEDYTHSTAKMIASGSGKLIRGILWCGDVTVERLKKGNEVMKNRLSRAEKEKDVSPETLRRIKRVKRVTQMTEKVATGVLSGVVKVSGFITGSMANSKAGKKLFGLLPGEIVLASLDGFSKICDAVEVAGKNVMSTSSTVTTELVNHRYGTKAAEATNEGLDAAGHAFGTAWVAFKIRKAFNPKNVIKPSSLAKSVSELKAKKGSK

SEQ ID NO: 795 - protein, 245 aa, Hordeum vulgare
MKGGDIEAGYADAAASKGAALYPGATESPELRWALIRKVYVVLCLQLLLTAVVAVVVVRVRAIPRFFVSSYAGLGLYVFFLILPFIVLCPLSIYRQKHPVNLLLLGVFTVAISFSVGLTCAFNSGKVILEAGILTVVVVLSLTVYTFWAAKRGKDFSFLAPFLFASLSMLLVFGLIQIFFPLGKLSHTIYGALAALIFSGYIVYDTNNIIKRYTYDDYVWAAVSLYLDIINLFLGLLTLFRAADS

SEQ ID NO: 796 - protein, 169 aa, Hordeum vulgare
MAAAGDAGEKRMVTLKSSDGEEFEVEEAVAVESQTIRHLIEDDCADNGIPLPNVNSKILSKVIEYCNKHVQAKPADAAGPGASDAPPPADDLKNWDAEFVKVDQATLFDLILAANFLNIKGLLDLTCQTVADMIKGKTPEEIRKTFNIKNDFTPDEEEEIRRENQWAFE

SEQ ID NO: 797 - protein, 195 aa, Arabidopsis thaliana
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMEMEQLVGESEKLRMIKLEELSKSIETV

SEQ ID NO: 798 - protein, 125 aa, Brassica juncea
MAGRLSGVASRIMGGNGIVARSGASSLRQRAGMGLPVGKHIVPDKPLSVNDELMWDNGTAFPEPCIDRIADTVGKYEALGWLCGGLGFFATLGMLAVVNDKASKVPFTPRVYPYDNLRVELGGEP

SEQ ID NO: 799 - protein, 389 aa, Brassica juncea
MANGAGRVDLDGKPIKPMTICMIGAGGFIGSHLCEKLLTETPHKVLALDVYNDKIKHLLEPDTAEWKDRIQFHRINIKHDSRLEGLVKMADLTINLAAICTPADYNTRPLDTIYSNFIDALPVVKYCSENNKRLIHFSTCEIYGKTIGSFLPKDHPLREDPSFYVLKEDVSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYAKVSGEGAIESPTVDVSSKEFYGEGYDDSDKRIPDMTIINRQLGWNPKTSLWDLLESTLTYQHRTYAEAVKKATSKPVAS

SEQ ID NO: 800 - protein, 388 aa, Brassica juncea
MSDNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDYTSPTFASSMQNSVPAITFLMAALLRIEKVRINRRDGISKVLGTALCVAGASVITLYKGPTIYTPTSNLHAHLLTTNSVASAVLAPLGDAAPKNWTLGCIYLIGHCLSWSGWLVFQAPVLKSYPARLSVTSYTLLFGIIQFVIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRGSITTPLLHQSTNNV

SEQ ID NO: 801 - protein, 496 aa, Brassica juncea
MAMIGLLEVFAAFFFFLVFKHFFLPKKSPGQPILKSWPVLGMLPGMLPHIPRIFEWTFEVLEATNLTFFFKGPWLSGTDMLFTADPRNIHHILSLNFGNYPKGPEFKKIFDVLGDGILSADLELWEDLRKSNHAIFHHPDFLKLSASSNTLKLKEGLVPFLDNAAHENIVIDLQDVFKRFMFDTSSISLTGFDPMSLSTEMPEVEYGEATETGEEAIYYRHFKPVILWRLQNWLGIGLERKMRSSLVTVNRMFAKIISTRREEISSGEGEQLMDALTYYINVDTTKYKLLKPSNDTFIRDVAFSLLLAGRDTTSSVLTWFFWLLSKHPHVMTKIRQEINTKFDPTDLEKLVYLHATLNETMRLYPPVPFNHKSPLKSDVLPSGHKVKAESKIVICIYALGRMRSVWGEDALDFKPERWISESGELKHEPSYKFMAFNAGPRACLGKHLALPQMKIVAVEIIQNYDFKVTEGHKIEAVPSIVLRMKNGLSVTVTKKM

SEQ ID NO: 802 - protein, 349 aa, Brassica juncea
MSYEKELAAAKKAVALAASLSRGVQKTLMQSEVWTKSDKTPVTAADYGSQAVVSLVLERELKPVTLSLVAEEVDTGDLRKKGSEEFLEGITKLVRDTLASDESYADSPVTAEDVLNAIDCGKSQGGSSGCHWVLDPIDGTRGFVRGEQYAVGLALLVEGKVVVGVMACPNLPLSSAVVEKDDKSCQDNVGCLFFAATGSGAYVQPLNGNSPPQEVRVSSNENLEEAKFLESYHMPIPLHSSIAKKLGITALPVRIDSQAKYAAVSRGDAEMYLRFTLVGYREWIWDHAAGSIITTEAGGVVCDVEGTPLDFSKGKRLDHNRGIIVTTKKLKPLILKAVRESMEEENLRV

SEQ ID NO: 803 - protein, 1077 aa, Brassica juncea
MLRTASCSASLTSASPFFRHFPLSYSSLSSSTGALRAPGRNLRRVASPASTGRRVFLRRGLRVPSTAGRGVNRQLSRLSVRAVATQPAPSYPDVGQDEAEKLGFEKVSEEFISECKSKATLFKHKKTGCEVMSVSNEDENKVFGIVLRTPPKDSTGIPHILEHSVLCGSRKYPLKEPFVELLKGSLHTFLNAFTYPDRTCYPVASTNTKDFYNLVDVYLDAVFFPKCVDDVHTFQQEGWHYELNDPSEDISYKGVVFNEMKGVYSQPDNILGRIAQQAISPDNTYGVDSGGDPKDIPNLTFEEFKEFHRKYYHPSNARIWFYGDDDPLQRLRILSEYLDMFEASPSRDTSKIETQKLFSEPIRIVEKYPAGRDGDLKKKNMVCINWLLSEKPLDLETQLALGFLDHLMLGTPASPLRKILLESGLGEALVSSGMSDELLQPQFSVGMKGVSEDNVQKVEELIMSTLKKLAEEGFESDAVEASMNTIEFSLRENNTGSFPRGLSLMLQSIAKWIYDMDPFEPLKYTEPLKALKARIAEEGSKAVFSPLIEQFILNNSHRVTIEMQPDPEKASQEEAEEKSILEKVKAGMTEEDLAELARATEELRLKQETPDPPEALRCVPSLNLSDIPKEPTYVPTEVGDINGVKVLRHDLFTNDIVYAEVVFDMGSLKHELLPLVPLFCQSLLEMGTKDLSFVQLNQLIGRKTGGISVYPLTSSVRGKDEPCSKIIVRGKSMAGRADDLFNLMNCLLQEVQFTDHQRFKQFVSQSIARMENRLRGSGHGVAAARMDAMLNIAGWMSEQMGGLSYLEFLRTLEKKVDEDWEGISSSLEEIRRSLLAKNGCIVNMTADGKSLSNIEKSLEKFLDLLPENPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVGSYQLPDAKGYSSLMRHLLGVTDEERLRKREEILTTSLKDFKDFAEAIDVVRDNGVAVAVASAEDIDAANNARSNFFEVKKAL

SEQ ID NO: 804 - protein, 1032 aa, Brassica juncea
MKETRISSRKRRADRGEDRRKDKEKEQAGGGVVNERLPLRLFATDRYPSKRHNCNSSLEYLLLVRDVLEGTDEMEQMMGSCFGHLFRLPLRRCAFSGKLVHGMLTRQLVTKKRFELWPVFGGMPTRFSLAEFGHVTGLPCGEFEAGYVVDDQTRPKKSDYAYWDILFGGKRDVTIADVAAMVASDKEMPASRKLKLCLIIIVDGVLLATTQYPKPTVKHVKRLANLRSFLSFPWGRESFWWTISSMLPPPRVMGRCDDPEGEFCRKLRQKTLSLAGFPLALQLWAFEAIPGLVKRLGGNDQQDLLSYAGEKLPQHTGLSLSAVLDAEFDPELSVQPMVEVAEDKEEGWGEFDCEINDRKVVYMVEQLKTGHRFEKWAWGGGDSGEPEYVHEVVEKEKEKKRKTRHPGNKEVEAPVLKQRRLSRYFNRKGDGDGGRLAALEVKMEEMSGVVADLKKIVARQGRMLRKRRTLDRKTGKFSRSMLSRQRKSQRNVATGQRRLFDESDAKDSEEEGALDKETDFGGNDSEPEGMKESAIVPLKVAKRGDATKDGHQVYFGSSSNTFYVTEDKDGDVSGDIGIEGAAAACGTYVDLGGLDQLVGAIVHGAEAEGKGGESKGADVEDKCRGQNVPEVEKEKDGKRQTVGDGAAKEDAVNREEGERERKIGEVEEKEMVAGKKDGSVDKKGEDDEGEAGREDVAAKGERGSPEQQVPATEADDYSRDDEHGLDAADEVMELSDSSPCKRSAKHEPAEREGDLASLLLAKESFTLDKIVPETEDGDFPFFERVLLANPKVLHLNAGKYDLENHFFLDLATAEKWVSTKHMEVLVDYVASRHEERLKERRSLFLPPWFAAHLQGKSRRFNAARANKGKVLVDGRLTGLLTKEGKRWGHEVDRLYAPMIWDENHWVGLCISLVDWRVLVLDPNPGLRDMSAVGILMDPVLKMLPYLVEKVCPPPAEGAYKLDPFNCERMGGVYENTRSGDCGPVSIKFMELHAVGNPHPGMEGLSDALVDIMRKQFAMDVYKDWVVPLYIGG

SEQ ID NO: 805 - protein, 479 aa, Brassica juncea
MGKKKFIDKKKAATFELCPRDTSDPLYSDAPGGDKIFLRVDQNPVNINGFAEDNSQFDDAPEEGEEDLAYGYSSFAGSSSNNPLPADVRKEILELGYPDDGYNYLDHLREIKNTGGGSNFYANPKFEGEYLPRDVKAYDASRVKVSGVVVDGEDDKLMYSVASKTVNVKVKKAIDPEVAALLEDSDGSEFGSDVEDLEEDFVVRANLAEEGEGCSGVSHEEFARPPVAAENNQRVPRQIDELFDQLELNEYGSESDYDGEEEEGEEFKAQSVGDFIYEKPKDYELDEKYMNPADLLKNSDSAKDKEELEYIIRRSVQYGENLVNSNEDEFVEVVEESSDESEKWDCETIVTTYSNLDNHPGLICDPESARKKLSEALAKAKSLNGGSRIITLQGKEKLPVEFLPGRRAEQTSMKPKAEPVKRKTHGQETKEEKKERKAAVKTEKREARKMKKETKELYRFETQRAQKAVAVSGPSSIPL

SEQ ID NO: 806 - protein, 359 aa, Brassica juncea
MAEHHHRIRVYLASAILLLAVINTGIAAENLSQQKLTSRILQNEIVKEVNENPNAGWIAAFNDRFANSTVAEFKRLLGVKPTPKNEFLGVPVVSHDIDISLKLPKEFDARTAWSQCSSIGRILDQGHCGSCWAFGAVESLSDRFCIKYNMNISLSVNDLLACCGFLCGQGCNGGYPISAWRYFKHHGVVTEECDPYFDNTGCSHPGCEPAYPTPKCVRKCVSGNQLWRESKHYGVSAYKVRHGPQDIMAEVYKNGPVEVAFTVYEDFAHYKSGVYKHITGANIGGHAVKLIGWGTSDDGEDYWLLANQWNRSWGDDGYFKIKRGTNECGIEHGVVAGLPSDRNVFNGINTSDDVLVSSF

SEQ ID NO: 807 - protein, 739 aa, Brassica juncea
MGTSVQVSPLCGVYNENPLAYLVSIDGFNFLLDCGWNDLFDPSLLEPLSRVASTVDAVLLSHPDTLHLGALPYAMKQLGLSAPVYATEPVHRLGLLTMYDQYLSRKQVSDFDLFTLDDIDSAFQNVIRLTYSQNFHLSGKGEGIVIAPHVAGHMLGGSIWKITKDGEEVVYAVDYNHRKERHLNGTVLQSFVRPAVLITDAYNALYTNQTQSHHRDTEFLDTISKHLEVGGNVLLPVDTAGRVLELLLILEQHWSQRAFSFPIYFLTYVSSSTIDYVKSFLEWMSDSISKSFETSRDNAFLLRHVTLLINKTDLDNAPPGPKVVLASMASLEAGFARDIFVEWANDPRNLVLFTETGQFGTLARMLQAAPPPKFVKVTMSKRVPLAGEELIAYEEEQNRLKREEALRASLVKEDETKASHGPDDNSSEPMVIDTKTTHDVVGSHGPAYKDILIDGFVPPSSSIAPMFPFYDNTADWDEYGEVINPDDYVIKDEDMDRGAMHAGGDVDGRLDEATASLMLDTRPSKVISNELIVTVSCSLVKIDYEGRSDGRSIKSTIAHVSPLKLVLVHATAEATEHLKQHCLNSICPHVYAPKIEETIDVTSDLCAYKVQLSEKLMSNVIFKKLGDSEVAWVDSEVGKTESEKRCLQPMASAAAPHKPVLVGDLKMQDFKQFLASKGVQVEFAGGGALRCGEYVTLRKVGPTGQKGGASGPQQILIEGPLCEDYYKIRDYLYSQFYLL

SEQ ID NO: 808 - protein, 704 aa, Brassica juncea
MATCPPFDFSAKYYNGGGSGCERRSSFFGDTTVLDQGVGYAVILGFGAFFAVFTSVLVWLEKRYVGAQHTSEWFNTAGRNVKTGLIASVIVSQWTWAATILQSSNVAWQYGVSGPFWYASGATIQVLLFGVMAIEIKRKAPNAHTVCEIVKARWGTATHIVFLVFCLATNVVVTAMLLLGGSAVVNALTGVNIYAASFLIPLGVIVYTLAGGLKATFLASYVHSVIVHVVLVVFVFLVYTSSSELGSPSVVYDRLRDMAAKSRICTEPLSHHDQACGPVDGNYKGSYLTMLSSGGAVFGIINIVGNFGTVFVDNGYWVSAIAARPSSTHKGYLLGGLVWFAVPFSLATSLGLGALALDLPISADEANRGLVPPATAIALMGKSGSLLLLTMLFMAVTSAGSSELIAVSSLFTYDIYRTYINPRATGKQILKVSRSAVLGFGCFMGILAVILNKAGVSLGWMYLAMGVLIGSAVIPIAFMLLWSKANAFGAILGSISGCVLGIVTWLSTAKIQYGRVDLDTTGRNAPMLAGNLVAILTGGFIHAVCSLVQPQNYDWSTTREIKVVEAEAPGDDIDVPVEELKEEKLRRAKAWIVKWGLVFTLLIVVIWPVLSLPARVFSRGYFWFWAIVAVAWGTIGSIVIIGLPLIESWETIKSVCMGMFTNDRLMNKLDDLNHRLQALTKAVPEAERIYLLEIEKTKKTDEES

SEQ ID NO: 809 - protein, 337 aa, Brassica juncea
MGVDYYNVLQVDRNASEDDLKKAYRKLAMKWHPDKNPNNKKDAEAKFKQISEAYEVLSDPQKKAVYDQYGEEGLKGNVPPPGAGGATYFSTGDGPTSFRFNPRNADDIFAEFFGFSRPFGGGGGGTRFSSSMFGDNIFASFGEGGGGVGGAMHHGGARKAAPIENKLPCSLEDLYKGTTKKMKISREIADVSGKTMPVEEILTIDVKPGWKKGTRITFPEKGNEQPGVTPADLVFIIDEKPHPVFTREGNDLIVTQRISLVEALTGYTVNLKTLDGRRLTIPVTNVIHPEYEEVVPKEGMPLQKDQTKRGNLRIKFNVKFPTRLTLEQKTGVKKLLG

SEQ ID NO: 810 - protein, 680 aa, Brassica juncea
MDSESWKLLRSVCILSFLLGSFCVYQSLHAVVAAQEEQDTQPSVTLQVNASNGAGRLIPDTLFGIFFEEINHAGAGGLWAELVSNRGFEAGGQNTPSNIWPWSIVGDQSSVYVATDRSSPFERNKIALRMDVICDGNGCPSGGVGVYNPGYWGMNIEEGKKYKVAFYVRSSGDIDLSVSLTSFNGSLTLASEKITASASDVSKWIKKEVVLEAKGSDHGARLQLTTTKKGSLWIDQVSAMPVDTYKGHGFRNDLYQMMADIKPRFIRFPGGCFVEGEWLSNAFRWKETIGPWEERPGHFGDVWKYWTDDGLGHFEFFQLAEDIGAAPIWVFNNGISHNDEVETASIMPFVQEALDGIEFARGDANSTWGSVRAAMGRQEPFELKYVAIGNEDCGKTYYRGNYIVFYDAVKKAYPDIKIISNCDGSSSPLDHPADYYDFHIYTSASSLFSMYHQFDGTSRKGPKAFVSEYAVTGKDAGTGSLLAALAEAAFLIGLEKNSDIVEMASYAPLFVNTNDRRWNPDAIVFNSSHLYGTPSYWVQRFFAESSGSTLLSSELKGNSSSIVASAISWKNSSQDYIRIKAVNFGDSSVNLKVLVTGLDPNVMKVSGSTRTVLTSTNVMDENSFTQPEKVVPQESLLEMAEEDLTVVLPPHSFSSFDLLKEPAKIRKPVSDSSYQKTSTM

SEQ ID NO: 811 - protein, 459 aa, Brassica juncea
MEKKLLLITVSIITNLVFTIHILYRNSTTWNPTWTSRAAIEAEDAASVSCSGHGRAYVDGIGVLGGKQPSCECNNCYTGKDCSILLSDCPVNANSGDPLFLEPFWMRQAESSAALVSGWHRMSYIYQDGTYMSEALETVIRKLHSVVGNAVTDNRFVIFGSGSTQLLAAAVHALSLTNSSSSGPARLLASVPYYAMYKEQAEFFDSVHLKFEGDAFAWKNSERNDNTTQVIEVVTSPNNPDGKLKRAVLDGPNVKTIHDYAYYWPYFSPITVPADEDLSLFSLSKTTGHAGSRFGWGLVKDKTVYENMKRYITLSSMGVSRTTQLHVLQLLNVVVRDGGDNIFHFGHETLKKRWETLNKVLSLSTRFSLQKIKPEYCNYFKKVRDFTPSYAWVKCERPGDANCYEIFREAKITGRDGKVFGSEESFVRLSLIRSQDDFDHLIDMLKKLVLQEGVEAHSI

SEQ ID NO: 812 - protein, 246 aa, Brassica juncea
MKLKVYADRMSQPSRAVIIFCKVNGIEFDEVLIILAKRQQLSPEFKEINPLGKVPTIVDGRLKLFESHAILIYLSSAFPSVADHWYPNDLSKRAKIHSVLDWHHSNLRPGAAGYVMNSVLAPFLGGSLDSKAAAEAEQILTKSLSTLETFWLKGNAKFLLGSNQPSIADLSLVCELMQLQVLDEKDRLRLFSPYKKVEEWIENTRKVTQPHFDVVHKTLYGAKDKVEKQRKMGTTTVSKPGFQSKM

SEQ ID NO: 813 - protein, 2610 aa, Arabidopsis thaliana
MASPLESLLSISGSVSTSSTLIRLRIFRHDIPEILQNSDMTSDIAPVIVDMIFQTLAIYDDRASRKAVDDLIVKGLGNVTFMKTFAAMLVQVMEKQLKFCFDTVCYRLLIWSCLLLEKSQFATVSKNAFVRVASTQASLLRIIMESSFRMRRACKRFMFHLFSQSQAIYSLYMDEVKGSRIPYKDSPELLGLLLEFSCSSPALFEQSKAIFVDIYVKDVLNSREKQKPNLSNCFKPLLQRLSHEEFQTVILPAAVKMLKRNPEIVLESVGFLLANVNIDLSKYALELLPVILPQARHTDEDRRLGALSMVMCLSEKSSNPDTIEAMFASVKAIIGGSEGRLQSPHQRIGMLNAVQELASAPEGKYIGSLSRTICSFLIACYKDEGNEDVKLSILSAVASWASRSSVAIQPNLVSFIAAGLKEKEALRRGHLRCVRIICRNPDTISQISDLLSPLIQLVKTGFTKAVQRLDGIYALLIVSKIAACDIKAEDTMVKEKLWTLISQNEPSLVQITLASKLSSDDCVVCVDLLEVLLVEHSSRVLEAFSLKSLSQLLLFLLCHPSWNVRKTAYNSVTKIFLATSQLATTLLDEFSDFLSITGDQIVSSRTSDADNPADHQAPFVPSVEVLVKALIVISSAAVAGPPSSWIVRAIFCSHHPSIVGTGKRDAVWKRLQKCLKTCGFDVATFLSTNGESVCKSLLGPMGLTSAKTPEQQAAVYSLSTMMSLAPEDTFTVFKMHLQDLPDRLSHDMLSETDIKIFHTPEGMLLSEQGVYVAQTIGAKYTKQEPSSNHSLKKGLASRETANSGRRDTAKLTKKADKGKTAKEEARELMLKEEASTRENVHRIQKSLSLVLHALGEMGLANPVFCHSQLPFLATFLDPLLRSPIVSAAAFENLVKLARCTVQPLCNWALEISTALRLIAIDEVDTSFDFRPSVDKAGKTYEGLFERIVNGLSISCKSGPLPVDTFTFIFPILERILLSSKRTKLHDDVLQILYMHLDPMLPLPRLRMISVLYHVLGVVPAYQASVGPALNELCLGLQADDVANALYGVYSKDVHVRLACLNAVKCIPAVSKCSLPQNVKIATNIWIALHDPEKSVAESADDLWARYGHDLGTDYSGIFKALSHINLNVRLAAAEALADALHESPSSIQLSLSTLFSLYIRDATSGEDVFDAGWIGRQGIALALQSAADVLTTKDLPAVMTFLISRALADPNTDVRGKMINAGIMIIDKHGKENVSLLFPIFENYLNKEASDEEEYDLVREGVVIFTGALAKHLARDDPKVHNVVEKLLEVLNTPSESVQRAVSTCLSPLVLSKQEEAPALFLRLLDKLMKSDKYGERRGAAFGLAGVVMGFGISSLKKYGLIVTLQEALIDRNSAKRREGALLAFECLCEKLGKLFEPYVIKMLPLLLVSFSDQVGAVREAAECAARAMMSQLSAYGVKLVLPSLLKGLEDKAWRTKQSSVQLLGAMAFCAPQQLSQCLPRVVPKLTEVLTDTHPKVQSAGQLALQQVGSVIKNPEISSLVPTLLLALTDPNEYTRHALDTLLQTTFVNSVDAPSLALLVPIVHRGLRERSSETKKKASQIVGNMCSLVTEPKDMIPYIGLLLPEVKKVLVDPIPEVRSVAARAVGSLIRGMGEDNFPDLVPWLFETLKSDTSNVERYGAAQGLSEVIAALGTDYFENILPDLIRHCSHQKASVRDGYLTLFKFLPRSLGAQFQKYLQLVLPAILDGLADENESVRDAALGAGHVLVEHHATTSLPLLLPAVEDGIFNDNWRIRQSSVELLGDLLFKVAGTSGKALLEGGSDDEGASTEAQGRAIIDILGMDKRNEVLAALYMVRTDVSLSVRQAALHVWKTIVANTPKTLKEIMPILMSTLISSLASPSSERRQVAGRSLGELVRKLGERVLPLIIPILSKGLKDPDVDKRQGVCIGLNEVMASAGRSQLLSFMDQLIPTIRTALCDSALEVRESAGLAFSTLYKSAGLQAMDEIIPTLLEALEDDEMSTTALDGLKQIISVRTAAVLPHILPKLVHLPLSALNAHALGALAEVAGAGFNTHLGTILPALLSAMGGENKEVQELAQEAAERVVLVIDEEGVETLLSELLKGVSDSQASIRRSSAYLIGYFFKSSKLYLIDEAPNMISTLIVMLSDSDSTTVAVSWEALARVIGSVPKEVLPSYIKLVRDAVSTARDKERRKRKGGYVVIPGLCLPKSLKPLLPVFLQGLISGSAELREQAAIGLGELIEVTSEQALKEFVIPITGPLIRIIGDRFPWQVKSAILATLIILIQRGGMALKPFLPQLQTTFVKCLQDSTRTIRSSAAVALGKLSALSTRIDPLVGDLMTSFQAADSGVREAILSAMRGVIKHAGKSIGPAVRVRIFDLLKDLMHHEDDQVRISATSMLGVLSQYLEAAQLSVLLQEVNDLSASQNWGARHGSVLCISSLLKHNPSTIMTSSLFSSMLNSLKSSLKDEKFPLRESSTKALGRLLLKQLATDPSNTKVVIDVLSSIVSALHDDSSEVRRRALSSLKAFAKDNPSATMANISVIGPPLAECLKDGNTPVRLAAERCALHVFQLTKGAENVQAAQKYITGLDARRLSKFPEQSDDSESDDDNVSG

SEQ ID NO: 814 - DNA, 1074 bp, Arabidopsis lyrata
aactccttaaaatttctctcaggcggagaagaagaagaagagagaaacggcgccgtttatttatttgtttgtattttactgttttgtgttttttgagtggagaaagctttaagaagagtgaaagatggtgatggactcatcaaaatggtggtggattgggaatcacaacaccacaaatttctctccttggcttcattctactctctctgaattggatgaaaagacaaaagaaatgctgagagtgattgatgaggatgctgattctttcgccgcacgagctgagatgtattataagaaaaggcctgagcttatagctatggtcgaagagttctaccgttcacatcgctccttggccgagaggtacgacttgttgagaccctcttctgtgcacaaacatggctcagagagtcatgggaaatcatcaacttgtgatgagtcttcttggtctgaggcttgtgagactcatgaggactatgcggagtctgaaatagataacggtgaaagcaaatgggtcgatgaaggtgaaatcgatggcattgtcgaggaaatggaatcatcgcaagtcgaatacggtgaagctagtggaagttatgagatgatgaaggaagagctagaaaggctgagagaggagaataaggtttacagtgaaatggtgagagaaaaagatgaagagaagagagaagctataaggcaaatgagtgtagcaatacaaatgcttaaagaagagaactcagagctaaagcaacgtgttactactgttgttgcaaggcgtaacaaggtaggtggtgattctcagaggaagccatttgagtttaagaagattaatcttcaagggttttgggggaaagtagtaggaaattgggttctcccaaacacagattctgcttctagagagctcatgactctttagagaaaacagagaggtctgagtgatcaagaacagaaactgaggaactttctctaaacatctttgtactctgtgacaagtagggtatactctcaagtggttagtgtaagctaagctaagtccatgggtgtttgttttacattttttttctgttgttcgttttttgt

SEQ ID NO: 815 - DNA, 1192 bp, Arabidopsis lyrata
ttttcccggtgaagatagagatgcggaggatcaattcactgtacggaagaattggtatgcttaggagagtacccgaagaatctacgaagaaatctcatacattgctcgcctctctctccttctctacggaaggtagttatggcggtgacggtgagcttcagcagaacagctccaaagtcaagatctttgatcgagatctcaagcgaatacatcgtgatcgagcggcgtggctttctcgccaaaaaaacgattcttttgttgacgctgttgcagagaatctacttgaccgcttagaggattgtaagaagagttttcccactgcattttgtttgggaggatctcttggtgctgttaagcgattactacgtggtcgcggtgggattgagaagcttatcatgatggatacttcatatgacatgattaaatcatgtagagatgctcaagaggattcactcgataactccattgaaacatcttattttgttggtgatgaagagtttctgccagtcaaagagagttcggttgatttgatcataagttcgttggggcttcattggacaaatgatcttcctggttccatgatacagtgcaaactagcgctgaagcctgatggcctatttttagcagcaattcttggcggagaaaccttaaaggagttgagaatagcatgcactttggctcacatggagcgagaaggaggtattagtccccggctatcacctttggcacaggttagggacgcagggaatctcttaaccagggcgggttttagtcttcctggtgttgacgttgatgaatatgtagtcaaatacaagagtgcgatggatcttatagagcatcttcgtgcgatgggtgaaaccaatgctcttctcgagagaaacaaggctggtttcttcttgtattttgaatcgcgaaactgctctggccacggcagccatatatgactccatgtttgccacagaggacggcactatacctgctacttttcaggtaatttacatgacaggatggagagaacattcgtctcacccgcaggccaaacgaagaggttcagccaccgtatccttcactgatctccagaagcaatttggcggtcaatcctgatggaatgattaaagaggagaacacattcaataaacagagactttacaatgagactcgagagaaatcagtgacttatctataaaatact

SEQ ID NO: 816 - DNA, 1124 bp, Raphanus sativus
  misc_feature (426)..(426): n is a, c, g, or t
gttttcccggtgaagcgagagaggattcgatgtacggacgaatcgggagtctcaagagagtactcgaaaaaccaaggaagcaatctcacacattgctgccctttctctctttctctacagaggacggtagtggttatggcggtggcggtggcggtggcggtgagtctcagcagcagaatagctcctcgagggtgaagatcttcgatcgagatctcaagcgcgtacatcgtgacagagcggcgtggctgtctcgcaataaaaacgacacctttgtcgacgctgttgctgagaatcttcttgaccgcttagaggattgtaagaagagttttccatctgcattgtgtttgggaggatctcttggtgctgttcagcgtttactacgtgctcgcggtgggattgaaaagctaatcatgatggatacctcanatgacatgattaaatcatgtagagatgctgctcaacatgatgtttcactcggtaactcctccatcgacacatcttacttggttggtgacgaagagtttctccctatcaaagagagttcggttgatttgatcataagttccttggggcttcattggacaaacgatcttccaggttccatgatacagtgcaaactggctctgaagcctgatggcttgtttttagcagccattcttggtggagaaaccttaaaggagctgagaatagcatgcactttggctcacatggagcgcgaaggagggattagtccccgcctatctcctttggcacaggttagggacgcagggaatctgttgaccagggcgggttttagtcttcctggtgttgacgttgacgaatatgttgttaaatacaagagtgcgctggatcttatagagcatcttcgtgcaatgggtgaaaccaacgctcttctccagagaaacaagatattgaatcgtgaaactgctcttgccacggccgccatatatgactccatgttcgccactgaagacggcactatacctgctacttttcaggtgatttacatgacgggatggagagaacacacgtctcatcctcaggccaaacgcagaggttcagccaccgtatccttcaccgatatccacaagcaattcggtggtcaataaagcgacacttttaca

SEQ ID NO: 817 - DNA, 1404 bp, Raphanus sativus
  misc_feature (27)..(29): n is a, c, g, or t
  misc_feature (59)..(59): n is a, c, g, or t
  misc_feature (61)..(61): n is a, c, g, or t
  misc_feature (63)..(63): n is a, c, g, or t
  misc_feature (82)..(82): n is a, c, g, or t
  misc_feature (86)..(86): n is a, c, g, or t
  misc_feature (90)..(90): n is a, c, g, or t
  misc_feature (101)..(101): n is a, c, g, or t
  misc_feature (106)..(106): n is a, c, g, or t
  misc_feature (108)..(108): n is a, c, g, or t
  misc_feature (116)..(117): n is a, c, g, or t
  misc_feature (186)..(187): n is a, c, g, or t
  misc_feature (189)..(189): n is a, c, g, or t
  misc_feature (195)..(195): n is a, c, g, or t
  misc_feature (297)..(297): n is a, c, g, or t
  misc_feature (364)..(364): n is a, c, g, or t
  misc_feature (378)..(378): n is a, c, g, or t
actgtccgacgttttcccggtgaagcnnnagagaattcaatgtacggacgaatcgggantntnaagagagtactcgaaaaancaangaancaatctcacanatttntngcctctcnntccttctctacagaggacggtagtggttatggcggtggcggcggtgagtctcagcagcagaatagctcnncnagggtnaagatcttcgatcgagatctcaagcgcgtacatcgtgacagagcggcgtggctgtctcgcaacaaaaacgacacctttgtcgacgctgttgctgagaatctncttgaccgcttagaggattgtaagaagagttttccatctgcattgtgtttgggaggatctcttggtnctgttcagcgtttnctacgtggtcgcggtgggattgaaaagctaatcatgatggatacctcacatgacatgattaaatcatgtagagatgctccacttgataactccatcgagacatcttacttggttggtgacgaagagtttctccctatcaaagagagttcggttgatttgatcataagttccttgggggcttcattggacaaacgatcttccaggttccatgatacagtgcaaactggctctgaagcctgatggcttgtttttagcagccattcttggtggagaaaccttaaaggagctgagaatagcatgcactttggctcacatggagcgcgaaggagggattagtccccgcctatctcctttggcacaggttagggacgcagggaatctgttgaccagggcgggttttagtcttcctggtgttgacgttgacgaatatgttgttaaatacaagagtgcgctggatcttatagagcatcttcgtgcaatgggtgaaaccaacgctcttctccagagaaacaagatattgaatcgtgaaactgctcttgccacggccgccatatatgactccatgttcgccactgaagacggcactatacctgctacttttcaggtgatttacatgacgggatggagagaacacgcgtctcatcctcaggccaaacgcagaggttcagccaccgtatccttcaccgatatccataagcaattcggtggtcaataaagcgacacttttacaaaaaaaaaaaagaagagactcgagtcagaatcagtgacttttttaattgtagtgtgcatgcatatgcccttgtgaggtgagatcttcttgtaaaccatcatgatgtctcgcatggaataaataatggactatctgaccagatatgcagatacatgtttgagaggaagttgattattatattgtgcaacaacaatttgtatttcaaaaatgtttccagatattttatcaaacacaacaatacgtgtataattattgtctgaaacaatcaaagcgtattacaaccgaagtttccaaga

SEQ ID NO: 818 - DNA, 1414 bp, Arabidopsis lyrata
tacttttcgaaatatcaaaagagaaaggaaaaaaaaaaatgcaagccatcggcagcagccatgggaggaggctgtgcttcaaccattatctctccgattccttctccaagttcctctctccttcttcttctccttcccttctccctcagagatgccattcgttttgtatccccaagcttggaagtagtagtatcaatgagaatggcagaggaagaattgtgacagtgagagcttcaggagaagaagattctaatggcaactttgctcctcttgctcctgttgagcttgaatctcctgtaggacagcttttggagcagattcttagaactcatcctcatttgttacccgttactgtcgatgagcagctcgagaaattcgccgcagaaaacgagactcttaaagccgattcgtctgctacacaagacattctccaaaagaggatatctgaagttagagataaggaaagacgtaaaactttagcggagatcatttactgtttagtggtacaaaggtttgtggagaaaggaatctctatgattcctcagattaaaccaacttcagatccagcaggacggatagacttatggccgaaccaagaagagaagctcgaagtcattcactctgcggatgcgttcgagatgatacagagtcacttgtcttcagttcttggggatcgaacagcggttggtcctttaagctctatagttcagataggcaaaatcaaactcggaaaactctacgctgcttcagccatgtatggctattttcttagaagagtagaccaaagataccaacttgagagaaccatgaacacacttccaaaacgtcctgagaaaaccagagaacgattcgaggaaccctcgcctccttacccgttatgggatccagattccttgatcaggatccaaccagaggaatacgatcctgatgaatacgcgatacaaagaaatgaagacgagtcatcgtcttatggattgaggtcatacgttacatacttggactcagatacgcttcagagatacgccacgatacggtctaaagaagccatgactctgattgagaagcagactcaggcgctctttgggcgaccagacataaggatactcgaggacggtaagctcgatacttctaacgacgaggttctgtctctgagtgtctcaggacttgcgatgttggttttggaggctgtggcttttgggtctttcttatgggattcagagagctacgttgaatccaaataccattttctcaaggcttgagtttagtcctccttgacatttgtcctttttgagagtagtgaatatgtaaatgttaaatctctcatcatgtaaaatcggtagcaactcatatattcgtaaaatgtaataaactacacttcaaaactttagattcaaatcaagcattatagctcaaa

SEQ ID NO: 819 - DNA, 1386 bp, Brassica napus
aagcagtatcaacgcagtagtttacgttcgggggttagtctactaatttggtagtagtcatctctgagatactttgcgaaaaatcaaatccaagaaagaaaaatgcaagcaatcggcagctatggctgcctctgcttcaagcactaccactccctctccaagttcctttctcctccctctacttctccatcgcttcttcctcagagatgccattcgttctgtatccccaagcttggaagtagcagcaacaacgctgagaacgggcgaggaagaggcgtgacagtgagagcctcaggagaagacgacaactttgccccgattgctcctgttgagctggaatctcctgtgggacagcttctggaccagattcttaggactcatcctcatctcttacccgtcactgtcgatcagcagctcgacaagttatccaccgaaaacgataatctcaaagccgaatcgtcttcttcgcaagacattctctctaagaggatatctgaagttaaggataaggagaaacgtaaaacattggcagagatcatttactgcttagtggtgcatagatttgtggagaaagaaatcaccatgatccctcagattaaaccaacctcagacccagcaggacggatagacttatggccaaaccaagaagagaagcttgaagtcattcactctgcggaagccttcgagatgatacagagtcacctgtcttcggttcttggagacagaacagcagtaggtccattaagctccatagttcagataagcaagatcaaactcgggaaactctatgctgcttctgtcatgtatggctacttcctaagaagaatcgaccagagataccagcttgagagaaccatgaacacacttcccaaacggcctgacaaaaccagggaacgctacgaagagccttcccctccgtacccgttatgggacccggattctttgatccggatccaaccagaggaatatgatcctgatgagtacgcaatacagaggaacgaagaggagtcgtcgtcgtcttacgggttgagatcgtacgttacgtacttggactcggatacgcttcagagatacgccacgatacgctctaaagaagccatgtcgctgatagagaagcagacccaggcgctctttgggcgaccggacataaggatactggaggacggtaagctggatacgtctaacgatgaggttctgtctctgagtttctcgggtcttgcgatgttggttttggaagctgtgacctttggatctttcttatgggacgcagagagctacgttgaatctaagtaccatttcctcaaggcttgagcctgcctagtcctcaatttgtatgttgttttcctagttatcatgtaaagaaagaagacttttgtacattgaatg

SEQ ID NO: 820 - DNA, 1359 bp, Brassica napus
ggtagaacctgagccacaatttggtagtagtcatctctgagatactttgcgaaaaatcaaatccaagaaagaaaaaaatgcaagcaatcggcagctatggctgcctctgcttcaagcactaccactccctctccaagttcctttctcctccctctacttctccatcgcttcttcctcagagatgccattcgttctgtatccccaagcttggaagtagcagcaacaacgctgagaacgggcgaggaagaggcgtgacagtgagagcctcaggagaagacgacaactttgccccgattgctcctgttgagctggaatctcctgtgggacagcttctggaccagattcttaggactcatcctcatctcttacccgtcactgtcgatcagcagctcgacaagttatccaccgaaaacgataatctcaaagccgaaccgtcttcttcgcaagacattctctctaagaggatatctgaagttaaggataaggagaaacgtaaaacattggcagagatcatttactgcttagtggtgcatagatttgtggagaaagaaatcaccatgatccctcagattaaaccaacctcagacccagcaggacggatagacttatggccaaaccaagaagagaagcttgaagtcattcactctgcggaagccttcgagatgatacagagtcacctgtcttcggttcttggagacagaacagcagtaggtccattaagctccatagttcagataagcaagatcaaactcgggaaactctatgctgcttctgtcatgtatggctacttcctaagaagaatcgaccagagataccagcttgagagaaccatgaacacacttcccaaacggcctgacaaaaccagggaacgctacgaagagccttcccctccgtacccgttatgggacccggattctttgatccggatccaaccagaggaatatgatcctgatgagtacgcaatacagaggaacgaagaggagtcgtcgtcgtcttacgggttgagatcgtacgttacgtacttggactcggatacgcttcagagatacgccacgatacgctctaaagaagccatgtcgctgatagagaagcagacccaggcgctctttgggcgaccggacataaggatactggaggacggtaagctggatacgtctaacgatgaggttctgtctctgagtttctcgggtcttgcgatgttggttttggaagctgtgacctttggatctttcttatgggacgcagagagctacgttgaatctaagtaccatttcctcaaggcttgagcctgcctagtcctcaatttgtatgttgttttcctagttatcatgtaaagaaagaagacttttgtactttgaa

SEQ ID NO: 821 - DNA, 1377 bp, Raphanus sativus
  misc_feature (147)..(147): n is a, c, g, or t
  misc_feature (918)..(918): n is a, c, g, or t
  misc_feature (969)..(969): n is a, c, g, or t
ggatctctgagctttctgaaaaatcaaatcgaaagcaaaagaagaaaaatgcaagcaatcggcagctatggctgcctctgcttcaagcactaccactctctctctaagttcatctctcctactccttctccttctccatcacttctncctcagagatgccactccctctgttaccccaagcttggaagtagcagcagcaacactgagaacgggcgaggaagaagcgtgacagtgagagcctcagtagaagacggcactagcgacaactttgctccgattgctcctgttgagctggaatctcccgtgggacagcttctggaccagattcttaggactcatcctcatctcttacccgtcactgtcgatcagcagctcgacaagttatccaccgaaaacgagaacctcaaagccgaatcgtcttcatcacaagacgttctctctaagaggatatctgaagttaaggataaggaaaaacgtaaaacattggcagagatcatttactgcttagtagtacatagatttgtggagaaaggtatcactatgatccctcagattaaaccaacttcagatccagcaggacggatagacttatggccaaaccaagaagagaagcttgaagtcattcactctgcggaagccttcgagatgatacagagccacttgtcttccgttcttggagacggaacagctgtcggtccattaagctccatagttcagataagcaagatcaaactcgggaaactctatgctgcttccgtcatgtatggctacttcctcagaagaatcgaccagagataccagcttgagagaaccatgaacacacttccgaaacggcctgagaaaaacagggaacggtacgaagaaccttcccctccgtacccgttatgggacccggattccttgatccggatccaaccngaggaatatgatcctgatgagtatgcaatacagagaaatgaagatgagtcntcttcttacgggttgagatcatatgttacctacttggactcggatacgcttcagaggtacgccacgatacggtcaaaagaagccatgtcgctgatagagaagcagactcaggcgctctttggacgaccagacataaggatactggaggacggtaagctggatacgtctaacgatgaggttctgtctctgagtttctctggacttgcgatgttggttttggaagctgtgacctttgggtctttcttatgggatgcagagagctacgttgaatctaaataccatttcctcaaggcttgagcttagtcctcatttgtatgttgttttccaagttatatgtaaagaaagaagacatttgtattctacttttgaatgtaaattgttaatctctcatgtgaagtattgataaca

SEQ ID NO: 822 - DNA, 1756 bp, Arabidopsis lyrata
ttttctggttctctctttcctctttgtattttttattcaaaagccaattcccaatttcccaccaaagcttacctatcacttttggcgcaatccggagattctctccgccgtcgtcatgtcgccttccggcgaatcgacgaacggttctcgttgctcatcatgcatctctggtgacatatatggcgacgatttccgtaaatcggatgagtttacatgcaaacaatgcaaaaattccgattcgaaatctaaatcgaaatcggttaatgattcagagaagcttcgaagaatcatcgtcgcttccgtcaaaggattcactataggtactggtttaaaaggtggattagcgattttctcaatcgtcgctcgtttcgctcgtcgccgtagatcttctcttcaatcgaggaaaaccggagagttttcgaatagtgaagctattgctatggggattaaggagacattaagatatggattgttcttaggaacttttgctgggacttttgtttcagtagatgaagctattgctgctttagcaggagacaagagaactgcaaagtggagggccctgtttgctggattggtggctggaccatctatgcttctcacagggccaaatacgcaacatacgagtttggctgtttatatattgatgcgtgctgcggttcttgcatcgcggtgcggtattaaaagtaaacggtttggttccatatgcaagccgcttacttggaaacatggcgatttatttctcatgtgtctctcatcttcacagattttgtctgcttacattttgaaacaagaaagtcttccttcatcgtacaagtctttccttaacaaacaaggtgggaaggatctttctatcttacaaggcgtaaaagatatcgcaagcgcccaaccgttcactaatctaagagcgattgagaaatattacaagtctgttggagttgatatcaaactagatcctaacatgaaagtcccctgttcgataatacatggaaatgagtcatgtgttaagcatggtattacatttttccttcaagcttacaagagggcgttacctgtctatgtccctgtctatttgattccagcgctaatcgttcatcgtcaagacctgctaaaaaagcaatactctatacttggcaagggtcttctgggcacagcaagatcaagtttgtttctcgctacttactgctcttctgcctgggcttggacttgcctacttttccggacttttgagacatgcaacataccgcttgtggccatagcaacgttcccaacaggtctggctttagctattgagaagaaaagcagaaggatagagatatcactctactgcttagcgagggcaatagagagcttcttcacttgcatgacagatgcaggatacattcgaccgcccaagagtctaagaagagcagatgtggttgtgtttagcgtttcaacagccattataatgcattgttacgcacaggaaagagaagtatttcgatcaaaatacttaaacgtgctagattgggttttcggtgttcctcctcctcctcttcctcctccttgcgaaacaacctagagacattcactttttaacctgaagatctttgatgtgcgatagaatttggtgaaagaatgttcatttagagtctctaggagttttgttttgggtcaattttgtagacaactatccatttgacaattttggtccatcttatggggacacaccaatatgtaatctggacgtcttacatgttctacacagttaaaataa

SEQ ID NO: 823 - DNA, 1586 bp, Brassica napus
  misc_feature (120)..(120): n is a, c, g, or t
  misc_feature (204)..(204): n is a, c, g, or t
  misc_feature (308)..(308): n is a, c, g, or t
  misc_feature (740)..(740): n is a, c, g, or t
  misc_feature (773)..(773): n is a, c, g, or t
  misc_feature (833)..(833): n is a, c, g, or t
cggcacgagggtcactctctttacaacttttatggttgttccttcccctttgtccttttatttcaaacgccggaaccaatttcccaccaaagcccacctatctttcactttggcggactncgtatcttcttcactttaggatcaatcccgacgtcatgtcgccgtctcgccgaaaggcgaacggttctcgctgctcatgtatcngtggtgaaatcgatggaatctccggcggcgaatcgtttgaccttacatgcacgcattgcaacggttccgattcgattaaacctgatcccgcttcctcttggttnctgtcttctttatctgaaacgaaactggatgactcggagaagctgcgtagaatcatcgtcgcttccctcaaaggattctccataggtactgggattaaaggtggattagctcttttctctatcattgttcgtttcgctcgccgtagatcttcttctaaatcgaggagaaccggtgatttctcgaatagtgaagctatttccatggggattaaggagacactaagatacggactgttcttgggaacttttgctggtacttttgtctccgtagacgaagctatttgttctcttgtaggacaccaaagaactgcaaagtggagggctctgtttgctggtttagttgctgggccatcgatgcttctcactggaccaaacacaacacacacgagtttggctgtttacatcctgatgcgtgcggcggttcttgcgtcncggtgcggcattaaaagcaaacggtttggttcnatttgcaagccgcttacatggaaacatggggacttgtttctcatgtgtctctcatcttcncagattttgtcttcctacattttaaagcaagatagtcttccttcatcgtacaaatctttcctaaacaaacaaggtgggaaggatctttctatcatacagggcgttaaagatatcgcaagcgccaaaccattcaccaatttaagggcaattgagaaatattacaaatctgttggagttgatatcaaacttgatcctaacatgaaagtcccctgttcgataattcatggaaaagagtcatgtactaagcatgctcttacatttttccttcaagcttacaagagggcgttacctgtctatgtccctgtctacttgatcccagcgctgatagtccatcgtcaagacctgctaaaaaagcaatactcaatactcggtaagggtcttcttggcacggcgagatcaagtttgtttctctctacttactgcacttcgtcctgggcctggacttgcctgcttttccggatttttgagacgtgcagcataccgatcgtggccatagccacgttcccaacaggtctggctttagcaattgaaaagaaaagcagaaggatagagatatcactctactgcttagcgagggcaatagagagcttcttcacatgcatgacagatgcaggatacattcgaccgcccaagattctaagaagagcagatgtggtcgtgttcagcgtttccacagccattataatgcactgctacgcgcaggaaagagaagtgtttcgatcaaaatatttgaacgtcctagattgggtttgc

SEQ ID NO: 824 - DNA, 1471 bp, Brassica napus
gacgacgtatcttcttcactttaggatcaatcccgacgtcatgtcgccgtctcgccgaaaggcgaacggttctcggtgctcatgtaccggtggtgaaatcgatggaatctccggcggcgaatcgtttgaccgtacatgcacgcattgcaacggttcggattcgattaaacctgatcccgcttcgtcttggttcctgtcttctttatctgaaacgaaactggatgactcggagaagctgcgtagaatcatcgtcgcttccctcaaaggattctccataggtactgggattaaaggtggattagctcttttctctatcattgttcgtttcgctcgccgtagatcttcttctaaatcgaggagaaccggtgatttctcgaatagtgaagctatttccatggggattaaggagacactaagatacggactgttcttgggaacttttgctggtacttttgtctccgtagacgaagctatttgttctcttgtaggacaccaaagaactgcaaagtggagggctctgtttgctggtttagttgctgggccatcgatgcttctcactggaccaaacacaacacacacgagtttggctgtttacatcctgatgcgtgcggcggttcttgcgtcccggtgcggcattaaaagcaaacggtttggttcaatttgcaagccgcttacatggaaacatggggacttgtttctcatgtgtctctcatcttcacagattttgtcttcctacattttaaagcaagatagtcttccttcatcgtacaaatctttcctaaacaaacaaggtgggaaggatctttctatcatacagggcgttaaagatatcgcaagcgccaaaccattcaccaatttaagggcaattgagaaatattacaaatctgttggagttgatatcaaacttgatcctaacatgaaagtcccctgttcgataattcatggaaaagagtcatgtactaagcatgctcttacatttttccttcaagcttacaagagggcgttacctgtctatgtccctgtctacttgatcccagcgctgatagtccatcgtcaagacctgctaaaaaagcaatactcaatactcggtaagggtcttcttggcacggcgagatcaagtttgtttctctctacttactgcacttcgtcctgggcctggacttgcctgcttttccggatttttgagacgtgcagcataccgatcgtggccatagccacgttcccaacaggtctggctttagcaattgaaaagaaaagcagaaggatagagatatcactctactgcttagcgagggcaatagagagcttcttcacatgcatgacagatgcaggatacattcgaccgcccaagattctaagaagagcagatgtggtcgtgttcagcgtttccacagccattataatgcactgctacgcgcaggaaagagaagtgtttcgatcaaaatatttgaacgtcctagattgggtttgc

SEQ ID NO: 825 - DNA, 2200 bp, Arabidopsis lyrata
caattgcaaacccttagacaaaactctcgaagcttggatcccgttttgcagccatggctccgaaatcgaaagaaaaatccaaaacatcaacttcacaacctcctctagcaatcgaagatctcttcagttccctcaatggtcatatccagggatctgaatttgaagaagccgtcaaggtcgcagataaagttttgtcgattttacctactgatgaggatgcgatccgatgcaaagttgtggctctgataaaagacgataagatcgatggtgctctctccgtcattagctcgttccagaagcttccaatcgatctagggtttcaaaatgcgtattgtttataccgtctaaacaagttagatgaggcgttggtgtgtttaaaaggtctcgagagagattcagatactttgcttttggagtctcagattttgtaccgtttggggaaagcagatgcttgtgtggatgtgtgtcagaaactgagcaagtcggagattgagtccttagagatcaatttagtcgcggcgttgattacagctggaaaagcttctcaggtgccaaaagcattggagggtttgaagatcaaaccaactagtacttatgacttggcttataatactgcttgctctttgattgaaaacaataactatgccgatgctgaacaacttttgctcactgccaagagaattggtcaggaaaccctcactgaagatgactgttctgatgagtatatcgagactgagctggccccaatttctgttcaattagcatatgttcaacaggtccttgggcaaactcaagaatccactagctcttatgtagatatcattaaacgaaatctggctgatgaaccttcacttgctgttgctgtgaacaaccttgttgcctcgaaaggttccaaagatatttctgatggcttgaggaagtttgatcggctgaaagaaaaagactcccaaaattttcagctttctcaagaactcgatgcaaagctttcacagaaaaataaggaggctatatatgccaatcgcgtccttctactcctccatgcaaataaaatggatcaggcacgagaactttctgctgcactgccgggtatgtttcctgagagtgttattcctacattgcttcaagctgctgttttggtgagagaaaacaaggctgccaaagctgaagaacttctgggacagtgtgccgaaaaatttccggaaaagtctaagttggttctcttggccagggcacaaattgctgcgtctgccagtcatcctcatgtagcagcagagtccctgtccaaaatacctgatattcagcatttgcctgcaactgttgccaccattgtcgccctcaaagagcgtgctggggacaatgatggtgctgctgctgttcttgactcagcaattaaatggtggtcgaattcgatgactgagagcaataagcttagtgtaatgatgccggaggctgctgccttcaagctcaggcatggtcaagaagaggaggcttcacggctatacgaggagattgtgaaaaaccataatagcacagatgctctggttggtcttgtgactacacttgctcgtgtcaatgtcgaaaaagcagaaacttatgagaaacagcttaaacccttaccaggtttgaaggctgttgatgtggataacctagaaaagacctctggtgcaaaacccattgaaggcgctgctgcttcatcgagtcaggaagaagtgaagaaagagaaggcgaagaggaagaggaagagaaagccaaagtatcccaaaggattcgatccagctaacccaggtccacctccagaccctgaaaggtggcttcccagaagggaaaggtcaagttacagacccaagaggaaggacaagcgagcagctcaaatccgtggctcgcagggtgcggtgacgaaggataagcaagaagcagctccttcaacttcaaagtcaaaccaagcggccagttctaaagccaatgcagctgcgccttcttcaaaggcctcgaaaaagaagtctagaagatgagtgaaacaaccctttaagattgtttcatctgttctgagaaaacaaaaacaaagagtacttggccccaaactttccattgttctttttttttttggattgatcaagttttagttgtcttgacccatttaagattttggttcatttctcgtttgcgtgtcctgaattcgcattgctttgatgatcgttaa

SEQ ID NO: 826 - DNA, 1963 bp, Arabidopsis lyrata
gctaactgaattacagttttcgattcgaaattcttaatcccattttcattccttcgacaaatcttcacacaatcctaatctcatttctggtaaatccgattttggtgaaaccctaatttgatctccagatcgctatcgacgatggaggaagacaagcaaatgcacgaggagaaatcatccccggttaagggagaagagcctgagattgagaaattgacagtggccgataccgatgcgccgccgaagagtaccggtggttggggttggggtttctctggcttctctgtactttccgatcttcaaaaagctgcggaagagatttctcgtaatgctgcagcggtggcggagaaagcggcgaaaagtattgcagatatgggagaagtggatgaagactctgaatcttctgctaaggaagaagagaaaactgaagaagctgatacagagcaggatagtgatgatgagaatgcaaagttaaagaagtcagctcttgcgagattggagggggcaagtgaagagtcgcttcttagccaggcaatatctcgatgtttcatcttccagggtttgaaggttttcgatgattcagttgagagtttcacttctggagcttggcaggcatttggaaatgcgttaaaagggggcacaagtttggtgcaaaagcttgaaaacagtgtcgagcaaggttcttctcctagggaagctggatctggtgcaccttccctactggagacaggaaaagcattaactgctaaaggaatgcaagtacttgaatttgtgggcaaggaaaccatggatttactgattacagagactggtattggagctgagaaggatagggtagactttaaggatcaagtacttgaggaagtgacatttgatcgatgtttttacatttatggtggtcctgagcagcttgaggaattggaagcattggcaagccactatactctgttgttcaacaggaaaaaggggaaattgtcaccagatcaaaaatccttgtatgacgggaagctcaaacaaatccagcaactgtttagcttcgctgacgaaatgagcggaagtaaagcagagtctgacaaagggaagaaaatagatatcaaaactgaaggcaatgatgatgacatgaagaatctgcataactcgagtgtcagcaaagctgctgatatggctgcggggttcacaaatgctttagcgggactaaacgtaaacgatatgatccagcggaccggtggcaggcttgaatctcttcactcagaaggagttcatagactttcagagatgtgctgttttgcagtcactcatctgcttattctcagtaagtccatgatatctcatgccaacaaagttcaggatgaagacaccgaggcattgaaaatcgagtggccagaggatcctactgagaaagctaagctgattaaaggcaaggcagaatcgatgactggatatgttgaagcagtttccaacagttttataacaggtatatcagatgtatctgaaacatactcagctgcgattaaaggagttgctgctgctgattccaaagatgatcttctgaaaacatcaaccatgcaggaaaaagcaagcaccttcaacgatagtcttcgctctgaccaaaccacagctatcacaaagatccaggaaggacttcagtacctgtcttatgtcgtgatatctacctcaatgccctctgcctgatataataagagtcagattggtcttatttgtggtttacatgactcaggattcgatttagttttctttgtaattgtagatatatctctttcgctagatgctcttatggtaagtttttcacacttgtgctctgcttctctgttgtctggatcttgaaagttttattaaatctagaaaccaaagattgaaagcagggaagagattagtaatttcatcgaacttttgttagaaatatattgttgcttccaaattttttacttggaaggtggtttag

SEQ ID NO: 827 - DNA, 1794 bp, Brassica napus
ggatccaactgaaacgaaacacagtttgttagcattcgatatcgatggagggagacaaacaaacgcacgatgagaagaagcactcatcagaggaagaatcaattcggagagaggatcccccgacaccggagaacactggtggatggggctggggcttctctgtgctctcagatcttcaaaaagccgcggaagatttatctcgtaatgctgcagcagtggcggagaaagcagcgaaaagcattgcggatatgcaagaagcggatgaagactctgaatcttctgccaaggaagaagagataactgatacagagcaggatagtgatgatgagagtctgaagttaaagaagttagctttaggcaaattggaggatgcaagtgaagagtctcttcttagccagggtttgaaggttttcgatgattcagttgagagtttcacttctggagcttggctggcgctaggaaatgcgctaaaaggaggcacaagtttggtgcaaaagcttgaagacagtgtccagcaaggttcttcgcctagggaagctggatctggtgcaccgtctctattggagacgggaaaagcattaactgccaaaggaatgcaagttcttgagtttgttggcaaggagactatggatttattgattacagagactggtctcggaaatgagaagaacagggatcaaatgatggaggaagtgacgtttgatcgatgcttttacatttatggtggtcctgagcagctcgaggaattagaagcattgtcaagccactatactctgttgttcaacaggagaaaggggaaactgtcgcaagatgagaaagtgttgtttgatgggacgctcaaacagatccagcaactattcagcttcgctgatgaaatgagtggacgtaaagcagagtctgacaaagggaagaaaatagatattaacaccgaaggcaatgatgatgacatgaagaatctgtacaactccagcgtcagcaaagctgctgatatggctgctgggttcacaaacgctttagcgggtctaaacataaacgatacgatccagcggaccggtggcaggcttgagtctcttcactcagaaggagttcatggactttctgagatgtgctgttttgcagtcactcatctgcttattctcggtaaatccattatatctcatgccaacaaagttgaggatgaagacgctgagacattaaaaatcgagtggccagaggatcccactgaaaaagctaggctgattagaggtaaggcagaattgatggctggatatgtggaagcagtttccaacagttttataacaggtatatcagatgtctctgaaacattctcagctgcgatcaaaggagctgccgctgatgattccaaagatgaacttctgaaaacatcaaccatggaggaaaaggcaagcactttcaacaatagtcttcgctctgaccaaaccacagctatcacaaagatccaggaaggacttcaatacctgtcctatgtcgtgataactacctcaatgccctctgcttgatataataagagagtcagattggtcttgtttgtgggttttccttcttaatacatgactcaggatccgtttaagtttcctttgtagatattatctagttcgccagctgctcttatggcaagtcatttcatcagcgaagctgaatagttgctggatctgtttgagcttcccatcaaccaacactttctcatcttgcgacagtttcccctttctcctgttgaacaacagagtatagtgtctgacaatggaatactcctcgacgggcccgtacccatcg

SEQ ID NO: 828 - DNA, 1840 bp, Brassica napus
  misc_feature (104)..(104): n is a, c, g, or t
  misc_feature (107)..(107): n is a, c, g, or t
  misc_feature (111)..(111): n is a, c, g, or t
  misc_feature (130)..(130): n is a, c, g, or t
  misc_feature (140)..(140): n is a, c, g, or t
  misc_feature (145)..(147): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (186)..(186): n is a, c, g, or t
  misc_feature (194)..(194): n is a, c, g, or t
  misc_feature (221)..(221): n is a, c, g, or t
  misc_feature (230)..(230): n is a, c, g, or t
  misc_feature (245)..(245): n is a, c, g, or t
  misc_feature (249)..(249): n is a, c, g, or t
  misc_feature (255)..(255): n is a, c, g, or t
  misc_feature (263)..(263): n is a, c, g, or t
  misc_feature (281)..(281): n is a, c, g, or t
  misc_feature (314)..(314): n is a, c, g, or t
  misc_feature (319)..(319): n is a, c, g, or t
  misc_feature (358)..(360): n is a, c, g, or t
  misc_feature (394)..(394): n is a, c, g, or t
  misc_feature (419)..(420): n is a, c, g, or t
  misc_feature (423)..(423): n is a, c, g, or t
  misc_feature (946)..(947): n is a, c, g, or t
  misc_feature (1335)..(1335): n is a, c, g, or t
gaactgaaatacagtttcgattcgaacccctttgttaccattttcattcaatttgcttcagaaaccctaattcgatctcgaaatcgccaacgacgatggaggangangacnaacaatcgcacgagggggngaaagaaccnattcnnngagaggatgccganancgcngaatcgccgccgaagaacnccggcggntggggatgggggttttccggcttctcngtgctctcngatcttcaaaaagcngccnaagatntatctcgnaatgctgcagcagtggcngagaaagcagcgaaaagcattgcggatatgcangaagnggatgaagactcagaatcttctgccaaggaagaagagannnctgatgacagagcaggatagtgatgatgagagtnacaagttaaagaagttagctttagnnaanttggaggatgcaagtgaagagtctcttcttagccagggtttgaaggttttcgatgattcagttgagagtttcacttctggagcttggatggcgctaggaaatgcgctaaaaggaggcacaagtttgatgcaaaagcttgaagacagtgtccagcaaggttcttcgcctagggaagctggatctggtgcaccgtctctattggagacgggaaaagcattaactgccaaaggaatgcaagttcttgagtttgttggcaaggagactatggatttattgattacagagactggtctcggaaatgagaagaacagggatcaaatgatggaggaagtgacgtttgatcgatgcttttacatttatggtggtcctgagcagctcgaggaattagaagcattgtcaagccactatactctgttgttcaacaggagaaaggggaaactgtcgcaagatgagaaagtgttgtttgatgggaagctcaaacagatccagcaactattcagcttcgctgatgaaatgagtgganntaaagcagagtctgacaaagggaagaaaatagataccaaaactgaaggcagtgatgatgacatgaagaatttacataactcgagtgtcagcaaagctgctgatatggctgctgggttcacaaacgctttaactggactaagcgtaaacgatataatccagcggactggtggcaggcttgaatctcttcactcagaaggagttcatagactttcagagatgtgctgttttgcagtcactcatcttcttactctcggtaagtccatgatatctcatgccaacaaagttcagggtgaagacaccgaagctttgaaaatcgagtggccagaggatcctactgaaaaagctaagctgattagaggcaaagcagaatcgatggctggatttgtngaagcagtttccaacagttttataacaggtatatctgatgtatctgaaacatactcagctgcgatcaaaggagcttccacagatgatgattcgaaagataatctactgaaaacatcaaccatggaggaaaaggcaaacacttttaatgatagtcttcgctctgaccaaactacagccatcacaaagatccaggaaggacttcagtacctatcctttgtcgtgatatctacctcaatgccttctgcttaatataataagagagtcagattggtattatttgtggtttgccttcttttcttgtagatattatctgtttcgctagttgctcttatggtcagtttgcttcaactttagctttgcttctctgttgtttggatctttgaaaagtttgataaaatctggaaaccaaacgttaaaacaagggtagatagattagttttttttcagttgtcgagtgttgcttccaaagttttgttggttggacgttcatttaattgtgctttca

SEQ ID NO: 829 - DNA, 1769 bp, Brassica napus
gaattcgatggaggacgacgacgaacaatcgcacgagggggcgaaagaaccgattccgcgagaggatgccgagaccgccgaatcgccgccgaagaacaccggcggatggggatgggggttttccggcttctccgtgctctccgatcttcaaaaagctgcccaagatatctctcgcaatgctgcagcagtggcggagaaagcagcgaaaagcatagcggatatgcaggaaggtgatgaagaatcagaatcagaatcttctgcgaagggagaagagaaggctgaagagcctgaggatagtgatgatgagagtcacaagttgaagaagttagctttggctaagttggaggatgcaagtgaagagtctcttcttagccagggtttgaaggtttttgatgattcagttgagagttttgcttctggagcttgcctggcactaggaaatgcattaaaaggaggcacaagtttggttcaaaagcttgaaaacagtgtccagcaaggttcttcgcctagggaagctggatctgatgcaccgtctctattggagacgggaaaagcattaactgccaaaggaatgcaagttcttgagtttgtgggcaaggagactatggatttgttgattacagagactggtcttggagttgacaagaacgaggaaggctttaaggatcaaactattgaggaagtgacatttgatcggtgcttttacatttatggtggccctgagcagcttgaggaattggaagcattgtcaagccactatactctgttgttcaacaggagaaaggggaaactgtcacaagatgagaaatcgatgtatgacgggaagctcaaacagatccagcagctgtttagcttcgctgccgaaatgagtggaattaaagcagagtctgacaaagggaagcaaatagataccaaagctgaaggcagtgatgatgacatgaagaatttacataactcgagtgtcagcaaagctgctgatatggctgctgggttcacaaacgctttaactggactaagcgtaaacgatataatccagcggactggtggcaggcttgaatctcttcactcagaaggagttcatagactttcagagatgtgctgttttgcagtcactcatctgcttactctcggtaagtccatgatatctcatgccaacaaagttcaggatgaagacaccgaagctttgaaaatcgagtggccagaggatcctactgaaaaagctaagctgattagaggcaaagcagaatcgatggctggatttgtcgaagcagtttccaacagttttataacaggtatatctgatgtatctgaaacatactcagctgcgatcaaaggagcttccacagatgatgattcgaaagataatctactgaaaacatcaaccatggaggaaaaggcaaacacttttaatgatagtcttcgctctgaccaaactacagccatcacaaagatccaggaaggacttcagtacctatcctttgtcgtgatatctacctcaatgccttctgcttaatataataagagagtcagattggtattatttgtggtttgccttcttttcttgtagatattatctgtttcgctagttgctcttatggtcagtttgcttcaactttagctttgcttctctgttgtttggatctttgaaaagtttgataaaatctggaaaccaaacgttaaaacaagggtagatagattagttttttttcagttgtcgagtgttgcttccaaagttttgttggttggacgttcatttaattgtgctttca

SEQ ID NO: 830 - DNA, 1656 bp, Arabidopsis lyrata
ggcttctctcctcgcgttatctcctttgtcgatttagccctaacctatacggctgctacatccagatttcctcatccttattagggaagaagaaccaaaaccctaatcctatcttcttcctcctcctcttataaatcgcttcaacaacagtttcttctctcttgtctctgattttgattcatgatttctcatctcgaaccctaatttatacatccatccatcgggtgttactgttctttatctgggcattcagtggtgtttttgttccttttgtttatctgtcgagatttctaggtgaaatcgaagcttgtttggtttatctcgatcttggttttagctgaatcgtgtgttaagatggctggaggtggaaacaggagagatgaaggatcgatcacgatccagagtaccaatttgtttgcagctttggatactcgtaagaagaagaagaagtcagggaagagcaaagggtcttctaagtcacgagagccagagaaggagcctgagcctcaggtcttttgggcacctactccgttgaaagttaagtcttgggctgatattgatgatgatgatgatgatgatgactattatgcaaccactgctcctcctcagtctggttggagcacttctgtgccttcccattcggattcgaaagacgttcatgttgaggaaagtgaaagtgaggaagatattcttgatgaaggtgatgatgatgtggaggaagagcaggaacaggaaacagaggtacaggttcatccagagcctgagcctgaggtgaagaaagctcctgaagttcctgggcctcctaaagaggcagagaggcaactttccaagaaagagaggaaaaagaaggaacttgctgagcttgaggctttgttggctgattttggtgttgcccccaaggagaataatggccaagatgaatctcaagaggctaaacaagaaaagaaagaagatgtcaatggagagggagagaagaaggagaatgcagcaggtggggagtcaaaggcatcgaaaaagaagaaaaagaaggataagcagaaggaggtaaaagaatctcaagagcagcaagcaaacaacaatgccgatgctgtagatgaagctgctgggtctgaaccaactgaggaagaaactccaattgatgtcaaagaaaggctgaaaaagcttgcatccatgaagaagaagaagtcaggcaaagaggtggatgctgcagctaaagctgctgcggaggaagcagctgcaagacgtaagaagctggccgctgcaaagaagaaggagaagaaccactataaccaacagcctgtgcggtaaatcctgaaccaccaccattttgatcttgatggaaatgcaaatatgaacatgtatttcgccgtatattgttcatatgagtctctgtcctaataaatcttttgaagggtctggttcttagagttaaagacattgaatcctttttctagtcgtattacaatgaacaggctaaagacaaaacttctctctggaaattttcttttctttttgaacacttttgttttttaatatcagacctttttaggtacattatgtcttcaatcatcttcttatgtatggtttgatgatgttatgtttttctgttttcattcagtttcctgtgttttgattcatgccttgtcaaaaaatctt

SEQ ID NO: 831 - DNA, 1533 bp, Raphanus sativus
ttcagccctagcctatacggctgcttcacccagatttcctcatcttaattagaaaaagaaccaaaaaaaaacctaatcacaatctctgtctcaagccttcattttcaactcatccgattctcgatcaatatatttgaaattctccctttgtttttagatctctttgtccatttgtttatccgtgtagacttgtccgaagaagcttgtttgttattttactgttgtttttttgtctgaatcgaaaacaagtttggggggggaagataagatggctggaggaggtggaaacaggagagacgaagggtcgattacgatccagagcaccaatttgtttgcagctttggacactcgcaagaagaagaagaagaacagtggtaagagcaaagaagggtcctcctctaagagcaaagctccacacaaggagcctgagccacaggttttctgggcgcctacgcctttgaaagttaagtcttgggctgatatcgatgatgacgatgaagatgatgactattacgctaccaccgctcctcccacctctggttgggccacttccgagcctaaagacactcatgttgaggaaagtgaaagtgaggaagatattcttgatgaaggtgatgatgatgtggatgaagagcaggagcatgaaacagaggtacaagttcatccggagccagagcctgaggtgaagaaagcacctgaagttcctgcgcctcctaaagaggcagagaggcaactgtccaagaaagagaggaaaaagaaggaacttgctgagcttgaggctttgttggctgattttggagttgcccccaaggaggataatggccaagatgcctctaaagaggctaaagaagagaccaatggagaaggggagaagaaagagaacgcagcaggtggggagtcaaaggcatcaaagaagaagaaaaagaaggataaacagaaggaggtaaaagaatctcaggaacaacaagccaacgcagatgctgtaggtgaagctgctgggtctgaaccggctgaggaagattctgcaattgatgtcaaagaaaggctaaaaaagattgcatccatgaagaagaagaaatcgagcaaagaggtggatgccggagccaaaacagccgcgcaggaggcagctgctagacgtgcaaagctggcggctgcaaagaagaaggagaagaaccactataaccaacagcctgtgcggtaagacccaccattttgatctttgatggaccatacgaatatgggcatgtaattggccgtattttgttcatatgggtcttcttctctgctttaataaatcttttgaagacttcaaaacgcacattgaatcctttttttttctagtcttattatgatgaacagtctaaagacaaaaacttgaagatttcgtttattttctgtaaacttgtgtcccttttaatctcagacctttttaggggtgatgattttagttctgttttcaaattatcttcttatgtatggtttgatggttgctttattattactcatggagaatcctcttacggggatcatcag

SEQ ID NO: 832 - DNA, 1574 bp, Brassica napus
agagacgtccatgacgcgtacgtagcttgacacctctagagacgacccacgcgtccgcccagatttcctcatcttaaccagaaaagaaccaaaagccttattctaatctcttctctaaccttcatttttcaattcatcggactctcgatcaaaatatatttgtggctcagacttcttttcttttttagatctctttcccatttgtttatccgtttagacttatcggttctgtccgaagaagcttgtttgttaaattctgtcgttttatccgaatcaaaaacaatcaagtggggagggaagaagatggctggaggtggaaacaggagagaggaagggtcgattacgatccagagcaccaatttgtttgcagctttggacactcgcaagaagaagaagaagactgacaaagctggtaagagcaaagggtcctcctcctcttcctctaagacacagaaggagcctgagcctcaggttttctgggcgcctacgcctctgaaagtcaagtcttgggctgatatcgatgatgacgatgaagatgatgactattactctaccactgctcctcctctcccctcgggttggaccacttctgagcctaaagacactcctgttgaggaaagtgaaagtgaggaagatgtacttgacgaaggtgatgatgatgtggatgaagagcacgaaacagaggtgctagttcatccggaaccggagcctgaggtgaagaaagcacctgaagctcctgcacctcccaaagaggctgagaggcaactttccaagaaagagaggaagaagaaggaacttgctgagcttgaggctttgttggcagattttggagttgcccctaaggaggataatggtcaacaagaggctaaagaagagatcaaaggagagggagagaaagagaatgcagcaggtggggagtcaaaggcatcaaagaagaagaaaaagaaggataaacagaaggaggttaaagaatctcaagagcaacaagctaacgcagatgaagctgctgggtctgaaccgactgaggaagaatctgcaattgatgtcaaagaaaggctgaaaaagattgcatccatgaagaagaagaaatcaagcaaagagatggatgccggagccaaaactgccgcccaggaggcagctgcaagacgtgcaaagctggcggctgcaaagaagaaggagaagaaccactataaccaacagcctgtgcggtaagcttaacccgccattttgatcttttgatggacatacgagtatgggcatgtatttggccgtattttgttcataatggtgtcttcttctcagctgctttaataaatcttttgaaggtttctggttttagagttggtacgcacattgaatccttttttttctagtcttattatgaatgtccaaagacaaaaaaaacttgaaaatttcgtttctttctgtaaacttttgtcctttttaatctcagacctttttaggtgcgatgattttaccttctcttttcaaattatcttcttatgtatgggttgatgggaactttattactcatgcatcagaatattatagttttgcgtctcagaaataatttt

SEQ ID NO: 833 - DNA, 1468 bp, Brassica rapa
  misc_feature (81)..(81): n is a, c, g, or t
gcttccccagatttcctcatcttaaccagaaaaaaaaaaccaaaagccttattccaatctcttctcaaaccttcacttttncaattcatcggactctcgatcaaaatatatttgttgctcagacttcttttcttttttagatctctttcccatttgtttatccgtttagacttatcggttctgtccgaagaagcttgtttgttaaattctgtcgttttatccgaatcaaaaacaatcaagtggggagggaagaagatggctggaggtggaaacaggagagaggaagggtcgattacgatccagagcaccaatttgtttgcagctttggacactcgcaagaagaagaagaagactgacaaagctggcaagagcaaagggtcctcctcctcatcctcctctaagacacagaaggagcctgagcctcaggttttctgggcgcctacgcctttgaaagtcaagtcttgggctgatattgatgatgacgatgaagacgatgactattacgctaccactgctcctcctctcccctcgggttggaccacttctgagcctaaagacactcctgttgaggaaagtgaaagtgaggaagatgtacttgatgaaggtgatgatgatgtggatgaagagcacgaaacagaggtgcaagttcatccggaaccggagcctgaggtgaagaaagcacctgaagctcctgcacctcccaaagaggctgagaggcaactttccaagaaagagaggaagaggaaggaacttgctgagcttgaggctttgttggcagattttggagttgcccctaaggaggataatggtcaagaagaggctaaagaagagatcaatggagagggagagaagaaagagaatgcagcaggtggggagtcaaaggcatcaaagaagaagaaaaagaaggataaacagaaggaggttaaagaatctcaagagcaacaagctaacgcagatgaagctgctgggtctgaaccgactgaggaagaatctgcagttgatgtcaaagaaaggctgaaaaagattgcatccatgaagaagaagaaatcaagcaaagagatggatgccggagccaaaactgccgcccaggaggcagctgcaagacgtgcaaagctggcggctgcaaagaagaaggagaagaaccactataaccaacagcctgtgcggtaagcttaacccgccattttgatcttttgatggacatacgagtatgggcatgtatttggcccgtattttgttcataatggtgtcttcttctcagctctgctttaataaatcttttgaaggtttctggttttagagttggtacgcacattgaatcctttttttttctagtcttataatgatgatgtccaaagacaaaaaaaacttgaaaatttcgtttctttctgtaaacttttgtcctttttaatctcaggtgcgatgattttaccttctcttttcaaattatcttcttatgtatgggctt

SEQ ID NO: 834 - DNA, 2812 bp, Arabidopsis lyrata
tgtgtatgtaaaatggttgccggagtccatggcagccgaaattgggcgattcaaagagagaatcttctttgattttttattcaaattccaacgatctcaaatttttgttattttttaaaattataattgattagtcacatgtggcagttcttcgtggtcgccactacctaatcataaccatttgggtttatagaagaacaaggtcgcgcatcgccatggatcaatcatcctccatgcattgacttttttttatttttactttagttagggtttgaaattcgataaatcgagatgcggtgggatttgatcgcggcgattgtggccgcgctggtggtgtcgggtttggctgatgaatcgggtcaaagggcaccgtatcggatccacacgctgttctcggtggagtgccagaactacttcgattggcagacggttggtttgatgcacagcttcttgaaatccggacaacccggtccgattacccggttattgagctgtaccgatgatcagaagaagaattacagaggcatgaatctcgctcccactttcgaagttccctcttggagcagacatcctaagaccggtgactggtacccagcaattaacaaaccagttggagttctttactggcttcaacacagtgaagacgccaagcatgtggattgggtcgttattcttgatgctgacatgatcattcgaggtcctatcatcccttggcaactcggtgctgaaaggggaagaccctttgccgcgcattatggctacttggtgggctgcgataacatccttgtgcgcttgcacacaaagcatcctgaactctgtgacaaagttggcggtcttctcgctatgcatatcgacgatcttcgggtcctggcccctctctggctctcaaagaccgaagatgttcgccaagatacagctcactggtccaccaatatcaccggagatgtttacggcaaaggttggatcagcgagatgtatggttactcctttggtgctgcagaggcaggacttaagcacaagattaacgacgacttgatgatatatcctgggtatgttccacgagaaggtgtcgagcctattcttatgcattacggtttacctttttccattgggaactggtcattcactaaactggaccaccacgaagacaatatagtctacgactgcaatcgtctcttccccgagcctccatatccaagagaggtgaaaataatggaacctgatccgtataaacgaagaggtctgattttgagtctagaatgtatgaatacattgaacgagggactcatactgcgtcacgcagaaaatgggtgtccgaaaccaaagtggaccaaatacttgagctttctgaagagcaaaactttcatggagttaacaaagcctaaactgcttgtaccaggaagtgtacatatcctgccagaccaacacgagccgccacccattaatgaattcaaaggaacttatccaaagattcacacactgttttctactgagtgcacgacttatttcgattggcaaacagtcggcttcatgcacagtttccgccagagcggccaacctggaaatatcactcggcttctcagttgcacagatgaagctcttaaaaactataaaggtcatgacttggccccgacgcattatgttccttcgatgagcagacatcctctaacaggcgattggtacccggcaattaacaaaccagcagcggttgtccattggcttcaccacactaacattgatgcagagtacgtagttattcttgatgctgacatgatcctccgaggacccatcacaccttgggagtttcaggcagctcgaggccgaccagtttcgactccttacgactatcttattggatgtgataacgaccttgcaagacttcacacgcgtaatcccgaagcttgtgataaagttggtggagtcattataatgcacatagaggatctccggaaattcgcaatgtactggttgcttaaaactcaggaggttcgagcagagaaagaacactatgggaaggagttaactggggatatatatgaatccggttggatcagcgaaatgtacggttattcatttggtgctgcagagctaaatttgcggcatatcataaacaaagaaattttgatttatcccgggtatgttcctgaacctggtgctgactaccgagttttccactacggtcttgagttcaaagtgggaaattggagctttgacaaggcgaattggaggaacactgatttgatcaacaaatgctgggcaaagtttccagacccccctagtccttcggcagtgcatcaaacagacaatgatctacggcaaagagaccttctgagcattgaatgtggacagaagctgaacgaagctctgtttctgcatcacaagagaaggaattgccctgaacctggatctgaatcgactgagaagatgtcggtttcgagaaaagttggtaacattgaaacgaaacaaacacaaggaagcgatgatacaaaagagtcaagtggtgctgaagggagattcagcacgttgaaattatgggtgattgcgctgtggttgatatctggtgtagggttcttggtggtgatgcttttggtgttctcgactcgtagaggcagaggaacaacaagagggaaaggttacagaaacaagagacgaacttcgtactcgaacacaggtttcatggacacaaaatgatcgagagatagctgttagaatgagagcaatgtgtagatacaactaaaccaaaccaagaaaaggtgagacattttgcttcccccaaagtcatataggtttctttgtattctttttaagggtt

SEQ ID NO: 835 - DNA, 2751 bp, Brassica napus
ccgggcgaggattcggacgagattcaatctaatctgaattttagaaaaaagatattgagagtagcagtttggtgtcgtgatgaccactacctaatcataacccacctgttgttttatacaaggaacgcatggatccatcctcctcctcctcctcctctgtctccatgcattgacttttttttttcctctgttccaattcgaaatcgaccaacttccaaaatgctgtggggtttgatgctggtgattgcggctctggcggtggctttcgggtccgggtcggcggatgaatggggtcaaagggcaccgtatcggatccacacgctgttctcggtggagtgccagaactacttcgattggcagacggttggtctgatgcacagcttcaagaaatcccgacagcccggtccgattacccggttattgagctgtaccgaagaggagatgaagaattacagaggcatggatctcgctcccactttccgcgtcccctcctggagcagacaccccaagaccggtgactggtacccagcaattaacaaaccggtaggagttcttcactggcttcaacacagtgaagatgccaagaatgtggattgggtcgttattcttgatgctgaccagatcattagaggtcctatcatcccttgggaacttggtgctgaaaggggtagaccctttgctgcccactacggctacttggttggctgcgataacatgcttgtccgattgcacactaatcatcctgagctctgtgacaaagttggcggtcttctcgctatgcacatcgatgatcttcgcgtcctggcccctctttggctttccaagactgaagatgttcgccaagacactgctcactggtccaccaaccttaccggtgatgtttacggcaaaggttggatcagtgagatgtatggttactccttcggtgctgctgaagcaggactgaagcacaagataaacgacgacttgatgatatatccagggtatgttccacgagaaggtgttgagcctattctgatgcactacggtttgcctttttccatcggtaactggtctttcactaaacttgaccaccacgaagacaacattgtctatgactgcaaccgtctcttccccgagcctccatacccacgagaggtgaaaatgatggaacctgatcagtacaagcgaagaggtctactcttgagtctagaatgcatgaatacattgaacgagggactcataatgcgccacgctgaaaacgggtgtcccaagccaaagtggtccaaatacttgagctttctcaagagcaaaactttcatggagttaacaaagcctaaactgcttgcaccaggaagtgtacatatcttgccagaccaacaccaacaccagcagccgccacccgtcgatgaattcaaaggaccttatccaaagatccacacactgttttccaccgagtgcacaacttatttcgactggcaaacagttgggttcatgcacagtttcaggttgagtggtcagcccgggaacatcactcggcttctcagttgcacagatgaagatcttaaaaagtataaaggtcgtgacttggcccccacgcataatgttccttccatgagcagacatcctctcacaggggattggtacccggcaattaacaaaccggcggcggtcgttcattggcttcaccacacgaatatagatgcagaatacatagtaattcttgatgctgacatgatcctcagaggacccatcactccttgggagtataaggcagctcgaggacgtccagtttctactccttacgactatcttattgggtgtgacaacgatcttgcaaaacttcacacgcgtaaccccgaggcatgtgacaaagttggtggagtcataataatgcacatagatgacctcaggaaattcgcaatgtactggttgctgaaaacgcaggaggttcgagcagacaaagaacattacgcaaaggagttaacaggggatatatatgagtccggttggatcagtgaaatgtacggttattccttcggtgctgctgagctgaatttgaggcatatcataaacaaagagatattgatataccctggttacgtccctgaaccgggtgttgactatcgagttttccattacggtcttgagttcaaagtagggaactggagcttcgacaaggcgaactggaggaacaccgatatgatcaacaagtgctggtctaagttcccggacccgcctactccttcagaggttcatgaaacggacaatgatctacggcaaagagaccttctcagtattgaatgtggacagaagctaaacgaagctctgttgctgcatcacaagagaaggaactgccctgaacctggatccgagtccgagtcgaaggaggagagtatctccttgggttcgagaaaagtgggaaagttggaaacgaaacaagccaaaggaagcgatgagactacggaagaaacgacgtcagaagggagattcagcaggttgaagatgtgggtgatcgctgtgtgggtgatatctggagtagggttcgtggtagtgatgctattggtgtgctccactcgtaaagtcagggcaagagggaaaggttacagaaacaagagacgaactacttcttcctactccaagccgggtttcgaatgatcctgcgttcattttggcttgaaagtctttgagcattgtatttgtagagatacaaattaaaaccaaaaaggatattattccccacaaagtcatatatagagtttatttgtattc

SEQ ID NO: 836 - DNA, 2804 bp, Brassica napus
  misc_feature (104)..(104): n is a, c, g, or t
  misc_feature (347)..(347): n is a, c, g, or t
  misc_feature (419)..(419): n is a, c, g, or t
  misc_feature (434)..(434): n is a, c, g, or t
  misc_feature (448)..(448): n is a, c, g, or t
  misc_feature (491)..(491): n is a, c, g, or t
  misc_feature (506)..(506): n is a, c, g, or t
  misc_feature (542)..(542): n is a, c, g, or t
  misc_feature (1794)..(1794): n is a, c, g, or t
  misc_feature (1951)..(1951): n is a, c, g, or t
  misc_feature (2752)..(2752): n is a, c, g, or t
ccgggcgaggattcggacgagattcaatctaatctgaattttagaaaaaagatattgagagtagcagtttggtgtcgtgatgaccactacctaatcataacccncctgttgttttatcaaggaacgcatggatccatcctcctcctcctcctcctctgtctccatgcattgacttttttttttcctctgttccaattcgaaatcgaccaacttccaaaatgctgtggggtttgatgctggtgattgcggctctggcggtggctttcgggtccgggtcggcggatgaatggggtcaaagggcaccgtatcggatccacacgctgttctcggtggagtgccagaactanttcgattggcagacggttggtctgatgcacagcttcaagaaatcccgacagcccggtccgattacccggttnttgagctgtaccgangaggagatgaaganttacagaggcatggatctcgctcccactttccgcgtcccctcntggagcagacacccnaagaccggtgactggtacccagcaattaacaaaccngtaggagttcttcactggcttcaacacagtgaagatgccaagaatgtggattgggtcgttattcttgatgctgaccagatcattagaggtcctatcatcccttgggaacttggtgctgaaaggggtagaccctttgctgcccactacggctacttggttggctgcgataacatgcttgtccgattgcacactaatcatcctgagctctgtgacaaagttggcggtcttctcgctatgcacatcgatgatcttcgcgtcctggcccctctttggctttccaagactgaagatgttcgccaagacactgctcactggtccaccaaccttaccggtgatgtttacggcaaaggttggatcagtgagatgtatggttactccttcggtgctgctgaagcaggactgaagcacaagataaacgacgacttgatgatatatccagggtatgttccacgagaaggtgttgagcctattctgatgcactacggtttgcctttttccatcggtaactggtctttcactaaacttgaccaccacgaagacaacattgtctatgactgcaaccgtctcttccccgagcctccatacccacgagaggtgaaaatgatggaacctgatcagtacaagcgaagaggtctactcttgagtctagaatgcatgaatacattgaacgagggactcataatgcgccacgctgaaaacgggtgtcccaagccaaagtggtccaaatacttgagctttctcaagagcaaaactttcatggagttaacaaagcctaaactgcttgcaccaggaagtgtacatatcttgccagaccaacaccaacaccagcagccgccacccgtcgatgaattcaaaggaccttatccaaagatccacacactgttttccaccgagtgcacaacttatttcgactggcaaacagttgggttcatgcacagtttcaggttgagtggtcagcccgggaacatcactcggcttctcagttgcacagatgaagatcttaaaaagtataaaggtcgtgacttggcccccacgcataatgttccttccatgagcagacatcctctcacaggggattggtacccggcaattaacaaaccggcggcggtcgttcattggcttcaccacacgaatatagatgcagaatacatagtaattcttgatgctgacatgatcctcagaggacccatcactccttgggagtataaggcagctcgaggacgtccagtttctactccttacgactatcttnttgggtgtgacaacgatcttgcaaaacttcacacgcgtaaccccgaggcatgtgacaaagttggtggagtcataataatgcacatagatgacctcaggaaattcgcaatgtactggttgctgaaaacgcaggaggttcgagcagacaaagaacattncgcaaaggagttaacaggggatatatatgagtccggttggatcagtgaaatgtacggttattccttcggtgctgctgagctgaatttgaggcatatcataaacaaagagatattgatataccctggttacgtccctgaaccgggtgttgactatcgagttttccattacggtcttgagttcaaagtagggaactggagcttcgacaaggcgaactggaggaacaccgatatgatcaacaagtgctggtctaagttcccggacccgcctactccttcagaggttcatgaaacggacaatgatctacggcaaagagaccttctcagtattgaatgtggacagaagctaaacgaagctctgttgctgcatcacaagagaaggaactgccctgaacctggatccgagtccgagtcgaaggaggagagtatctccttgggttcgagaaaagtgggaaagttggaaacgaaacaagccaaaggaagcgatgagactacggaagaaacgacgtcagaagggagattcagcaggttgaagatgtgggtgatcgctgtgtgggtgatatctggagtagggttcgtggtagtgatgctattggtgtgctccactcgtaaagtcagggcaagagggaaaggttacagaaacaagagacgaactacttcttcctactccaagccgggtttcgaatgatcctgcgttcattttggcttgaaagtctttgagcattgtatttgtagagatacaaattaaaaccaaaaaggatattattccccacaaagtcatatatagagtttatttgtattctnaaggatttgttctttgtttttaagaattttaaattggcattttgttcttcta

SEQ ID NO: 837 - DNA, 1462 bp, Arabidopsis lyrata
aaaaattaaaagtgtacaaaaaaataaattaaaaaaaaaacaaaataaatagtcttctacttctctctctctctctctctgtttatcaaaatctcacatcgagacgaaattagagctactcagacttgttctattacactgttaccttctccagaaaaagcgttacctttttattgtttgtccgtacgaggaagaatctaggagacagagctagctgattaattttgtgcgaaagatgcaactttttcatagctgttgtggtaaaggatttgatgggaagaagaaagaaaaggaagagccatcttggagggtattttcattgaaggaacttcatgcggccactaacagtttcaattatgataacaaactcggtgaaggccgattcggtagtgtctactggggtcagctatgggatggatcacaaattgcagtcaagagattgaaggcatggagtaacagagaggagattgattttgctgtggaagtcgagattcttgctcgtattcgtcacaagaatttgttgagtgttcgtggctactgtgcagaaggccaagaacgtcttcttgtgtacgagtacatgcctaatttgagcttggtttcgcatcttcatggccagcattcagctgaatgccttttagattggaccaagcgaatgaagatcgccataagttctgctcaggctattgcctacctacacgaccacgcaaccccacatatagtccatggagatgtgagagctagcaatgtgttactagattctgaatttgaagctcgggttacagattttggatatggtaagctgatgccagatgatactggagatggagctaccagagccaaaagtaataatggatatatctcaccagaatatgttacatcaggaaaagaatcagaaactagcgatgtgtacagtttcggtatccttttgctggtactggttagtggcaagagaccactcgaaaggctaaatccaacaacaacgcgaggtataaccgagtgggttttaccacttgtttacgaaagaaaatttggtgaaatcgttgataagaggctgagcgaggagcatgtggaagagaagctgaagaaagtagtcttggtggggcttatgtgtgctcagacagatccagacaagagaccaacaatgtctgaggtcgtggagatgctggtgaatgaatcaaaggagaaaatgtctgaacttgaagccaatccgctcttcaagaatccatatagcaacaacgaaaacaatagagagcatgttacagaggtaagctcagatgtgatctcagaagagaaagatcaacaacaacatgaataggaatggttaggcacaggaattcgtttgctcagattattttttatgatcattgcttatttttttggtgtgtttcttggttcatatttcataacattgatttgatcattactggagattagagtttgtaaggtgtggtattggctcata

SEQ ID NO: 838 - DNA, 1290 bp, Arabidopsis lyrata
cttgtctcagattagctttgtaataatatctagctgggtttcctgtaatttctcgttcggattcttgttaccatgattcggctatagtgtttgtgcctctgattgattgtcccaagcatcgttctttacttatttttagagatagctctgagatctgtctctgcgattcgtcggattttattagggttttttttttttgttttggatttcttcttctagggtatcgaagaggatagagaaaatgcgggtgtcctcagagatactccttctttctttggttccggcgttgactttttatcattctggtttgagttctaatcgtttgaaacctcttcaaaagagtgattggcgtggtaatcttagttaaacaaaaatttctctgtttttcaagtttctcttcggtttcgtttgttctcacgcattttctatctcgaagaagaacaagcttttgatctcgttcttcggacattttagtcagtaaccaatcttttgacatttcggctgctcgatttacttttggatatgagctctgtctgtggtgggttggatttcaaagatgcagagagcagctctgcttccagtcccaatatatgttctaatggctcatcaaagcatatctcttgtgttggatctgatgatgctcaagagtctgatggtgatgatagtggttatatacaacaatatgtgattgaagattccaaagacaaggcgatctgcgaacccatccttgagtctttacctcttgaatctttggatgatgaaactgaagacaagaaccttgcatccgcattgcaagacatgttctctgaaagtatgagtgtggttactctgattcctgccattaaaggtggtcgagagaagcatggcaagtcactcgagaagctgagagtgtcatgggctgaagatgtgtatgatccgccaccttccattgtctctcacacaagaagcaagaaacagcaaccgcagaaatcaaagagcaaagacaacctgaagaagaatggaaagaaaggacaaaagggaagcagccattcccgtggcagcaaagacaagaagcagatttcttctcgcagcagcagcaaatacagtcgtgataagtttgattgggcaacacaaatgtctgttctagctgcgtcttcttgaatctgtgtagcatcaccaaggcacttgcgtcttccttactcttttctctctcactctctcttgtttataaataaaaagatttggtgtgaaaacttttcttgagtttcagaacgattgttgttattcgtacggaattgattttgattttac

SEQ ID NO: 839 - DNA, 1224 bp, Arabidopsis lyrata
atgtctctgatctgccgcctcaatctttgtcggcgtttctccaccgccctgccaagaagagcggaggacataatgtcaaacccagattgtcgtcccgcgcagctatgcttgagagtctcgtacttgatcagattcgttggagatctcgacacggcggcgaagtacgctcgtttggctgttttcaccgacatcaaatcggaggccacagcagcaacatgtcaagccatcatcggaggcatgttgcagaataaaaggcacgatgacgcttacgatctctacgatttcttcttcaatcactttaagctcagacccaacagccattgctgtaactacatcatcgaatctcgtttcaaacaaggtttagttgacgaagctctcggtttccaccaccgatccatcgaatctggtatggtccacgactacccaagcaacgatactttcagggtcttgactaaagggttagtccactccggtcgattagaccaagccgaagccatgcttagagacaggacagtcgataggatcatctacccagatcacgtggcgtacaactatctgattcgcgggtttttggatcttgggaatttaggcaaggcgaatctagtcctggacgaattcaaacgcttgtttcttattaccctctctgagaccaaagatgatttgcaccattcaaactatgaaaacagagtggcattcgtgatggccacattcatggagtactggtttaagcaaggtaaagaggtggaagctatggagtgttacaaccgttctgttctatcaaacaggttactggtttgtgccgaaacggctaacgcccttttggtagtcctgctcaaatacggtgagaaaaaacatgcttgggcattgtaccatgatatcttagataaaagtagaacttaccctgataccattaagataatggtggacgagtgttttgatatgggtcgatttagggaggctatgaagacctacaacaaggcgagagccaagaaccattacctcagtgacatatacatttttacaaagtgttgtcaaaacgggatgttgtcagaagcagagtctatctttgctgattcacttgctgatgatttcgcatacattgatgttgacacttctaaaacaatgatggattcttatgtgaaggctgggagaatccatgatgctataaaaacctccaacaagatgatcgatgcaactctacaggaggtctcccatctcttttga

SEQ ID NO: 840 - DNA, 2869 bp, Arabidopsis lyrata
aaaggagcgaaatttgcagaagaaacaaagcataaccccccagagaaagattttctcccaacaagaccaaacttcgaactccacgagaactaccattaaccaaaactagaaatagagacagagattacacaaatttcttgcctttactccatagtttttctcagatagcattttcctctgtctttggctctttgtgaacttctccttattccggtttgggtttcccgagaaaatctagctagaaaaaagaagggatccagtagcagaaccagaagctaaacccaatcaaagagaaagctctgagcaaaagacgttttctgggttcgtttaattgaaaagaaatggctgattcaaccaaagtaaggctagttcgttgcccaaaatgcgagaatctcttatcagagcctgaagattccccctttttccagtgtggtggctgcttcaccgttcttcgtgccaaaatcaaggagcgtgaagcagattctgtttcagtcaagtccgttgaagataaagccaaaccaatttcagctaactctactagttccccagagaaagcaattgtggattctagtgaaacttcatctgactctgatgttccatcaaattctgtttctttgagacaccaccaaaatgttgttcctgttgatgttgagagtgatcctggttcaaaagaacaaggtaacagatctatattaggggataaagatgaccttaaatctcaatcggggagacaagactctggtttggatcggtttaggaaaagaacaactacgagatgtgattctgaaagtgtcatcaacagattatccacttcaaggcatccttgtgatgaaggcacttcttcttcagctaactactttccagattcactccatgagttccagaaacatttgaaagaccagagcaatgaagcaatcgagcaagaccgagctggacttctgagacagttagaaaagatcaaagaacagcttgttcagtcttgcaatgtggcgactgacaagtctaaagaacaggttcctagttcttcgtctgcctcggggttgaacaaggcgcctccaatgcggtttcacagtacgggaaatcacgctgttggaggtccttcttattaccatcaacatcctgaaccgcagtttccttacaacaacaacaacaatgaagtccctatgcaccatagtctgatgcatccctcttatggagacactcataggttccctatacacggaagaggtcctcatccgctacttctcgggacaatatgttggtaataataacaacggtcatgacctctttgacgcatacccgcagcaaaacgggcattttcatcactcatcttgctcttgttaccagtgttatgataataaatactggcgaggtccagcaccggtgatccctgatgcaccctataacgccggtttttatcctcatgagagcgttatgggttttgctccaccgcataatccaagaacttatggttctcgtggtctacagcctcatggcagatggcctagtaacttcagtgatgctcaaatggactctctttcgcggatacgtcctcctaaagttgtattatcaggtggatctcgtcatatccgccctttggcaggtggtgctccgtttataacctgtcaaaactgttttgagcttctacaattgccaaagaaaccagaggctggtacaaaaaaacagcagaaagtgcgatgtggagcatgctcttgtttgatagatttatctgttgttaataacaaattcgttctctcgacaaacacagcttcaacgagacaaggagaagcccgtgtagctgctgattacacttctgatgactatgatcttcttggttatgtgtttcattcgttggatgatgaaccaagagatcttccgggattgatttcagacaagtctcaagatatgcagcacgttcattctcattccgctagcctttccgaggacgagctaagctcagacagtctaacagctaagccactagctcaagctcaagataactttgttgattactcttcgatcaatcatgaccggtctggagcaggcagccgtagctctcgttcggaacacgacaaggtcacactgagcaagacgacagctatgagacagaactccatgaaagaggtttcacttgcaagtgagatggaagttaacttcaacgactactctcatcgtaacagtggagtatctaaagatcagcagcaaagagccaagaagagcggatttgcaagcattgtgaagaaaagcttcaaggatctgacaaaatctattcagaatgatgaagggaataaaagcaatgtttcgataaatggaaatcctttaacagaacgtctgctgagaaaagctgagaagcaagccggagtcattcagccaggaaactactggtatgattacagagctggattctggggagtaatgggaggtccaggtcttggaatattaccgccattcatagaagagcttaactacccaatgccagagaactgctcaggtggaaccacgggagtgtttgtcaacgggagagagcttcaccggaaagatttggacttgcttgcgggtagaggacttcctccagacagagatagatcatacattgttgacatcacgggtagagtcatagatgaagacaccggtgaagagctcgattgcctcgggaaactagccccaacgattgagaaattgaagcgtgggtttgggatgagactcccgaagagaattacgtgaaggaagatatgacgagatatgtatatttagttgaatatcttctgtttaacatctactgaaaatttagagagctttatgtatttatttagaaattggtattatttgcttccaagtttgatttttagactctttcaatcaaaacttg

SEQ ID NO: 841 - DNA, 1265 bp, Arabidopsis lyrata
gtctctgtttgtcttcctaatccgtactctgttctcttctcttcttttggagaaaaaaaaaaatggaatggataaaatcaatgcccaaaatcgagcttcatgctcatctcaacggctccattagagactccactcttctagagcttgctagggttcttggtgagaaaggtgttatagtgtttgctgatgttgaacatgtcattcgaaaaaatgatcgatctttggttgaagtcttcaagttgtttgatttgatccataagctcactactgatcacaaaaccgtgacaaggatcactagagaagttgtagaagattttgctttagagaatgtggtgtatctcgagttaagaacaactccaaagaggaatgattccataggtatgagtaaacggtcttacatggatgcggttattgaaggtctgagatctgtcagtgaagtcgatattgattttgttacggcatctgattctcaaaaactgctcaatgcgtgtgatggaattggaagaaagaagatttatgttagacttcttcttagtattgaccgtagagaaacaaccgagtctgcaatggaaactgttaagctcgcattggaaatgagagatgtcggggtagttggtatcgatctttcagggaatcctcttgttggagaatggagcactttcttgcctgcattacaattcgcgaaagacagtaatcttcacatcactcttcactgtggagaggtccccaatccaaaagaaatccaagccatgcttgatttcaaaccgcatcgaattggccatgcctgtttcttcaaagatgaagattggacaaagttgaaatctttcaggactccggttgaaatatgtctaacatccaacatcataaccaaatcgatatcgtccatcgatatccaccatttcgctgatctctacaatgcaaatcacccattgattctatgcactgatgattttggagtattctccactagcctctccaatgagtacgctctcgctgttcgttcttttggtcttagtaaaagagaaacctttgcattggctagaacggcaatagacgcaacgtttgcagaagatgaagttaagcaacaactttggttgatttttgattcagcctcgccagagtatgcttagtgcttcacatttttaccggtttacttgatttggttgggtttatatacaaaaccggacaaaaggtgttttggttcattggttggttaaatgatttacattcgtctcagaattcgattgttatattattttaattta

SEQ ID NO: 842 - DNA, 1504 bp, Brassica napus
tctcttctcttctctactagacagaaaccaacaaaaaaatggaatggatacatccaatgcccaagatcgagcttcatgctcacctcaacggctccatcagagacaccactctcctagagcttgctagggttcttggtgagaaaggggttatagtgttctctgatgttgaagatgtcattcagaaaaatgatcgatctctggatgaggtgttcaagttgtttgatttgatccatatgatcaccactgatcaccaaacagtgacaagaatcactcgagaagttgtacaagactttgctttggagaatgtggtttacctcgagttacgtacaactccaaagaggaatgattcgataggtatgagtaaacgttcttacatggaagcggttatcaaaggtctgagatctatcagtgaagtcgatgttgagtttgttgccgcgcctgattctgagaaactacacaactcgtgtgatggagttggaagaaagaagatttatgttagacttcttcttagtattgaccgtagagagacaacagagtccgcaatggagactgttaagctcgcattggagatgagaaatgtcggtgttgttggtatcgatctctctgggaaccctcttgttggagaatggagcaccttcctacctgcgttacagtttgctaaagacaatgatctttacatcactcttcactgtggggaggtccctaatccgaaagagatccaagcaatgcttgatttcaaaccgcatcgagttggccatgcttgtttcttcaaagatcaagactgggaaaaattgaaatctttccggattccggtggagatatgtctatcatccaacattataaccaaatccatatcttcaatcgatatacaccattttgctgatctctacaaggcaaagcatccgttgattatatgcactgatgattttggagtgttctccactaccctctccaacgagtactctctcgctgttcgttcctttggtcttggtaaaagagaaacatttgcgttggctaaatcaggcatagacgcaacgtttgcagaagatgaagttaagcaacaacttgggttgatttttgattcagcctcgccagagtatgtttagtgttctgcttttaccggtttacctggtttgattgtgttcgtaccaaatggaggaaatgtggtttggttcattggaattgataacatacggtatttccattgttactaatattttacaatcagtatatgaactttttaacttttaattattcttatttttcagtctctgttcttgtttgtactgtatgtattgttttatagttaatgcagagtttgttcaaattgatgcaataacaaagaatttagatgaattctcgtgtgaacagtagatttatagattagaggctatgactaataatatcattactgcaaattttttgcaagtccatagtctgttaaatttcgtaactttcagctctgaaatattttttgttggtttagtatcaaacaagtaataaa

SEQ ID NO: 843 - DNA, 1546 bp, Brassica napus
  misc_feature (1249)..(1249): n is a, c, g, or t
  misc_feature (1296)..(1296): n is a, c, g, or t
ggcttccttatagaaacgtcttatctctgcactgtgtcactctctcttctcttctctactagacagaaaccaacaaaaaaatggaatggatacatccaatgcccaagatcgagcttcatgctcacctcaacggctccatcagagacaccactctcctagagcttgctagggttcttggtgagaaaggggttatagtgttctctgatgttgaagatgtcattcagaaaaatgatcgatctctggatgaggtgttcaagttgtttgatttgatccatatgatcaccactgatcaccaaacagtgacaagaatcactcgagaagttgtacaagactttgctttggagaatgtggtttacctcgagttacgtacaactccaaagaggaatgattcgataggtatgagtaaacgttcttacatggaagcggttatcaaaggtctgagatctatcagtgaagtcgatgttgagtttgttgccgcgcctgattctgagaaactacacaactcgtgtgatggagttggaagaaagaagatttatgttagacttcttcttagtattgaccgtagagagacaacagagtccgcaatggagactgttaagctcgcattggagatgagaaatgtcggtgttgttggtatcgatctctctgggaaccctcttgttggagaatggagcaccttcctacctgcgttacagtttgctaaagacaatgatctttacatcactcttcactgtggggaggtccctaatccgaaagagatccaagcaatgcttgatttcaaaccgcatcgagttggccatgcttgtttcttcaaagatcaagactgggaaaaattgaaatctttccggattccggtggagatatgtctatcatccaacattataaccaaatccatatcttcaatcgatatacaccattttgctgatctctacaaggcaaagcatccgttgattatatgcactgatgattttggagtgttctccactaccctctccaacgagtactctctcgctgttcgttcctttggtcttggtaaaagagaaacatttgcgttggctaaatcaggcatagacgcaacgtttgcagaagatgaagttaagcaacaacttgggttgatttttgattcagcctcgccagagtatgtttagtgttctgcttttaccggtttacctggtttgattgcgttcgtaccaaatgaaggaaatgtggtttggttcattggaattgataacatacggtatttccattnttactaatattttacaatcagtatatgaactttttaacttttaattnttcttatttttcagtctctgttcttgtttgtactgtatgtattgttttatagttaatgcagagtttgtttaaattgatgcaataacaaagaatttagatgaattctcgtgtgaacagtagatttatagattagaggctatgactaataatatcattactgcaaattttttgcaagtccatagtctgttaaatttcgtaactttcagctctgaaatattttttgttggtttagtatcaaacaagtaataaa

SEQ ID NO: 844 - DNA, 1322 bp, Raphanus sativus
  misc_feature (564)..(564): n is a, c, g, or t
  misc_feature (585)..(585): n is a, c, g, or t
  misc_feature (861)..(861): n is a, c, g, or t
  misc_feature (873)..(873): n is a, c, g, or t
  misc_feature (942)..(942): n is a, c, g, or t
  misc_feature (1059)..(1059): n is a, c, g, or t
  misc_feature (1116)..(1116): n is a, c, g, or t
  misc_feature (1171)..(1171): n is a, c, g, or t
  misc_feature (1183)..(1183): n is a, c, g, or t
  misc_feature (1242)..(1243): n is a, c, g, or t
gggcttcctcatagaaacgtcttatctctgcactgttgtcactcttctcttctctacgagacgaaaccaaacaaaaaaatggaatggatacacacaatgcccaagatcgagcttcatgctcacctcaacggctccattagagactccactctcctagaacttgctagggttcttcgtgaaaaaggggttacagagttgactgatgttgaagatgtcattcagaaaaatgatcgatctttggatgaggtcttcaagttgtttgatttgatccatgtgatcaccactgatcaccaaactgtgacaagaatcactagagaagttgtacaagactttgctttggagaatgtggtttatctcgagttacgaacaactccaaagaggaatgattcgataggtatgagtaaacgttcttacatggaagcggtaatcaagggtcttagatctatcagtgaagtcgatgttgagttttttaattctcaacaactaaacaagtcgtgtggaagaaagaagatttatgttagacttcttcttagtattgaccgtagagaaacaacagagtctgcnatggaaactgttaagctcgcnttggagatgagaaatgtcggtgttgtcggcatagatctctctgggaaccctcttgttggagaatggagcactttcttgcctgcgttacagtttgctaaagacaatgatctttacatcactcttcactgtggagaggtccctaatccagaagaaatacaagccatgcttgatttcaaaccacatcgagttggccatgcatgtttcttcaaagatcaagattgggagaagttgaaatctttcaggattccggttgagatatgtctatcatccaacatnataaccaaatcnatatcttcaatcgatgtacaccactttgctgatctctacaaggtaaagcatccgttgattatatgcacngatgattttggagtgttctccactaccctctgcaacgagtactctctcgctgttcgttcctttggtcttggtaaaagagaaacattttcattggctaaatcaggcatagacgcaacntttgcagaagatgaagttaagcaacaacttaggttgatttttgattcagcctcgccngagtatgtttagtgttctgcttccaccggtttacctggtctgattggttcgtacnaaatcgggaaantgtgttctggttcgttggaattgatgacattcggtatttccattgttactaatatttannttacaattagtatatgaaactaaactacactttttataaacataaagagtattgaaatataatatttaatttgaatcga

SEQ ID NO: 845 - DNA, 3663 bp, Arabidopsis lyrata
atgatccccaacggagaattgagattgccagctcccaaggtccgtgatggccgcgtgtctcccccagctcctattccggtcaccagaaccctcgtggccgatactgacgccacttccgatgacgacgatatgagtacaaattccgaggatgtctctctcgattcgtctcccgagaacagtagagtgtccagtgccgttggtcgcagctacggaagaaattcttcttattatacatactccgaggtgagctcatcaagagagactttggtcggtgcacgcgaacagacgggacctagatttgatggtgatacggaggaggatgaatccaccgattcagcttctagctcgcaattttctccgccgccggcagctgggaggattaatggcggcgtacctcaggagtttgatgagacgtttccttctgaagaagtaagcgatattcccagtgcccctccattttccggggcagcagaggaatctgaagaaattaaaccagcaacttcaagcgttcaagtttcagaagtcaaaacagaagattgtgtagaaagtagaaagactggccactttactagacctagtgcagcttctgagtcatctggggcacctgatcaacatccagctcggcttccaacttttcatgcaagttctcgtgggccatggcatgccgtggtttcctatgatgcatgtgtacgactttgtctgcatgcatggtcaacgggttgcatggaggctcccatgtttttggaaaatgagtgtgctcttctacgagaagcatttgggttgcagcaactccttttgcaatcggaggaggagcttctggcaaagcgatcttcacaagctccgcacgaaggagttgcaccaaaatccaagaaaaacattggcaaaatgaaggtgcaagtacgacgtgttaaaacagttatggatggtccaactggctgtagtatatcatctttaaagccatcgttgataaagtttgagaaaatccggattcacttttccaatatgtcaacacgcttattttctggatggcgggctctaaggaagatccatgtccgtgtaccagccaatggttcttctcttcctcgtcaaagtctggcatatgtacatgccagtacacagtacttaaaacaagtttctggtctcctgaaaactggtgtcacaagtctacgtaataattcaacgtcttatgatgttgtacaagaaacatactcgtgtaagttaaaattgaaaagcttagctgaagatgacgccattatgatgcaacccggatctggtgaaagccatgttttctttcctgatagtcatggagatgatctgatcgttgagatccttgatccaatggggaaggattttgggcgtgtgcttgtgcaactagctaatatttctgaagattcgtacgtttcaaatgattctaatgaagaaaccatacaggctgagaaacttcgctggtggtctgtttttcgtgagccagaacatcaacatgtgggaaaactccagctctatattgactattcagcaagttttgatgataacagccatttgaagtgtgcttctgttgcggaaacagtcgcatatgacctagtcctggaagtggccttgaaaatgcagcggtttcagcaaagaaacttgttgttatatggttcatggaaatggcttttggaagaatttgccacctactatgggatttcagatgtctacaccaagctcagatacttgtcctatgtaatggatgtcgctacaccgacttccgactgtctccatttggtacatgacttgttaacacctgtcatcatgaagggaaatggcaagagcgccttgagtcatcaagagaatcggatcttgaatgaaatcaaggaccagatcgagcagattctgaagctggtctttgagaactacaaatctcttgacgagtcatcattttctggaatgattgatgtggtcagttctgcatcaggggttccagcgccagcactcactcctgctgtgaaattgtacacgcttctgcacgatgtcttatcacccgaggatcagactaatctttgtcattattttcaggcagcagcaaagaagagatctagaaggcacatgggtgagacagatgagtttgttgcaaacaatagcgagcccaatttttgggatacgtctgcaatgtcggctgcttaccagaaaatgacaatggcctgcaagaatgtaaagaatgagatctacactgatattgagatccaaaatgaagatatacttcccagctttcttgaccttccaaacctgtcagcgtctatatatagcactgatctctgtaatagacttcgagcattcctcgttgcatgtccgccctctggcccttcaccaacagttgcagagcttgtgattgctactgcagactttcaacgtgatctttccagctggaacattagtcctatccaaggcggtgttgatgcaaaagagttgtttcatctatatatcatgatttggattcaagataaacgcctttcattacttgagtcctgcaaacttgataaggttaaatggtctggagtcaggacacagcattcaacaactccatttgttgatgaaatgtacaagaggctgaacgaaaccattcaagactatcaagttatcatttccagatggccagaatatatctttgttctggagagtgccattgctgatgttgaaaaagcaactgtggaagctctggagaagcagtatgcagatgtcttatcacctctcaaagaaaacttggctccaaaaaaactaagcttcaagtatgtccaaaaactgaccaaaagatctgtgattccatatatagtcccggatgagcttggcattctattaaactccatgaagaggatgcttgatgttctacggcctaatatagaggctaaatttaaagcatggtcttcatgcattcctgatggtgggaatgcagctcctggtgatcgtctttctgaggtgacagtgatgctcagagccaagttccgtagttaccttcaggctgtggtcgaaaagcttgtagaaaatagcaagctacaaaagacgacaatgttgaagaagattcttcaggactctaaagaaagtgttggagaatcagacatcagaagcaaaatgaataacctcaaggagcagctcaccaacacagtgaatcatctacactcggtttgtgagacgcatgtcttcatcgcattgtctcgaggatattgggatcgtatggggcagatcgttttaagctttttggagaacaggaaagagaatagagcttggtacaagggttctagagttgctgtctcgatattagacgatacatttgcagcacagatgcaacagctgcttggcaactcgttaagagagcaagacctggagcctcctagatcgatcatggaggttcggtcgattctttgcaaggacactgcagataataaagccaagtcgttctactactgagcatcttaacagctaaaaatgcttgaaagatttcagatctcatttgctcgtctgcttgaagctgcaagtatttttactgggtggagcaaatcgacgaaaccttgagaaagctttagatgtataataaagtacaatggttaccacatctttctttagtgctaatgaatgtcaatatattacaacaagactggcatcacatttgatacgaattgtgataagagt

SEQ ID NO: 846 - DNA, 1875 bp, Arabidopsis lyrata
atttcagattctctgacgttatctatttcgattagcacaaggtgaagctgaagcccatcaatggcggatgggtagcctctggtttctttgaagatgtatcggatttcagctacttctaatcttgtccctttccttccgtcgtcctccttcgttccgacacgacggtgttatcctcgcagagctactccttactccaggcgtatcaatctcaagcctctcacctctcgcattgttctcctcacgcgccgccgtcagcttggtcagatcgtggaggaggtagaagcagctaagaaacggtatgggaagcttaacacaattgtgatgaactcagttctagaagcttgcgttcactgtggaaatatcgatttggctcttcggatgttccatgagatggccgaacctggtggaattggagtcgactccattagttacgccactatcttgaagggattggggaaggctcggaggattgacgaagcgttccaaatgttggagactatagagcatggaactgttgctgggaatcccaagttgtcatcatctcttatctatggtctgcttgacgctcttatcaatgctggagatttacgtcgtgccaatggtctgcttgcacgatatgatattttgcttctagatcatggcaccccgtcagttctcatctataacctgttgatgaagggctatgtcaactcagaatctccgcaagctgcaataaatttgctggatgaaatgttacgacttagattggagcctgataggttgacttacaatactttgatccatgcctgcatcaagtgtggcgatatggatgtggctatgaagtttttcaaggaaatgaaggagaaagcagaggaatattacgacgattttcttcagccagatgttgtaacatacaccactttggtgaagggatttggggatgcgaaggatctgttatcactgcaggacatatatttggaaatgaaattgtgtgataacgtgttcattgaccgaactgcatttacagcagtagttgatgctatgctaaagtgtggttcaacaagcggggccctttgtgtatttggtgagatattgaagagaagtggagctaatgaagtcttgcgaccgaagcctcacttgtacctgtctatgatgcgtgcgtttgctgtccaaggggattatggaatggttagaaatctgtatcttcgcttatggccggattcttcaggatcaatctccaaggcggttcaacaagaagctgataatctcttgatggaagctgctctcaatgctggccagctcgatgaggccttagggattctttcaagtatcgtgagaaggtggaaggcaatcccttggacgactagtggaggcatggctgctgtccgcctagaagcattgttggggttttccaatctatattgcgtccacatctactaagtaaggtgataccaagtgaaccaatagaaagcattatgattcgatttgaaaccactcagccactgttaggcactttacagttgaagaatgtggtcatgcggtttttcaaggagcaagttgtaccaattgtagacgaccggggatgctgcataggccttttgcatcgggaggattgcatcaatcttgatgcgccattggtctcaatgatgagaagcccgcccacatatgtgaatacaacaacatcgattggtcgtgtcgtggatctggttttggaaaagaaacttaagatggttatagttgttcattgcggaaatcttagtgggagtggttatagctcaaaggcagtaggagcttttacaagagcacaattgtatcggctatttgaaccagaacaacagctgctttagtaaatgtaagtaatataacatcgcttcttatataagttagttcttccaa

SEQ ID NO: 847 - DNA, 752 bp, Arabidopsis lyrata
aaaaatggctacccgaagagctctgattaacgttcaccggatcattcgctccaccgccgtggttggccgacgctccgtcattcctgccgccgctaaccggattatattccggaatggagttgattcggggacaagattcttctgtgggaacactgcttctgcccagaattttgatattgatctctcgaacgaagagaataagagaagaacgatcaacagattgttgtataggagcaagcaaagaggttttttggaacttgatcttgttttggggaattgggttgaggagaatgttgattccatggacgaaaatggtgttaaatccctaattcatgtcctcaatttggaaaaccctgatctctggaaatggctaactgaacaggaacagcctccggaggaagtgagctctaatccggtgttctcggcgttacacgagaaagttatgaagaatctgaacaagcatgcagcaccagagacacgtgcagcggctggacagccctgggtcaaaggctgggacgatttcaagagaggccgtgatgctcctatttcagggaaccagtaaacataaactcctctttacagaagtaacaaactgaaaatacgttatgatatgaagtatctgaaaagagatatcaaatcgtagcaaccattacttttactcttgtattaataaagaaccaggccgtgaagaaggtccattgacgttgagataattacaaagttgtgtcttgtactcttgtttgttgaagttt

SEQ ID NO: 848 - DNA, 806 bp, Brassica napus
gaaacaaaatggccagccgaaaagctctaattaacatccaccgtatcatccgctccaccgcggtggttaacaggagatccgtgattccagccgctgctgcccgttcacatcctattttccgaaatggagttgattttgcgccgagattcttctgcgggaacacgtcgagtccacagaactttgatatagatctctctagcgaagagaagaagaggattacgattaacagattgttgtataggagcaagcaacgagggtttctggaacttgatcttgttttggggaactgggttgaagagaatgtcaattccatggacgagaacaccgtcaaatcccttattcatgtcctcgatttggaaaaccctgatctttggaaatggttaactggtcaggaacaacctccggagatagtgagctcaaatccggtattcttggcgttgcacaagaaagtcatgacgaatctgaacaagcatgcagcaccagagacgcgtgcagaagctggacagccttgggtcaaaggctgggatgatttcaagagaggccgtgatgctccgatatcagggaaccagtaaaataaaataaaaacactacttacgaaagtaacaaatttccaaaaagaaaatacgtttatataaaaagtatctttacatagataccgagtagtctttaccttttactattgtatgaataaagcgtgagagcatataatgcgtctcagaagtaaggttgagagagtgaattacaggatgtcttgcttgtcgaagttcttgatatataaatacaggtatcaagggattgcgtttgtt

SEQ ID NO: 849 - DNA, 842 bp, Brassica napus
catacgtccatgccgcgtacgtagcttgtatcctctagagtcgacccacgcgtccgaacaaaatggccagccgaaaagctctaattaacatccaccgtatcatccgctccaccgcggtggttaacaggagatccgtgattccagccgctgctgcccgttcacatcctattttccgaaatggagttgattttgcgccgagattcttctgcgggaacacgtcgagtccacagaactttgatatagatctctctagcgaagagaagaagaggattacgattaacagattgttgtataggagcaagcaacgagggtttctggaacttgatcttgttttggggaactgggttgaagagaatgtcaattccatggacgagaacaccgtcaaatcccttattcatgtcctcgatttggaaaaccctgatctttggaaatggttaactggtcaggaacaacctccggagatagtgagctcaaatccggtattcttggcgttgcacaagaaagtcatgacgaatctgaacaagcatgcagcaccagagacgcgtgcagaagctggacagccttgggtcaaaggctgggatgatttcaagagaggccgtgatgctccgatatcagggaaccagtaaaataaaataaaaacactacttacgaaagtaacaaatttccaaaaagaaaatacgtttatataaaaagtatctttacatagataccgagtagtctttaccttttactattgtatgaataaagcgtgagagcatataatgcgtctcagaagtaaggttgagagagtgaattacaggatgtcttgcttgtcgaagttcttatatataatacaggttcaa

SEQ ID NO: 850 - DNA, 951 bp, Brassica napus
attaccacttttgttgtacttctttgccttgtacattcgctgcggcacgatcgagaagagcatcaacaaaaaatggccagccgaaaagctctgattaacgtccaccggatcatccgctccactgcggtggttagacggagctccgtcaccccttccgctgcacctcctattttccaaaatggagttgatttgggggcaagattcttcagcgggaacacctcgagtccacaaaacattgatattgatctctccagcgaagagaagaagaggataaccatcaacagattgttgtataggagcaagcaacgagggtttctggagcttgatctggttttgggtaactgggttgaggagaatgtcaattccatggatgaaaccgctgtcaaatccctcattcatgtccttgatttggaaaaccctgatctctggaaatggctaacttctcaggaacagcctcccgagatagtgagctcaaatccggtatttctggcgttgcacaagaaagtcatgacgaatctgaacaaacatgcagccccagagacgcgtgcagcagctggacaaccctgggtcaaaggctgggatgatttcaagagaggccgtgacgctcccatctccgggaaccagtaaaatctaaaaaaaaacacactctctcttccttgcaaaagtaacaaactgcaaaaaacacgtttataaaagttatcttataaatataataaagtgccaggccgtgaagaaggccgggggtataaatgtgtctctgtagtgagtgacacgatgagatagataattggaagttcttgatatgttatcaagggatattgtatttttttttgaaattgcggtgttctctcttcagcttatgctgacgaagagttttggacagttctttaatgctacaaaccgcctccgagtacaagcaaaactttttttagtaagcaaaatatttgctat

SEQ ID NO: 851 - DNA, 905 bp, Brassica napus
gacacgacaaatgtaggcccattaccacttttgttgtacttctttgccttgtacattcgctgcggcacgatcgagaagagcatcaacaaaaaatggccagccgaaaagctctgattaacgtccaccggatcatccgctccactgcggtggttagacggagctccgtcaccccttccgctgcacctcctattttccaaaatggagttgatttgggggcaagattcttcagcgggaacacctcgagtccacaaaacattgatattgatctctccagcgaagagaagaagaggataaccatcaacagattgttgtataggagcaagcaacgagggtttctggagcttgatctggttttgggtaactgggttgaggagaatgtcaattccatggatgaaaccgctgtcaaatccctcattcatgtccttgatttggaaaaccctgatctctggaaatggctaacttctcaggaacagcctcccgagatagtgagctcaaatccggtatttctggcgttgcacaagaaagtcatgacgaatctgaacaaacatgcagccccagagacgcgtgcagcagctggacaaccctgggtcaaaggctgggatgatttcaagagaggccgtgacgctcccatctccgggaaccagtaaaatctaaaaaaaaacacactctctcttccttgcaaaagtaacaaactgcaaaaaacacgtttataaaagttatcttataaatataataaagtgccaggccgtgaagaaggccgggggtataaatgtgtctctgtagtgagtgacacgatgagatagataattggaagttcttgatatgttatcaagggatattgtatttttttttgaaattgcggtgttctctcttcagcttatgctgacgaagagttttggacagtt

SEQ ID NO: 852 - DNA, 822 bp, Raphanus sativus
  misc_feature (36)..(36): n is a, c, g, or t
  misc_feature (106)..(106): n is a, c, g, or t
  misc_feature (659)..(659): n is a, c, g, or t
gggttttacgatcgataacagaaacaaaatggccanccgaaaagctctaattaacatccaccgtatcatccgctccgccgcggtggttaaccggagatccgtgatnccagccgctgcaacccagtcacatcctattttccgaaatggagtcggactgggggcgagattcttgtgcggggacacgtcgagtccgcagaactttgatatagatctctctagcgaagagaagaagaggattacgatcaacagattgttgtataggagcaagcaacgagggtttcttgaacttgatcttgttttagggaactgggttgaggagaatgtcaattccatggacgagaacaccgtcaaatccctgattcatgttctcgatttggaaaaccctgatctttggaaatggttaactggtcaggaacaacctccggagatagtgagctcaaacccggtattcttggcgttgcacaacaaagtcatgacgaatctaaacaagcatgcagcaccggagacacgtgcagaagctggacaaccttgggtcaaaggctgggatgatttcaagagaggccgtgatgctcccatctcagggaaccagtaaaaattaaaaaacactacgttcgaaaataatgaatttccaaaaagaaaatacgttcatataaaaaaantataccgcgccgagtagtcgttactttttactattgtatgaataaagcgtgacagcgtataatgcgtctcagacgtaaggatgagatagagaattacagtgatatcttgcttgtcgaagttcttgatatataaatacaggtatcaagggattgtgtttgttga

SEQ ID NO: 853 - DNA, 901 bp, Thellungiella halophila
  misc_feature (32)..(32): n is a, c, g, or t
  misc_feature (56)..(56): n is a, c, g, or t
  misc_feature (63)..(63): n is a, c, g, or t
  misc_feature (141)..(141): n is a, c, g, or t
  misc_feature (144)..(144): n is a, c, g, or t
gaaatttaactttgccttctacatttcgctgngagaagaagaaccaaaaaaaacgnaaatggncagccgaaaagctctgattaacgtccaccggattatccgctccaccgcggtgactagccggaactccgtaactcctgncgncgcaacacgaacacatcctattttccggaacagagttgatttggggatgagattcttctccgggaacaccgcgagtccccagaattttcatatcgatctctctaacgaagagaataagaggataacgatcaacagattgttgtataggagcaagcaacgagggtttctcgaacttgatctagttctgggaaattgggttgaagagaatgtcaattccatggacgaaaacgctgtcaaatccctaattgatgtcctgggtttggaaaaccttgatctctggaaatggctaactggtcaggaacagcctccagaggcagtgagctcaaatccggtattcatggcgttgcacgagaaagtcatgaagaatctgaacaagcatgcggcaccagagacgcgtgcagcagctggagagccctgggtcagaggctgggacgatttcaagaaaggccgtgacgctcccatttcaggaaaccagtaaaaaaacacacttctatgtactaaagtaacaaaacctcaatcaaatacgttcatgtaaaagtatcttaaatagatactgaagcaaatattaccttttactattattgtatgaataaaaagagccaggtcgtggaggtgggaggtataatgtgtttctgtagtgacgatgaggcaattacattgatctgtcttatttgttgaagttcttgatactaatataaaagtgtcaatggattgtagtttgattctatgaataaataatgtgccgagtctgtaatgg

SEQ ID NO: 854 - DNA, 815 bp, Brassica juncea
ccacaaagctttgatattgatctctccaacgaagagaagagagagcatcaacaaaaaaatggccagccgaaaagctctcattaacgtccaccggatcatccgctccactgcggtggttagacagagctccgtcaccccttccgctgcacctcctattttccaaaatggagttgatttgggggcaagattcttctgctcgagtccacaaagctttgatattgatctctccaacgaagagaagaagaggataaccatcaacagattgttgtataggagcaagcaacgagggtttctggagcttgatcttgttttgggtaactgggttgaggagaatgtcaattccatggacgaaaccgctgtcaaatcccttattcatgtcctcgatttggaaaaccctgatctctggaaatggctaactgctcaggaacagcctcccgagatagtgagctcaaatccggtatttctggcgttacacaagaaagtcatgacgaatctgaacaaacatgcagccccagagacgcgtgcagcagctggacaaccctgggtcaaaggctgggatgatttcaagagaggccgtgacgctcccatctccgggaaccagtaaaagcaaaaaaaaaacacactctctttcttccttacaaaagtaacaaactgcaaaaaaacacgtttataaaagttatcttataaatataataaaatgccaggccgtgaagaaggccggaggtataaatgtgtttctgtagtgagtgacacgatgagatggataaattggaagttctttatatgttagttacagttatcaagggatattgtat

SEQ ID NO: 855 - DNA, 907 bp, Brassica napus
acgacaaatgtaaggcccattaccacttttgttgtacttctttgccttgtacattcgctgcgacacacgatcgagaagagagagcatcaacaaaaaaaatggccagccgaaaagctctgattaacgtccaccggatcatccgctccaccgcggtggttagacggtgctccgtcaccccttccgctgcacctcctattttccaaaatggagttgatttgggggcaagattcttctgctcgagtccacaaagctttgatattgatctctccaacgaagagaagaagaggataaccatcaacagattgttgtataggagcaagcaacgagggtttctggagcttgatcttgttttgggtaactgggttgaggagaatgtcaattccatggacgaaaccgctgtcaaatccctcattcatgtcctcgatttggaaaaccctgatctctggaaatggctaactgctcaggaacagcctcccgagatagtgagctcaaatccggtatttctggcgttacacaagaaagtcatgacgaatctgaacaaacatgcagccccagagacgcgtgcagcagctggacaaccctgggtcaaaggctgggatgatttcaagagaggccgtgacgctcccatctccgggaaccagtaaaagcaaaaaaaaaacacactctctttcttccttacaaaagtaacaaactgcaaaaaaacacgtttataaaagttatcttataaatataataaaatgccaggccgtgaagaaggccggaggtataaatgtgtttctgtagtgagtgacacgatgagatggataaattggaagttctttatatgttagttacagttatcaagggatattgtattttttttgaaattgctgtgttttctcttcagcttgtggtgacgaagagtttt

SEQ ID NO: 856 - DNA, 817 bp, Brassica napus
ggtggtcaggagagggacacgacaaatgtaaggcccattaccacttttgttgtacttctttgccttgtacattcgctgcgacacgatcgagaagagagagcatcaacaaaaaaaatggccagccgaaaagctctgattaacgtccaccggatcatccgctccaccgcggtggttagacggtgctccgtcaccccttccgctgcacctcctattttccaaaatggagttgatttgggggcaagattcttctgctcgagtccacaaagctttgatattgatctctccaacgaagagaagaagaggataaccatcaacagattgttgtataggagcaagcaacgagggtttctggagcttgatcttgttttgggtaactgggttgaggagaatgtcaattccatggacgaaaccgctgtcaaatccctcattcatgtcctcgatttggaaaaccctgatctctggaaatggctaactgctcaggaacagcctcccgagatagtgagctcaaatccggtatttctggcgttacacaagaaagtcatgacgaatctgaacaaacatgcagccccagagacgcgtgcagcagctggacaaccctgggtcaaaggctgggatgatttcaagagaggccgtgacgctcccatctccgggaaccagtaaaagcaaaaaaaaaacacactctctttcttccttacaaaagtaacaaactgcaaaaaaacacgtttataaaagttatcttataaatataataaaatgccaggccgtgaagaaggccggaggtataaatgtgtttctgtagtgagtgacacgatgagat

SEQ ID NO: 857 - DNA, 859 bp, Raphanus sativus
  misc_feature (3)..(3): n is a, c, g, or t
ggnaccgcgacccgaaagaacaaaaaaaaaacaaaaaaatggctagccgaaaaagtctgattaacgtccaccggatcatccgctccaccgcgatggttagccggagatccgtcactcctgccgccgcaacacgagcccatcccattttccgaaatcgagttgatttgggggcgaggttcttctccgggaacacgccgagtccacaaaactttgatattgatctctctaacgaagagaagaagaggataacggtcaacagattgttgtataggagcaagcaacgtggttttcttgaacttgatctggttttgggtaactgggttgaggagaatgttgattccatggacgaaaccactgtcaaatccctaattcatgtcctcgatttggagaaccctgatctgtggaaatggctaactgctcaggaacagcctccggagatagtgagctcaaatccggtattcttggcgttgcacaagaaagtcatgacgaatctgaacaagcatgcagcaccagagacgcgtgcagcagctggacagccctgggtcaaaggttgggatgatttcaagagaggccgtgacgctcccatctcagggaaccagtgaaagaaaaaactcactctcttccttacaaaagtaacagactgcaaaaacacgtttatataaaagtattttataaaaatataataatgtgtggcaggccgtgaagaaggccggagctataaatgtgtctcggtagtgacacgatgagatagataaatacagtcttgtttgtggacgttcttgatatgtttagttttgtgtttgttgaaattgatgtgtttttatttcaggcaataagtccttttgcctctggctcaact

SEQ ID NO: 858 - DNA, 788 bp, Brassica rapa
gctctaactaacatccaccgtatcatccgctctaccgcggtggttaacaggagatccgtgattccagccgctgctgcccgttcacatcctattttccgaaatggggttgattttgcgccgagattcttctgcgggaacacgtcgagtgcacagaactttgatatagatctctctagcgaagagaagaagaggataacgattaacagattgttgtataggagcaagcaacgagggtttctggaacttgatcttgttttggggaactgggttgaagagaatgtcaattccatggacgagaacaccgtcaaatcccttattcatgtcctcgatttggaaaaccctgatctttggaaatggttaactggtcaggaacaacctccggagatagtgagctcaaatccggtattcttggcgttgcacaagaaagtcatgacgaatctgaacaagcatgcagcaccagagacgcgtgcagaagctggacagccttgggtcaaaggctgggatgatttcaagagaggccgtgatgctccgatctcagggaaccagtaaaataaaataaaaacactgcttacgaaagtaacaaatttccaaaaagaaaatacgtttatttaaaaagtatctttaccttttactattgtatgaataaagcgtgagagcgtattatgctgcgtctcagaagtaaggttgagagagtgaattacaggatgtcttgcttgtcgaagttcttgatatataaatacaggtatcaagggattgcgtttgttgaattcgttttgtgttttctggat

SEQ ID NO: 859 - DNA, 999 bp, Raphanus sativus
  misc_feature (103)..(103): n is a, c, g, or t
ggacagtatattcctatgtggccaggagagggacacggtagtaccacttctgttgttcgcctttcattacaaaatataaacttcgccgtcctctcacattcgncgcgacccgaaagaacaaaaaatggccagccgaaaaagtctgattaacgtccgccggatcatccgctccaccgcggtggttagccggagatccgtcactcctgccaccgcaacacgagcccatcccattttccgaaatcgagttgatttgggggcgaggttcttctccgggaacacgacgagtccacaaaactttgagattgatctctctaacgaagagaagaagaggataacgatcaacagattgttgtataggagcaagcaacgtggttttctggaacttgatctggttttgggtaactgggttgaggagaatgttgattccatggacgaaaccactgtcaaatccttaattcatgtcctcgatttggagaaccctgatctgtggaaatggctaactgctcaggaacagcctccggagatagtgagctcaaatccggtattcttggcgttgcacaagaaagtcatgacgaatctgaacaagcatgcagcaccagagacgcgtgcagcagctggacagccctgggtcaaaggttgggatgatttcaaaagaggccgtgacgctcccatctcagggaaccagtgaaagaaaaaactcattctcttcacttacaaaagtcacaaactgcaaaaacacggttatataaatgtatcttataaaaatataataatgtgtggcaggccgtgaagaaggccggagctataaatgtgtctcggtagtgacacgatgagatagataaatacagtcttgtttgtggaagttcttgatatgttagttatgtgtttgttgaaattgatgtgtttttatttcaggcaataagtccttttgcctctggctcaactttcttggcatatgcagaactagttacttcatttagagtcaatgtttccttgcca

SEQ ID NO: 860 - DNA, 904 bp, Raphanus sativus
ccgcgacccgaaagaacaaaaagaaaacaaaaaatggccagtcgaaaaagtctgattaacgtccaccggatcatccgctccaccgcgatgtttagccggagatccgccactcctgccgccgcaacacgagcccatcccattttccgaaatcgagttgatttgggggcgaggttcttctccgggaacacgccgagtccacaaaactttgagattgatctctctaacgaagagaagaagaggataacgatcaacagattgttgtataggagcaagcaacgaggttttctggaacttgatctggttttgggtaactgggttgaggagaatgttgattccatggacgaaaccactgtcaaatccctaattcatgtcctcgatttggagaaccctgatctgtggaaatggctaactgctcaggaacagcctccggagatagtgagctcaaatccagtatttttggcgttgcacaagaaagtcatgacgaatctgaacaagcatgcagcaccagagacgcgtgcagcagctggacagccctgggtcaaaggttgggatgatttcaagagaggccgtgacgctcccatctcagggaaccagtgaaagaaaaaacacagtctcttccttacaaaagtaacagactgcaaaaacacgtttatataaaagtattttataaaaatataataatgtgtggcaggccgtgaagaaggccggcgctataaatgtgtctcggtagtgacacgatgagatagataaatacagtcgtttgtggaagttcttgatatgttagatatgtgtttgttgaaattgatgtgtttttatttcaggcaataagtccttttgcctctggctcaactttcttggcatatgcagaactagttacttcgttaagagtcaatgtttccttgcc

SEQ ID NO: 861 - DNA, 957 bp, Raphanus sativus
ccgctacccaaaagaacaaaaacgcaaaaaaaaatggccagccgaaaaagtttgatcaacgtccatcggatcatccgctccaccgcggtaattagccggagatccgtcactcctgccgccgcaacacgagcccatcccgttttccgaaatcgagttgatttgggggcgaggttcttctccgggaacacgacgagtccacaaaactttgagattgatctctctaacgaagagaagaagaggataacgatcaacagattgttgtataggagcaagcaacgaggttttctggaacttgatctggttttgggtaactgggttgaggagaatgttgattccatggacgaaaccactgtcaaatccctaattcatgtcctcgatttggagaaccctgatctgtggaaatggctaactgctcaggaacagcctccggagatagtgagctcaaatccggtattcttggcgttgcacaagaaagtcatgacgaatctgaacaagcatgcagcaccagagacgcgtgcagaagctggacagccctgggtcaaaggttgggatgatttcaagagaggccgtgacgctcccatctcagggaaccagtgaaagaaaaaactcattctcttccttacagaagtcacaaactgcaaagacaggcttatataaatgtatcttataaaaatataataatgtgtggcaggccgtgaagaaggccggagctataaatgtgtctcggtagtgacacgatgagatagataaatacagtcttgtttgtgcaagttcttgatatgttagttatgtgtttgttgaaattgatgtgtttttatttcaggcaataagtccttttgcctctggctcaactttcttggcatatgcagaactagttacttcattaagagtcaatgtttccttgccattactgtatttaagtctgtgaaccagtgaatctaactgcattaggtcatg

SEQ ID NO: 862 - DNA, 1117 bp, Arabidopsis lyrata
tgctgtataaactaccttgtaatgaaccgtgcgcgttcatacatttccttggggctgcttaagaagtccagctatgtcagttcccatattccatggaatcgatgcttctatatgccttcaaaatacagtttaaagccttcatgtgtgactgcacttggactgtctagtgttcattgctattctacaagatcaaagactgccaaatcaaagatttcaaccgctgtttctgtttcggattcggataaagagaaagacgcctttttcgttgttcggaagggtgacattattggaatttataaggatttgattgattgtcaagctcaagttggatcttcggtatatgatcttccagttagcgtttataagggtaagggatactcgttgcttaaagacacgacggaggagtatctttctagtgttgggctgaagaaaccactctatgtttttagagcttttgacttaaaagaagatatgtttggacctcttacaccttgtattttccaggatcaacttccttcagcttccatgtcagttgttaatcctttggaaaagcttgctaagcagaagccatctgctgatacctcatatgaaacttgcattattgagtttgacggtgcatcaaaaggaaatcccggtctctctggcgctgcagctgtactgaaaactgaggacggaagcttgatttgtaaaatgcgtcaaggtttaggaattgccacaaacaatgcagcagaatatcatggattaatcctaggattgaagcatgctatcgagaaaggttacacgaaaattaaagtgaaaactgactccaagctagtctgtatgcagatgaaaggtcaatggaaggttaaccacgaggtactctcgaagctccacaaggaagcaaaacaacttagcgaccaatgtctctcttttgagatcagtcaagtacttaggaatttaaactctgatgcggatgaacaggcaaatatggcttctcgtctttctgaaggagaagttgaagtggcttaaaggatattattggtgaactaatatagagagctttggtttttcttgtccatgctacatctaaacctgaaagcccttatctaacagtgtgagtggtgtctctaaagagcac

SEQ ID NO: 863 - DNA, 1027 bp, Raphanus sativus
  misc_feature (586)..(586): n is a, c, g, or t
  misc_feature (597)..(597): n is a, c, g, or t
  misc_feature (612)..(612): n is a, c, g, or t
  misc_feature (614)..(615): n is a, c, g, or t
  misc_feature (626)..(626): n is a, c, g, or t
  misc_feature (699)..(699): n is a, c, g, or t
  misc_feature (946)..(946): n is a, c, g, or t
  misc_feature (964)..(964): n is a, c, g, or t
gaacacaaatggagagctctacatcttcagctatcgttcttcatcagtcttccaatcatgacgaactcttcatgcagcagactcttcaattctcacaaactctcaaggatttaaagaacttgcggaaacagttatactctgctgctgagtacttcgaaacatcttatggcaaagaagaacacaaagaaacggtgatagagacgttgaaagagtatgcagccaaggcagtagtgaacacagtggatcatcttggttctgtctctgataaattcaactcttttctctctgataactcagcccatttctccaccactcgtcttcgtttatcttctctcgaacaaaggatgaaactatgcagagagtacatggggaagagtgggacttctcagcattgttttctcattcaatctcctcaccatcataagcgttacttcttccctcaacatggaagaggctcaagtttggctgcaggagatgactcacatcggttcaagagtgctgttcgatcaacaatactagaaaaccactccaatactgcaagtaaaactaacaagacaggaagcttctccttcttacacaacaacancagcaacatancaccaagggtaaaanannacaatctcctntgagatttcctctcatgcgttcaggatctctactgaaacgttcaagctccccaagccagccaagaatactggngttaccggaaccacaaagagcgatatctatgtcgacaagtagagagatagtggagataaagcaaaaatcttcattgagaaaggggaagaagagtctgatgctcaaggcattgatgagtatgagcagcaagtccagaaactaaataaatcttgtatttttacgttaatatgtagaaaattaatgtgtgaaatatgaaaaaaaagaaaaaataatgctcacccacagagagctctattcactttctttntacactctctccagcttngactttagactatagagtcaatcatcacttgtaaattgaatgcatccaatttgttttgtccta

SEQ ID NO: 864 - DNA, 972 bp, Brassica rapa
  misc_feature (115)..(115): n is a, c, g, or t
  misc_feature (170)..(170): n is a, c, g, or t
  misc_feature (212)..(212): n is a, c, g, or t
  misc_feature (242)..(242): n is a, c, g, or t
  misc_feature (245)..(245): n is a, c, g, or t
  misc_feature (251)..(251): n is a, c, g, or t
gaacacaaatggagacctctacgtctttagccatcgttcttcatcagtcttccaatcatgacgaactttccatgcagcagactcttcaattctcacaaactctcaaggatttaangaacttgcggaaacagttatactcagctgctgagtacttcgaaacatcttatggnaaagaagaacacaaagaaacggtgatagagacgttgaaagantatgcagccaaggcagtagtgaacacagtngancatctnggttctgtctctgataaattcaattcttttctctctgatgactcagcccatttctccactactcatcttcgtttatcttctctcgaacaaaggatgaaactatgcagagagtacatggggaagagtgggacttctcagcattgctttctcattcaatctcctcctcaccatcataagcgttactttttccctcaacatggaagaggtgaacgtggaagaggcacaagtttctctgcaggagatgactcgcataggttcaaaaatgctgttcgatcaacaatactagaaaaccacccaattactactacaagaaaagcttataagacaggaagcttctccttcttacacaacaacaacatcagcaacaacagaacgccaaacagtaaaagaggaaactctccaatgagatttcctctcttacgttcaggatctcaactgaaacactcaagctctccaggccagccaagaatactggcgttgttaccggaaccagaaagagcaatatctttgtcgacaagtagagagatagtggagataaagcaaaaatcttcattgagaaaggggaagaagagtctgatgcttaaggcactgatgagtatgagcagcaagtccagaaactaaatccatcgctttgtattttacattttataatgttcattcttaaaattgtacaaaaacatgtgaattaaggagagagcaataatggttatccttagtctta

SEQ ID NO: 865 - DNA, 1185 bp, Raphanus sativus
  misc_feature (29)..(30): n is a, c, g, or t
  misc_feature (41)..(41): n is a, c, g, or t
  misc_feature (317)..(317): n is a, c, g, or t
  misc_feature (988)..(988): n is a, c, g, or t
  misc_feature (1101)..(1101): n is a, c, g, or t
ggatggatcgaatattgtgttaaagagtnntgcagtggctncacttggatctatctctcttacttactcactccattatcttcctctcattaattaaatcagaacacaaatggagagctctacatctttagccatcgttcttcatcagtctgccaatcatgacgaactcttcatgcagcagactcttcaattctcacaaactctcaaggatttaaagaacttgcggaaacagttatactcagctgctgagtacttcgaaacatcttatggcaaagaagaacacaaagaaacggtgatcgagacgttgaaagagtatncagccaaggcagtagtgaacacagtggatcatcttggctctgtctctgataaattcaactcttttctctctgataactcagcccatttctccaccactcatcttcgtttgtcttctctcgaacaaaggatgaaactatgcagagagtacatggggaaaagtgggacttctcatcattgctttctcattcaatctcctcctcaccatcataagcgttacttcttccctcaacatggaagaggtgaacgtggaagaggcacaagtttttccgcaggagatgactcgcataggttcaagagtgctgttcgatcaacaatactagaaaaacacacaagtactactgcaagaaaagcttataagacaggaagcttctcctttttacataacaacatgagcaacaacagaacaccaaacagtaaaagaggaaactctcctctgaggtttcctctcttacgttcaggatctcaactgaaacactcaagctctccaggccagccaagaatactggcgttgttaccggaaccagagagagcaatatctttgtcgacaagtagagagatagtggagataaagcaaaaatcttcattgagaaaggggaagaagagtctgatgctcaaggcactgatgagtatgagcagcaagtccagaaactaaatccctccctttgtattntacatttttataatatttttttgaactatacattttataatgttcatccttaagattgtacaaaaacaacatgtgaactaaggagagagtaataatggttattctcaatcttntttagatgctttggttgaaaatggtgtggttgaatttccataggaacatacaaagtttctttactagttaagttttttcacttc

SEQ ID NO: 866 - DNA, 985 bp, Brassica oleracea
  misc_feature (401)..(401): n is a, c, g, or t
  misc_feature (479)..(479): n is a, c, g, or t
gcgtccggtcttgttctggctccacttggatctctctctcttacttacttactccattatcttcctcctctcattaaaatcggaacacaaatggagagctctacatctttggccatcgttcttcatcagtcttccaatcatgatgaactcttcatgcagcagactcttcaattctcacaaactctcaaggatttaaagaacttgcggaaacagttatactcagctgctgagtacttcgaaacatcttatggcaaagaagaacacaaagaaacggtgatagagacgttgaaagagtatgcagccaaagcagtagtgaacacagtggatcatcttggttctgtctctgataaattcaactcttttctctctgatgattcagcccatttctccactactcatcntcgtttatcttctctagaacaaaggatgaaattatgcagagagtacatggggaagagtgggacttctcagcatttctntctcattcaatctcctcctcgccatcataagcgttacttcttccctcaacatggaagaggtgaacgtggaagaggcacaagtttctctgcaggagatgactcgcataggttcaagaatgctgttcgatcaacaatactagaaaaccacccaattactactgcaagaaaagcttataagacaggaagcttctccttcttacacaacaacaacatcagcaacaacagaacaccaaacagtgaaagaggaaactctccaaagagatttcctctcttacgttcaggatctcaactgaaacactcaagctctccaggccagccaagaatactggcgttgttaccggaaccagaaagagcaatatctttgtcgacaagtagagagatagtggagataaagcaaaaatcttcattgagaaagggtaagaagagtctgatgctcaaggcactgatgagtatgagcagcaagtccagaaactaaatccctcgctttgtagattacattttataat

SEQ ID NO: 867 - DNA, 983 bp, Arabidopsis lyrata
gtatggaatgtgttaaagagtgtgtgtatagtgtctccacttggatctttcttacttactccattatcttcttctccttctctctctccctcatctcattaatggcgagctctacatctttagcgatagttcttcatcaatcttccaatcatgacgaactcttcatgaagcaaactcttcaattctcagaaactctcaaggatttaaagaatctgcggaaacagttatactcagcagctgagtacttcgaaacatcttatggcaaagaagaacacaaagaaacagtgatagagacattgaaagagtatgcagcaaaggcagtagtgaacacagtggatcatcttggttctgtctctgacaaattcaactcttttctctctgataactcaacccatttctccaccactcatctccgtgtatcttctcttgaacaaaggatgagactatgcagagattacatggggaagagtgggactcatcagcatttgcttctatttcaatatcctcgccatcataagcgttacttcttccctcaacaaggaagaggcacaagtttctctgcaggagatgactcgcaccggttcaagagtgctgttcgaacaacaatactagaaaacctcccaaatactgcaaggaatgttaacaagacaggaagcttctcttttgcacccatcatacacaacaacatcaacaacagaacaccaaataaaagaacaaactcgcctatgagattccctctcttacgttccggatctctactgaaacgttcaagctccccaagccaaccaaagaaaccgcccttaccggaacctcaaagagcgatatctgtgtcgagaaatacagagatagtggagataaagcaatcttcatcgcgaaaaggaaagaagattctgatgctcaaggcattgatgagtatgagcaagtccagaaactaaaatctctcccctgacaagatttgtacaaaactaatgtgaaataagaga

SEQ ID NO: 868 - DNA, 1070 bp, Arabidopsis thaliana
gtatggaatgtgtcgagtatgtgtgtatagtgtctccacttggatctttcttacttactccattatcttcttctctctctttccctcatctcattaatggcgagctctacatctttagcgatagttcttcatcaatcttccaatcatgacgaactcttcatgaagcaaactcttcaattctcagaaaccctcaaggatttaaagaatctgcggaaacagttatactcagcagctgagtacttcgaaacatcttatggcaaagcagaacacaaagaaacagtgatagagacgttgaaagagtatgcagcaaaggcagtagtgaacacagtggatcatcttggttctgtctctgacaaattcaactcttttctctctgataactcaactcatttctccaccactcatcttcgtttatcttctcttgaacaaaggatgagactatgcagagattacatggggaagagtggcactcatcagcatttgcttctatttcaatatcctcgccatcataagcgttacttcttccctcaacaaggaagaggcacaagtttctctgcaggagatgactcacaccggttcacgagtgctgttcgatcaacaatactagaaaacctcccaaatactgcaaggaaagctaacaagacaggaagcttctcttttgcacctatcgtacacaacaacatcaacaacagaacaccaaataagagatcaaactctcctatgagattccctctcttacgttcaggatctctactgaaacgttcaagctccccaagccaaccaaagaaaccgcccttagcgttaccggaacctcaaagagctatatctgtgtcgagaaatacagagatagtggagataaagcaatcttcatcgcgaaaagggaagaagattctgatgttcaaggcattgatgagtatgagcaagtcgagaaactaaaatctctccttgtatttgataaatgaaaagatttgtacaaaactaatgtgaaataagagagagagatgcttattttgtcgatattagtacttttctttcagatgctttagttgcaattcaacagaaaccatacg

SEQ ID NO: 869 - DNA, 1537 bp, Glycine max
gagaaaacccttttcgccggaaaacccaccgcaaccttcgcggttcgcgattccgcttccggttccaccgtgctcctcttacacacgtattcaactattcaattttctctttaacgtttccgttttctcggaacacgttcccaattttttcccccaattgtgagcatatgggaaaaactagttggttgataatattggttacttgtttgtgcctgcttgccttttctgatggtagagaactcaaggttagacataaaaagcctcattaccaatacaatcatacgcttgctacaatattagtggaatatgcttctgcggtatacttgtcagatttaactgaactttttacttggacgtgctctaggtgtaatggcttgaccaagggatttgaaatgatagagttagttgttgacgtcgagcattgcttacaggcatttgttggagtggctgatgatccttgtgccattatcattgcattcagaggaacaaatgaacacagcttacagaattggattgaagatttatattggaagcagcatgatataaattatccaggcatggatgatgcaatggtacaccgtggtttttataccgcataccacaatacaacaatacgtcctgcaattttagatgctgttgaaagagcaaagaagttttatggagatattgaaattatagcaacagggcattcaatgggaggggcaatggcttcattttgtggacttgatttaacggtaaatcaaaatgaaaaaaatgttcaagttatgacatttggacaacctcgtgttggaaatgctgcttttgcatctctctataccaaactagttccaaataccatccgagtcacaaatgaccatgatattgtacctcatttgcctccatattattattatttaccgcagaagacataccaccacttcccaagagaggtttggctttataacatcggattaggtagtcttgtgtacaacgttgagaagatttgtgatgaatctggtgaggatccggattgcagcaggtcggtgactgggaatagcattgctgatcacttagtctattatggcgtagacatgggatcagatgagcctagttcatgcagaattgttatggattctcatgttcagaatactagcatcagagattcaagaggaaacttaatcttgtccagagatcctgcaacccccctcatcaaattgggtggagagggtgacaatcaggaaaatcccattaatgttgattgaattggcattagatatctcttgcatgatatgttccagaggtttgctgtggggcattatacttcagatttattttttcttcacggtccatacagctgaacaattttattgaattggctagggctggaaggagtttgtatagtctttgactcgtgtatatatgttcatccttgtatatataattaataattctatattttttactgcataagtaataattcttgatactttgtcaattgtataatttcactttcaaattctactgaattccactcctcatttgggtgataattcttttt

SEQ ID NO: 870 - DNA, 1638 bp, Cajanus cajan
ggggtggcaaataataacaacttggccagacgccagagtgttccaaaacggcacgaaaatgacgaaatgaacccctgcgacgtcgtatatgctacttcttccttcttcgtctctccaaccccaaattattgttatgactctttgacttctccttcatctctttcgctggacccaatcctctcaccactccgattcccgttccaccgtgcttctttcacgcatagtatatggggaagtctaggtggttgatattggttatctgtttatgcttgcttgccttttctgatggccgagaactccatgttaggcataaaaagaatcactaccaatacaatcatacacttgctacaatattagtgcaatatgcttctgcggtatacttgtcagatttaacagaactttttacttggacgtgctctaggtgtgatggcttgaccaagggatttgatattatagagttagttgttgacgttgagcattgcttacaggcatttgttggagtggctgatgatccacatgccattatcattgcattcagagggacaaatgaacacagcttacagaattggattgaagatttatattggaagcagcatgagataaattatccaggcatggatgatgcaatggtacatcgtggtttttatatggcataccacaatacaacaatacgtcctgcagttttagatgctgttgaaagagcaaaaaagttttatggagatattcaaattatatcaatagggcattcaatgggaggggcaatggcttcattttgtggacttgatttaacggtaaatcaaaatgaaaaaaatgttcaagttatgacatttggacaacctcgtgtgggaaatgctgcttttgcatctctctatagcaaactagttccaaatacaatccgagtcacaaatgaccatgatattgtacctcatttgcctccatattattattatttgccacagaagacataccaccacttcccgagagaggtatggctttataacattggattaggtagtcttgtgtacagcgttgagaagatttgtgatggatctggcgaggatccaacttgcagcaggtcggtgagtgggaatagcattgtagatcacttggcctattatggcgttgacatgggatcagatgagccaagttcatgcagaattgttatggattctcatgttcagaaaactagcatcaaagattcaaggggaaacttaatcttgtccagagatcctgcaacccctatcatcaaattgagtagagagattgacaatcaggaaaatcctgttaacgttgattgaattggcaagggatatctcttgcatgataggttccaaggtttgccatggaggcattataattcgtatttcttcttttcttcacggtccttcctaatggcatggaccatacagctgcattttttatattgaaatcgattaatgctggaagaagattgtatagtcttgggctcttgtatatatgtgctcatccttgtatatatgattaataattcgatactcggttaagtgtataatttcatcttaaaattccactgaattcgaccccctcatttgggtgataattcttttaaccatttgtcgcttccagtttaattttacgcaaattttctgattctctcat

SEQ ID NO: 871 - DNA, 1449 bp, Glycine max
tttgacttctccttcatctctttcgctggacaaaacccctttcgccggaaaacccaccgcaacctttgtggttcgcaactccgtttccggcttcaccgtgctcctcttacacgcagtatatatatatgtatgtatatggggaaaactaggtggttgataatattggttacctgtttatgcctgctttccttttctgatggcagagaactcaaggttaggcataaaaagcaacattaccaatacaatcatacacttgctacaatattagtggaatatgcttctgcggtatacttgtcagatttaactgaactttttacttggacgtgctctaggtgtaatggcttgaccaagggatttgaaatgatagagttagttgttgacgtcgagcattgcttacaggcatttgttggagtggccgatgatcctcatgccattatcattgcattcagaggaacaaatgaacacagcttacagaattggattgaagatttatattggaagcagcatgatataaattatccaggcatggatgatgcaatggtacaccgtggtttttataccgcgtaccacaatacaacaatacgtcctgcaattttagatgctgttgaaagagcaaagaagttttatggagatattgaaattatagcaacagggcattcaatgggaggggcaatggcttcattttgtggacttgatttaacggtaaatcaaaatgaaaaaaatgttcaagttatgacatttggacaacctcgtattggaaatgctgcttttgcatctctctatacgaaactagttccaaataccatccgagtcacaaatgaccatgatattgtacctcatttgcctccatactattattatttaccgcagaagacataccgccacttcccaagagaggtatggctttataacatcggattaggtagtcttgtgtacagtgttgagaagatttgtgatgaatctggtgaggatccaaattgcagcagatcggtgactgggaatagcattgctgatcacttggtctattatggcgttgacatgggatcagatgagccaagttcatgcagaattgttatggattcttatgttcagaatactaacatcaaagattcaagaggaaacttaatcttgtccagagatcctgcaacccccctcatcaaattgagtggagagggtgacaatcaggaaaatcccattaatgttgattgaattggcatcagatatctgttgcatgatatgttccagaggtttgccgtgtggcattattcttcagatttcttctttcttcatggtccatacagctgaacaattttattgaacaggctagggctggaaggagtttgtatagtcttggactcgtgtacatatgctcatacttgtatatataactaataattatatttttttacttcataattaataattcttgatactttgttaagtgtataa

SEQ ID NO: 872 - DNA, 1474 bp, Arachis hypogaea
ttcgccgccgttcgctgcttctgtctccttcctgtccctctcaccggtctctagttatctctgctcccgctgttctgtttcgtgtccctcgcagctggtccttcctcccgtgtttacaagatgaagaaaacatggtggttgatattggttacgtttttatgcttgctgagctcatctaatggtagagacttaaaggctagggacaaggttaatcttcccaagtacaaccatacacttgctacaatattagtgcaatatgcatctgcggtatacttgtcagatttaacagcgctttttacttggacatgctctagatgtgatggcttgactgagggatttgaaattatagagttggtggttgatgttgagcactgcttgcaggcatttgttggagtggctgatgatccgcatgccattatcattgcattcagaggaactaatgaacacagcttacagaactggatagaagatttatactggaagcagcatgaaataaattatccgggcatggatgatgcaatggtacaccgtggattttataatgcataccacaacacaacaatacgtcccgcaattctggatgctgtcgacagggcaaagaaattttatggaaatattcaaattattgtgcttggacattcaatgggaggagcaatggctgcattttgtggtctagatttaacggtgaatcgatgtgaaaagaatgttcaggttatgacatttggacaaccccgaattggaaatgctgtttttgcatccctgtatagcacacttgttccaaatacgttgcgtgtgacacatgaccacgacattgttccccatttgccaccatattattactatttaccatcaaagacataccaccatttcccaagagaggtgtggctttataacgttggattaggaagtctggtatatcgggttgagaaggtttgtgatggatctggtgaagatccaacttgcagtaggtcggtgagtgggaatagcatatcagaccacttggtatattatggtgttgaaatgggatcagacgcgccagactcatgcagaattgttatgggttctaatgattcaagtcctagcgtccaagattcgagagggaacattgtcttgaccagagagcctgcaaaatttgtcctgaaactgagtagagagcttgacaatcaaggaaaggccattagtgttagttgagtttacatggattgtctcttgtaagatatataggttttaaatgttaggtttggggggttggtcgacatgcttccgaattcttctttcttaaaaggagtcgcctgtaaggaggaattatttcagtgagattaggtagggatcttgtacattctcatccctgtatatatgattgttaatacttaatattggttttttttttgtagtcatacttaatattgttaattgtacaataattgtaaattaaattccttggtccgtaatttcttatgtgatttgggtgata

SEQ ID NO: 873 - DNA, 1352 bp, Phaseolus coccineus
  misc_feature (877)..(877): n is a, c, g, or t
  misc_feature (917)..(917): n is a, c, g, or t
  misc_feature (1248)..(1248): n is a, c, g, or t
  misc_feature (1304)..(1304): n is a, c, g, or t
tctttcgctggagaaaaccctgtcaccggaaagctcacctcagcctttgcggtttgcgattccgatcaccgttccaccgcgcccctcttacgcatagtatatggggaaaaccacgtggttgatactggttacctttttgtgtttgtttgcattctctaatggtagagggttaaaggttaggcagaaaaatcatccttacaaatacaatcatactcttgctacaacattagtggaatatgcttctgcggtatacctctctgatttaacagaactttttacttggacgtgtgccaggtgtgatgacttgaccaagggatttgacatgatagagttagttgttgatgtcgagcattgcttacaggcatttgttggagtggccgaggatcctcatgccatcatcattgcatttagaggaacaaatgaacacagcttgcagaattggattgaagatttatattggaagcagcatgatataaattatcctggcatggatgatgcaatggtacaccgtgggttttacactgcataccacaacacaacaatacgccctgcaattttagatgctatagatagggcaaagaagttttatggagatattcaaattatagcaacagggcattcaatgggaggggcaatggcttcattttgtggtcttgatttaacggtaaataaaaatgaaaaaaatgtccaagttatgacatttggacaacctcgtgttggaaatgctgtttttgcatctctctacagcgaactagttccatgtacagtccgagtcacaaatgaccatgatattgtacctcatttgcctccatactattattatttaccgcagaagacataccaccacttccccagagaggtatggctttataacatnggattaggtagtcttgtgtacagcgtggagaagatttgtnatgaatctggcgaggatccggattgcagcaggtcagtaactgggaatagcattgctgatcacttggtctattatggcgttgacatgggatccgatgagcctagttcatgcagaattgttatggatccttatcttcagagtgctagcatcaaagattcaagaggaaacattatcttatccaaagatcccgccacccccctcatcaaattgagtagagagagtggcaatcagaaaaatcccattaatgttgattgaattggctgtggatctcttacatatgataggtcccagaggtttgccgtggggcactatacttcagatttcggtccacnaagctgaacagttttattgaaattgactagggctggaaggagtttgtatagtcttngaatcttgtatatatgcatccttgtatatataattaataattcttgat

SEQ ID NO: 874 - DNA, 2494 bp, Lotus japonicus
cttgtctcttttctcttttttcttctgtaccttcacgcggtactactgactcactgagtcaagtctattttcccggaaaatcggcaacctgagaaaatgcccgattctcggaaaatcgattcgcacaacaatggcgcttagattctccactttctcctttcaccgtcatcctacctgagcttcttcttcttcttcttcattctctggtaactggctctgagctctgattgctggagagaaatttcaatacatgtagcattagattaggctttgatttcttgtttactgcttaggcatagggatgctattgcagtaacagtaaaagcaatttgaagttgaaatagagatgtaaagagaaaaaaaagtttagggttgccatttggtgattctgattcccttttatgatgggagcatttggttgtcagattcatagcttgtttatttttgagacagcaaggtattgaacctgagaaattgaggatggcttgtttggcgcttcgtccgatgcacgaagaagcttttggtgattttaccagctgttttagtcatcatttgcgggactcgattttgatttacctgactgttggtggatccgtggttccgatgcatattatggagacggattcgatagcttcgatgaagctgagaattcaaacgtttaaaggattttttgtgaggaaacagaagctggtttttgaagggaaggaattggctcgtgacaaattgtgcgtccgtgattatggtgtttcggatgggaatgtgttgcacctggtgcttaggctttctgatcttcaagctattactgttaggactgaatgtggaaaggagtttgggttttatgtcgggaagaaaaggaatgtgggttatgtaaagcagcagattgcgaggaaagggcaagggttgttggatcttgcagatcaagaattggtgtgggagggtgaggcgcttgaagaccagagacttatagaggacatctgtaaggacaacgatgcagtaattcactttttggttaggacatcagatgccaaagttacgactaaaccagttgggaaggattttgagttatcaattgaggcatacactgtgccaagttttagtgcaggccagttagggtcagtgtcagtaacaaatagggccctgaagaggaatgaattgactagagaatttcttttggaaccaattgttgtgaatcccaagatcaaaattccacaagtgatccaggagctaattaagattacttcagaggggttagaaaaaggtggtaaaccaattcaatcatcagagggatctggaggggcttatctcatgcaagattcactcggcttgaagtatgtttctgttttcaagcctattgatgaggagccgatggcaatcaataatcctcgaggcctacctctctctgtggatggtgaaggggggttaaagaaaggtacacgagtagggcaaggtgcgttgagagaagttgcagcttacattttggatcatcctaagaaaggaccccgctcatatcataacagtgatgaaaaggggtttgctggagttcctcctacagtcatggtcaaatgcttgcataaaggattccatcatcctgaaggttacaatagtgcttcagataatgttaaattaggatcacttcagatgtttatgaagaatattggaagttgtgaagacatgggccctagtgtatttccggtggaagaggtacacaagatctctgtgctggatatcaggttggcaaatgcagataggcatgctgggaacattttagttgccaaggatggtgaaaatggctcaactgtgcttattccaattgatcatggctattgcttacctgagagttttgaagactgcacttttgactggttgtattggccacaagccaaagagccctactccccagataccattgagtacataaaatctctggatgctgaagaagatatcaagcttttgaagtttcatggatgggagcttcctcctgaatgcgcccgactccttcgaatatcaaccatgcttctgaagaagggtgcagagaaaggactccctcctttcaccattgggagcatcatgtgtagagaaacactgaagaaaaaatctgtcattgagcaaattattgaggaagctgaggaaggtgcacttcctggaacaagcgaagcttcttttctcgatcttgtttcagtgataatggatagccatttagaagagccattcccatgagtactgaatacacatattgcttttgttaataaagatggcgataaagtgatgactctccattcggcttcaaaatggatcccttactatggtatatatacttaactgttggttaaaacttcttatgacccaccaatcaagaattttattcttgtattgcaatatccattccttatgcatctcagatcacaaggaatttttgtgcagttcctctgtgaatataaaattctgaaaataaaggttgtggtttcaataaaagaaatcgttccatgttctgctg

SEQ ID NO: 875 - DNA, 2669 bp, Glycine max
cttaattttctgcattcctcgagacactgactcactgagtcgagttttttttcccggaaaattaggaacctgagaaaatctccgattctccgagaaaatccgtgcaatggcgcttaatttctcatatcaccgtcatcgcacatgaacgtcctcttcgatttcgcttcactctctgctaattggagtccagtttgcagggaattcttccttcctttttcagcatcaacaaattttcttatagcatagattagaacatgacagctacgaaaaaaatcatgtaatcaattcaaggagatatctgatcagctgatcttcatttctccaaggtcttgtgttttctgaaaagtcttggtttgactctgagacctggtttctggaaagaaacttaggatatacatattttaggcttctaattcttgtttgctacttaggttcaggcatgaggaatcaggaagaaaaaaaagaatttgatctttttgtgatttcctattgaatctctgatggaaatcggttgaattttgctattggttttgaggttcataacttgtttatttttgagccagcaaggttttgaacctgtaaattgataatggcttgtgtggcacttcatccggtgtgtgaagaatctcttaaccgtggtgaatttaccagctgtttcagccctcatttgagggagtcaattttgatttacctaactgttggtggatctgtgattcctatgcatattatgaagacggattcaattgcttcagtgaagctgagaattcaaaccttcaagggattttttgttaaaaagcagaaactggtttttgaagggaaggaattggctcgtaacagatcttgtatccgtgattatggtgttggtgatgggaatgttttgcacctggtgctgaggctttctgatctcaaagctattactgttaggactatgtgtggaaaggagtttgggctttatgttgagaagagtaggagtgtgggctatgtgaagcagcagattgcaaaaaaagggcaagggttcttggatcacaaggatcaagaactgatatgtgagggtgaggaacttgaagaccagagacttattgaagatatctgtaaggacaatgatgctgttattcattttttggtcagaaaatcagatgccaaggtaaggactaaaccagttgacaaggattttgaattatcaattgaagcatcatatgtgcacaatctggtaccaaatttacatgcagaccagttagggtcagtctctgtaacaaatgaggtcctggagaggagccaattaacaagagattttgttctggaaccaattattatgaattccaacatcaaaattccactggtgatccaagagctaattaagagcacttcggagggattagaaaaaggctgtaaaccaattcaatcttcagagggatcaggaggagcttatctcatgcaagattcttctggcttgaagtatgtgtctgttttcaagcccatagatgaggagccaatggcaataaataatcctcgaggcctacctgtttctgaggatggtgaagggctaaagaaaggtacacgagtagggcaaggtgcattgagagaagttgcggcttacattttggatcatcctaggaaaggacctcgctcatattataacaatgaggagggcggatttgctggagttcctcctacagtcatggtcaaatgccttgataaaggatttcataatattgaagattatcagaatgattcagctaatgttaaaataggatctcttcagatgtttatgaggaatattggaagttgtgaagacatgggccctagtgcttttccagtggaagaggtacacaagatctctgtgctggatatcaggttggtaaatgcagataggcatgcagggaacattttgattgccagggatggtgaagacggtcaaactatcctcattccaattgatcatggctattgcttgcctgagagttttgaagactgcacttttgactggttatactggccacaagctaaggagccttactctcctgacaccattgattacataaaatctctggatgctgaagaagatataaagcttttgaagtttcatggatgggaccttcctcctaaatgtgcccagatccttcgtatatcaaccatgcttcttctgaaaggtgcagagagaggactcactcctttcgccttaggaagcatcatgtgtagagaaacactgaagaaaaaatctgtcattgagcagattgttgaggaagcagaggaagcggcatttcctggagcaagtgaagctgcatttcttgatctggtttcagtggtcatggatagtcatttggatgagctattcccgtgactgaatatacataattcacatacttattactactattttgataatacagtgataaagtggtcgtgcttgtttcgtcttcaaagaggatccatcaaactcgtttagtagactgtggttaaaacttctgtattgaccaatcaagcatttgatgcttgtattgcaaatatcgacttctcttatatatatatctcttataacatggaaatatattgaccaggaatgtttatggagtcctgtgcaataatattcctcttatgttctttggtgaatataaaattgtttgaataaagttgtacttatcatagaaaaaaggaaacaaattctgcca

SEQ ID NO: 876 - DNA, 1255 bp, Solanum tuberosum
cgaggcagatatagagagagaaagaagtgcgtgagtgtatgaattaaatttttcttccatttattatttttttggcagaatttgcatgacattctgttgaaaaaggacctcaagctcacttttttgtgcttcttcttccgtttctcgtcaggtaaagctcaagtaagagacgaattatagtagcattcaccatgtttcgtcgcaagaaccactctaatagtgaacagggtgttgaggaccagcagcagaaggttaaggagcttagggcttccctggggcaactctcagggcgcagcacacagttctgcactgatgcatgtttaaaaaggtttttggaagcacggaactggaatgtagataaagcaaagaagatgttggaggagacgcttaaatggagattatcgtttaaacctgaagaaattcgctggaatgaagtagcgaaagaaggtgagactgggaaggtatttaaagcaaattttcatgaccgccatggcaggacagtcctaatattgcggccaggaatgcagaacacagcagcactagacaaccagatgaagcatttggtgtatctaatcgagaatgccatttttaatctgccagaaggtcaagaacagatggtctggttaattgacttcactggatggtctataaccaataatgttcctgtaaaatctgctcgcgagagcatcaatattttgcaaaaccactaccctgagagactcgctgcagcaattttgtacaatccaccgcgactttttgaaacattttggaggattgtcaaatactttatggatcccaaaacatttcaaaaggtcaagtttgtgtatccaaagaacaaggatagcgcggaactgatgaagtcatacttcgacgtggataatcttcctactgagtttggaggaacagcgacactgaattatgatcacgaggagttctcaaggctaatggctcaagatgatgtgaaggccgccaagttttggggtaaggacaaacacccccctggtcctggtggtaatggtagttactctgcagtagaagttgctccagaaccttaatctcttgctctaccagccactgcctgagtttaaatgattgctccactgacaaagttcagtctcttatatgcctaactaagtttaaataaataatgaggaatgtaagatcatgttctcagacattagcttgtttcagatgaactttgattgtaggttgtattttgatttatgcagaaatcaaaaagtattaaattttaagc

SEQ ID NO: 877 - DNA, 1274 bp, Solanum phureja
gtgtgaacttctcactctgctcctcagatatagagagagaaagaagtgcgtgagtgtatgaattaaatttttcttccatttattatttttttggcagaatttgcatgacattctgttgaaaaaggacctcaagctcacttttttgtgcttcttcttccgtttctcgtcaggtaaagctcaagtaagagacgaattatagtagcattcaccatgtttcgtcgcaagaaccactctaatagtgaacagggtgttgaggaccagcagcagaaggttaaggagcttagggcttccctggggcaactctcagggcgcagcacacagttctgcactgatgcatgtttaaaaaggtttttggaagcacggaactggaatgtagataaagcaaagaagatgttggaggagacgcttaaatggagattatcgtttaaacctgaagaaattcgctggaatgaagtagcgaaagaaggtgagactgggaaggtatttaaagcaaattttcatgaccgccatggcaggacagtcctaatattgcggccaggaatgcagaacacagcagcactagacaaccagatgaagcatttggtgtatctaatcgagaatgccatttttaatctgccagaaggtcaagaacagatggtctggttaattgacttcactggatggtctataaccaataatgttcctgtaaaatctgctcgcgagagcatcaatattttgcaaaaccactaccctgagagactcgctgcagcaattttgtacaatccaccgcgactttttgaaacattttggaggattgtcaaatactttatggatcccaaaacatttcaaaaggtcaagtttgtgtatccaaagaacaaggatagcgcggaactgatgaagtcatacttcgacgtggataatcttcctactgagtttggaggaacagcgacactgaattatgatcacgaggagttctcaaggctaatggctcaagatgatgtgaaggccgccaagttttggggtaaggacaaacacccccctggtcctggtggtaatggtagttactctgcagtagaagttgctccagaaccttaatctcttgctctaccagccactgcctgagtttaaatgattgctccactgacaaagttcagtctcttatatgcctaactaagtttaaataaataatgaggaatgtaagatcatgttctcagacattagcttgtttcagatgaactttgattgtaggttgtattttgatttatgcagaaatcaaaaagtactaaattttaagc

SEQ ID NO: 878 - DNA, 1252 bp, Solanum tuberosum
gctcagatatagagagagaaagaagtgcgtgagtgtatgaattaatttttcttccatttattatttttttggcagaatttgcatgacattctgttgaaaaaggacctcaagctcacttttttgtgcttcttcttccgtttctcgtcaggtaaagctcaagtaagagacgaattatagtagcattcaccatgtttcgtcgcaagaaccactctaatagtgaacagggtgttgaggaccagcagcagaaggttaaggagcttagggcttccctggggcaactctcagggcgcagcacacagttctgcactgatgcatgtttaaaaaggtttttggaagcacggaactggaatgtagataaagcaaagaagatgttggaggagacgcttaaatggagattatcgtttaaacctgaagaaattcgctggaatgaagtagcgaaagaaggtgagactgggaaggtatttaaagcaaattttcatgaccgccatggcaggacagtcctaatattgcggccaggaatgcagaacacagcagcactagacaaccagatgaagcatttggtgtatctaatcgagaatgccatttttaatctgccagaaggtcaagaacagatggtctggttaattgacttcactggatggtctataaccaataatgttcctgtaaaatctgctcgcgagagcatcaatattttgcaaaaccactaccctgagagactcgctgcagcaattttgtacaatccaccgcgactttttgaaacattttggaggattgtcaaatactttatggatcccaaaacatttcaaaaggtcaagtttgtgtatccaaagaacaaggatagcgcggaactgatgaagtcatacttcgacgtggataatcttcctactgagtttggaggaacagcgacactgaattatgatcacgaggagttctcaaggctaatggctcaagatgatgtgaaggccgccaagttttggggtaaggacaaacacccccctggtcctggtggtaatggtagttactctgcagtagaagttgctccagaaccttaatctcttgctctaccagccactgcctgagtttaaatgattgctccactgacaaagttcagtctcttatatgcctaactaagtttaaataaataatgaggaatgtaagatcatgttctcagacattagcttgtttcagatgaactttgattgtaggttgtattttgatttatgcagaaatcaaaaagtactaaattttaagc

SEQ ID NO: 879 - DNA, 1054 bp, Solanum tuberosum
cagatatagagagagaaagaagtgcgtgagtgtatgaattaatttttcttccatttattatttttttggcagaatttgcatgacattcggttgaaaaaggacctcaagctcacttttttgtgcttcttcttcttcttccatttctcgtcaggtaaagctcaagtaagagacgaattatagtagcattcaccatgtttcgtcgcaagaaccactctaatagtgaacagggggttgaggaccagcagcacaaggttaaggagcttagggcttccctggggcaactctcagggcgcagcgcacagttctgcactgatgcatgtttaaaaacggtatttggaagcacggaactggaatgtagataaagcaaagaagatgttggaggagacgcttaaatggagattatcgtttaaacctgaagaaattcgctggaatgaagtagcgaaagaaggtgagactgggaaggtgtttaaagcaaattttcgtgaccgccatggcaggacagtcctaatattgcggccaggaatgcagaacacagcagcactagacaaccagatgaagcatttggtgtatctaatcgagaatgccatttttaatctgccagaaggtcaagaacagatggcttggttaattgactacactggatggtctataaccaataatgttcctgtaaaatctgctcgcgagaccatcaatattttgcaaaaccactaccctgagagactcgctgcagcaattttgtacaatccaccgcgactttttgaaacattttggaggattgtcaaatacttaatgaatctcaaaacatttcaaaaggtcaagtttgtgtatccaaagaacaacgattagcgcggaaactgattgaagtcattacttcgaccatggataatcttcctactgagttgttggaggaacagcgacactgaattatgatcacgaggagttctcaaggctaatggctcaagatgatgtgaaggtcgccaagttttggggtaaggacaaaaaccccctggtcctggtggtaatggtagttactctgcagtagaagttactccag

SEQ ID NO: 880 - DNA, 1345 bp, Solanum melongena
tactcggcactctgctccgcagatatagagagagaaacaagtgcgtgtagtgtatgaattaattttaccttccaaattttttatttggggggagaatttgcatgacattttgttgaaaaagggcctcaagctcacttttgttgtgcagtttctccatcagtttctcgtcggtcgtcaggtaaagctcacgtagagactaattatagtagcattgaccatgtttcgtcgcaagaaccattctcatagtgagcaggagggtgaggaccatcagcacaaggttaaggagctcagggcttccctggggctactctcagggcgcagcgcacagttttgcactgatgcatgtttaaaaaggtatttggaagcaaggaactggaatgtagataaatcaaagaagatgttggaggagacgcttaaatggaggttgtcgtttaaacctgaagaaattcgctggagtgaagtagcaatagaaggtgagactgggaaggtgtttaaagcaaattttcatgaccgctatggcaggacagtccttatattgcgaccaggaatgcagaacacgtcatcactagacaaccagatgaagcatttggtgtatctgatcgagaatgccatttttaatctgccagaaggtcaagaacagatggcctggttaattgacttcactggatggtctataaccaataacgttcctgtaaaatctgctcgtgagaccatcaatattttgcaaaaccactacccagagagactcgctgcagcacttctatacaacccaccgcgaatttttgaaacattttggaagattgtcaaattctttatggatcccaaaacatttcagaaggtcaagtttgtgtacccaaagaacaaggatagtgtggaactgatgaagtcatacttcgacgtggataatcttcctactgagtttggaggaacagcgacactgaagtatgatcacgaagagttctcaaggcaaatggctcaagatgatgtgaaagtcgccaaattttggggtttggacaaacacccccctggtgctaatggtggcggttactctgcagtagaagttgctccagaacctgaatctcttgctctaccagccactgtctgagcttaaatgtttgctccactgacagagttcagtctcttatatgcctaactaagttaaaataaataatgaggaatgtaagatcatgtgttcagacagtagaaaaactccctgaagttatttcagatgaactttaattgtaggttgtattttgatttatgaagaaatcaaaaagcactagctttttaaggcttaatattctcctcctctgtacttttaggtgaatttatcaatacattccaa

SEQ ID NO: 881 - DNA, 1262 bp, Capsicum annuum
gtagtgtatgaattaattagtaatttatttcccccttcccttttttattttggcagaatttgcatgacattctgttgaaaaaaagtacccctcaaagctcacttttttgttgtgcttctcctttcttccttcagtttttcttcttcagtcatcaggtaaagctcaagtaagggaccaactatagtagcattgaccatgtttcgtcgcaagaaccattctcatagtgaacagcagggtgaggaccagcagcacaaggtaaaggagcttaaggcttccctggggcaactctcagggcgcagcgcactgtactgcaccgatacatgtttaaaaaggtatttggaagcacggaactggaatgtagataaagcaaagaagatgttggaggatacacttaaatggagattatcgtttaaacctgaagaaattcgctggaatgaagtagcaatagaaggtgagactgggaaggtgtataaagcaaattttcatgatcgctatggcaggacagtccttatattgcgaccaggaatgcagaacacatcagcactagacaaccagatgaagcatttggtgtatctgatcgagaatgccatatttaatctgccagaaggtcaagaacagatggcctggttaattgacttcactggatggtctatagccaataatgttcctgtaaaatctgctcgtgagaccatcaatattttgcaaaaccactaccctgagagactcgctgtagcatttttgtacaacccaccgcgaatttttgaagcattttggaagattgtcaaatactttatggatcccaaaacatttcagaaggtcaagtttgtgtatccaaagaacaaggacagtgtggaactgatgaagtcatacttcgacgtggataatcttcctactgagtttggaggaacagctactttgaactatgatcacgaggagttctcgaggcaaatggctcaagatgatgtgaaagtcgccaagttttggggtttcgacaaacacccccctggtgctaatggttactctgcagtagaggttgctccggaacccgaagctgttgccctaccagccactgcaagggcttaaacgtttgttctactgacaaagttgagtcttatatgcctaactaagttaaaataaataaggaggaatgtaagattatgttctcagagactagaacactacctgagaggttatttcagataactttcattgtagaatgtatttttgcttaggcagaaatcaaaaagtactactagcttttt

SEQ ID NO: 882 - DNA, 1327 bp, Nicotiana tabacum
  misc_feature (49)..(49): n is a, c, g, or t
  misc_feature (604)..(604): n is a, c, g, or t
  misc_feature (616)..(616): n is a, c, g, or t
  misc_feature (619)..(619): n is a, c, g, or t
  misc_feature (624)..(624): n is a, c, g, or t
  misc_feature (685)..(685): n is a, c, g, or t
  misc_feature (730)..(730): n is a, c, g, or t
  misc_feature (739)..(739): n is a, c, g, or t
  misc_feature (787)..(787): n is a, c, g, or t
  misc_feature (793)..(793): n is a, c, g, or t
  misc_feature (838)..(838): n is a, c, g, or t
  misc_feature (873)..(873): n is a, c, g, or t
  misc_feature (913)..(913): n is a, c, g, or t
  misc_feature (919)..(919): n is a, c, g, or t
  misc_feature (997)..(997): n is a, c, g, or t
gccgcggggaataatattacatatatttatatgaaaatgagactatatntatagagagagaaagcagtgtgtagactcttacactctgctcctcagatatagagagagaaagttcagaagtgcgcgtagtgtatgaattaattggggttcagtttttggcagattttgcatgacattattctgttagaaaaaataaccgaaaactcacctttttgtgctctgcttctgctaccgtttgtcttcactcgtcaggtaaagcacagttaagagaccaattatagcagcattgaccatgtttcgtcgcaagaatcattctaatattgaacaggagggtgaggagaagcagcacaaggttaaggagcttagggcttccctggggccactatcagggcgcagctcgcagtactgcactgatgcatgtttaaggaggtatttggaagcacggaactggaatgtagataaatcgaggaagatgttggaggagacacttaaatggaggtcatcttttaaacctgaagaaatccgctggcatgaagtagcaatagaaggtgagactgggaaggtgtataaagcaaattttcatgaccgctacggcaggacagtncttatattgcgnccnggaangcagaacacatcagcactggacaaccaaatgaagcatttggtatatctgatagagaatgcnattcttaatctgccagaaggtcaagaacagatggcctggttaatngacttcacnggatggtctataaccaataatgttcccataaaatctgctcgcgagacnatcaanattttgcaaaaccactaccctgagagactcgctgtagcatttctntataacccaccgcgaatttttgaagcattttggangattgtcaaatactttatggatcccaaaacatttcagaangtcaantttgtctatccaaagaacaaggatagcgtggaactgatgaagtcattcttcgatgtggataatcttcctactgagttnggaggatcagcgactttgaattatgatcacgaggagttttcaaggcaaatggctcaagatgatgtgaaagctgccaagttttggggtttcgacaaacaccaatctgatgctaatggtttctctgcggcagaggttgctccagagcctgaatctattgcctctccagccatagcttagatgcttgatccactgaccagttcagtcttatattgcctaactgagttaaataaataatggggaatgtaagatcttgtccccccaccccacccacccccagcattattatcagagactagaaacacttcctgaggttatttttctagattttac

SEQ ID NO: 883 - DNA, 1216 bp, Solanum phureja
tgttggtgcatttgctttgtatcttgtttattttgttgccttttttttcctgtttcactaactttccttttgaaccgagggtatatcagaaataaccttttttaccctaaaaagatagggataaattctgacgcatcctaccctccgtaaaccccgggattaccctagttcattgcagtaacatttatcatgtttcgtcgcaagagccatccccacagtgaacaggagggtgaggatcaaccacataaggttaaggagcttaggacttccttgggcgcgccactatcaggacgcgatttacagtactgcaatgatgcatgtttaaggagatatttggaagcgcggaattggaatgttgagaaatcaaagaagatgttggaagagaccttaaaatggaggtcaacttttaagcctgaagagatccgctggcatgaagttgcaattgaaggtgagaccgggaaggcttatagagcaaattttcatgaccgtcatgggaggactgttcttatcttgagaccaggaatgcagaacacgacagcactagacaaccagatgaggcatttagtgtatctgatagagaatgcaattcttaatcttccacaagaccaagagcaaatgtcatggttgatagacttcacaggatggtctttaaccaacaatgttcctatcaaatctgctcgcgagactgtcaatattttgcagaatcactaccctgaaagacttgctgtagcatttctgtacaaccctccgcggatttttgaagcattttggaagatagtcaagtattttctggatcccaaaacaatgcagaaggtcaaatttgtttatccaaagaacaaggacagtgtagaattgatgaagtcatattttgacatggataatttaccaactgaattaggaggaaaagcaaatttgaagtatgatcatgaagagttctcaaggcaaatggctcaagatgatgtaaaagctgcaaagttttggagttttgacaaacaccacactgaaactaatggctactctgcacctgaggttgctccaaagactgagtgtcttgctccaccagtcaaagtttagatgcttttgctagagttacttaaactttgttatatgctttgctttgatataacaaatgtaagatgttaagaatttgtattttaaatattaggcaataaacactatgtgattactttttatctatttaagtcctttgtttgac

SEQ ID NO: 884 - DNA, 1185 bp, Solanum phureja
aagtttctgctataaatagctttgcactctttcattgtcttccacctttattttccagcctttctttttcttatagtaatccagaaaactgctcaaagtaacttcccacattctcctagagagatctgaccctttaacaaaatggagcatgaagacagctacaagggagtttcagagccaaaatacgactgccttctttttgatgttgatgatacactttatccactgagctctggtatttcagcacaatgcacgaaaaatatcattgattatatgattgaaaagcttggcattgatgagactaaagttccagaaatgtgtataaggttatataaggagtacggaacaaccatggctggtctcagggccattggttacgactttgattatgacgactaccatagttttgtacatgggagattaccttatgaacttttaaagcatgaccatgttctgaggaatcttttgcatagcttgcctgttcggaaagttatattttcaaatgcaaatgaagcccatgtggcaaaagttcttagcaggctcggattagaggactgctttgatgatattgtatgctttgagactgtgaatcctaccaacaacggcagtgtacaagacaacaacaatggtgtatcccctaggtctcttattgtttgcaaaccctttgaagaagcctatgaacaagcctttaaaatagccaatattaaccctcagaagacgctgttctttgatgactctgtccgtaaccttcagactgctaagctcacaggccttcatactgtgtgggtgggtgcctcccatagaacagaaggcatagattatgcactagaaagcattcataacatgaaggaagcattaccggagttatgggaagatgttaaaccagacattcgctattcggaaaagactgcaattgaagtgagagcttagttgtgtaatctcacaataaagacaaccacatagttgtagttatttatttattgctttctcttttttcttttctagtttcctcttttgcctgttaacctgaataacaattgttacattgatttcacagtccctagctgtattattattgcttagtggatgtgaaatttctcatgtgactagttgtaaaaacttctcttagaagtgaagtcgatgatgactgctgaaacaagtttgaatattaagtatttggttgtg

SEQ ID NO: 885 - DNA, 1116 bp, Capsicum annuum
ctttctttaagaaaactgctcaaaagtaacctaccacattcagatttgatcctttagaacaaaatggagcatgaagacagttacaagcgagttttggagccaaaatacgagtgccttctctttgatgttgatgatacactttatcctctaagctctggtatttctgcacaatgcacgaagaatatcattgattatatgattgaaaagcttggcattgatgagactaaagttccagaaatgtgcataagcttatataaggagtacggaacaaccatggctggtctcagggccattggttacgactttgattatgacgactaccatagttttgtacatgggagactaccttatgaacttttaaagcatgaccctgttctgaggaatcttttgcgcagtttgcctgttcggaaagttatattttcaaatgcaaatgaagcccatgtggcaaaagttctgagcaggctgggattagaggactgctttgatgatatcatatgctttgagactctgaatcctaccaacaacgacaacaaaagcaatgttgaatcccctaggtctcttattgtttgcaaacccttcgaagaagcctatgaacaagcctttaaaatagctaatattaaccctcagaagacgctgttctttgatgactcagtccgtaaccttcagactgctaagctcacgggccttcatactgtgtgggtgggtgcctcacatagaacaaaaggtatagataatgcactagaaagcatacataacatgaaggaagcattaccggagttatgggaggatgttaaaccagacattcgttactcagaaaagactgcaattgaagtgagagtttagttgtgtaatctcacaataaagacaaccatagtagtatttatataattttttactttcattttcttttttctagtgtcctcttttgtccgttaacctgaataaacgtcgtttcactggtttcagtcctctagcttatattattattgcttagtggatgtgaaatttctcatgtggctatagctgtaataacttctcttagaagtaagttttggcatgtaaagccaatgatggctgctggaacatgtttgaatataagtattttcgtttgtgact

SEQ ID NO: 886 - DNA, 1540 bp, Solanum phureja
aaatcactaaaggatagctaaaaatggtgagaaataggagagaagaattatacgttaccgttcccagccttttccgatgtccgatatccatggacgtaatgaagtcaccggtgagtctctgcaccggcgtcacttacgatcggagttccattcaaacttggctttcacaaggtcataatacttgtcccgccactatgcaaatccttccgtctaccgatttcacacctaacctcactctacgtcggcttatcaacgtctggattcagcatcagccggcgagctcaccgggatccacaacgccgtcttcatcctctgttacaaagtcggaagttgttgaaattgtcaaaagtctcaacggcgaggtcgataggttgagttccttggcgaagattgtggaatttgttaaatgttctggtgaaaacaggaggttttttgtgaatttgagtgatgcgattgtgagtgttgttggagttttggtggattgtgatgtggttgaggtttgtgaagcggttgttgcggttttggatttggttgtatcggaaaatgaagtgaaagagcagttgaacaaagagattttgaagagcgataggaaatttctgccgaagtttcttttgattcttcgaaaaggaaagttgagttcgaggattcaaaccgctcggattctagaattcatcgcattagacgcggattcgcagcgaaaaatggtcgaggagcaaggtttactctacgaattgcacgtattcactagcacggagacgaaccggttcgcgatcgaagccggtttatcaactctaatcgcggtctcaaccaccagaccggcgaaaaaagagctagtccggttcggaattgtacaaaccatcgggaaaatccttagcggttcggaaaccgctcgggcggtggtggagaagtcattgaagctgttggaaacagtagcgacgtgtacggaaggcaggtcggcgataggtaaaggcgaagagtgcttgtcggtgatagttacaaggctgatgaagagctcgaaagcagcgacagagcacggggtgacagtactgtggagcgtgtgctgcttgtttcgtgatacggaggcgcgtgaggtggtgggaaaggcaaatgggctaacaaaagtgttactggtaatgcagagtgattgctccgcgggggtacggcagatgtgtggggaattagtcaaagcattgcgcgtggtgaataataaagataagaattattcaaagtcgtgtttggcgagttatgataccaaaactactcacattatgccctactgaaaatataataaaggccataccactcttaatttgtgttgactaaccaaccataccaaaagaatcaaacactagtttttattttctttaaaataattattactccatttgtttgtttatagaaatagaattaggtaagtttcatgctgtaaatccaaaggaattctgctaatgatacacatgacatcaaactgttggctaaatacatcataagaccgtgatatttcttcattgtcgtcattaatattattgttattggtttt

SEQ ID NO: 887 - DNA, 1530 bp, Solanum tuberosum
aggatagctaaaaatggtgagaaataggagagaagaattatacgttaccgttcccagccttttccgatgtccgatatcaatggacgtaatgaagtcaccggtgagtctctgcaccggcgtcacttacgatcggagttccattcaaacttggctttcacaaggtcataatacttgtcccgccactatgcaaatccttccgtctaccgatttcacacctaacctcactctccggcggcttatcaacgtctggattcagcatcagccggcgagctcaccgggatccacaacgccgtcttcatcctctgttacaaagtcggaagttgttgaaattgtcgaaagtctcaacggcgaggtcgataggttgagttccttggcgaagattgtggaatttgttaaatgttctggtgaaaacaggaggttttttgtgaatatgagtgatgcgattgtgagtgttgttggagttttggtggattgtgatgtggttgaggtttgtgaagcggttgttgcggttttggatttggttgtatcggaaaatgaagtgaaggagcagttgaacaaagagattttgaagagcgataggaaatttctccctaagtttcttttgattcttcgaaaaggaaagttgagttcgaggattcaaaccgctcggattctagaattcatcgcattagacgccgattcgcagcgagaaatgatcgaggagcaaggtttactctacgaattgcacgtattcactagcacggagacgaaccggttcgcgatcgaagccggtttatcaactcttatcgcggtctcaaccaccagaccggcgaaaaaagagctagtccggttcggaattgtacaaaccatcgggaaaatccttagcggttcggaaaccgctcgggtggtggtggaaaagtcattgaagctgttggaaacagtagcgacgtgtacggaaggcaggtcggcgatagttaaaggcgaagagtgcttgtcggcgatagttacaaggctgatgaagagctcgaaagcagcgacggagcacggggtgacagtactgtggagcgtgtgctgcttgtttcgtgatacggcggcgcgtgaggtggtgggaaaggcaaatgggctaacaaaagtgttactggtaatgcagagtgattgctccgcgggggtacggcagatgtgtggggaattagtcaaagcattgcgcgtggtgaataataaagataagaattattcaaagtcgtgtttggcgagttatgataccaaaactactcacattatgccctactgaaaatataataaaggccataccactcttaatttgtgttgactaaccaaccataccaaaagaatcaaacactagtttttattttctttaaaataattattactccatttgtttgtttatagaaatagaattaggtaagtttcatgctgtaaatccaaaggaattctgctaatgatacacatgacatcaaactgttagctaaatacatcataagctcgtgatatttcttcattgtcgtcattaatattattgttattggtttt

SEQ ID NO: 888 - DNA, 1506 bp, Solanum tuberosum
gaaatcactaaaggatagctaaaaatggtgagaaataggagagaagaattatacgttaccgttcccagccttttccgatgtccgatatcaatggacgtaatgaagtcaccggtgagtctctgcaccggcgtcacttacgatcggagttccattcaaacttggctttcacaaggtcataatacttgtcccgccactatgcaaatccttccgtctaccgatttcacacctaacctcactctccggcggcttatcaacgtctggattcagcatcagccggcgagctcaccgggatccacaacgccgtcttcatcctctgttacaaagtcggaagttgttgaaattgtcaaaagtctcaacggcgaggtcgataggttgagttccttggcgaagattgtggaatttgttaaatgttctggtgaaaacaggaggttttttgtgaatatgagtgatgcgattgtgagtgttgttggagttttggtggattgtgatgtggttgaggtttgtgaagcggttgttgcggttttggatttggttgtatcggaaaatgaagtgaaggagcagttgaacaaagagattttgaagagcgataggaaatttctccctaagtttcttttgattcttcgaaaaggaaagttgagttcgaggattcaaaccgctcggattctagaattcatcgcattagacgccgattcgcagcgagaaatgatcgaggagcaaggtttactctacgaattgcacgtattcactagcacggagacgaaccggttcgcgatcgaagccggtttatcaactcttatcgcggtctcaaccaccagaccggcgaaaaaagagctagtccggttcggaattgtacaaaccatcgggaaaatccttagcggttcggaaaccgctcgggtggtggtggaaaagtcattgaagctgttggaaacagtagcgacgtgtacggaaggcaggtcggcgatagttaaaggcgaagagtgcttgtcggcgatagttacaaggctgatgaagagctcgaaagcagcgacggagcacggggtgacagtactgtggagcgtgtgctgcttgtttcgtgatacggcggcgcgtgaggtggtgggaaaggcaaatgggctaacaaaagtgttactggtaatgcagagtgattgctccgcgggggtacggcagatgtgtggggaattagtcaaagcattgcgcgtggtgaataataaagataagaattattcaaagtcgtgtttggcgagttatgataccaaaactactcacattatgccctactgaaaatataataaaggccataccactcttaatttgtgttgactaaccaaccataccaaaagaatcaaacactagtttttattttctttaaaataattattactccatttgtttgtttatagaaatagaattaggtaagtttcatgctgtaaatccaaaggaattctgctaatgatacacatgacatcaaactgttagctaaatacatcataagaccgtgatatttct

SEQ ID NO: 889 - DNA, 1522 bp, Capsicum annuum
gcacgaggaaaggatatctgaaaatatggtgagaaataggagagaagaactatacgttaccgttccgagtcttttccgatgtccgatttccatggacgtaatgaagtctcccgtaagtctctgcaccggcgtcacttacgatcggagctccattcaaacttggctttctcaaggccacaatacttgtcccgccaccatgcaaatccttccttgtacagatttcacacctaacctcactctccggaggcttatcaacgtttggcttcagcatcagacgacgacggcgagttcactgggagctgtaacgccgtctttatctgctgtaactaagtcggaagttgtagaaattgtgaaaagtatcaacggcgagataagccagttgagtaatttggtgaagattgtggaatttgtgaaatgttctggggagaatcggaggttttttgtgaatttgagtgatgcgattgtgaatgttgttggagttttggtagattgtgatgaggttgaaatttgtgaatcggttgttgcggttttggatttggttgtatcggagaatggagtgaaagagcagttgaacaatgagattttgcggagcgatcggagagttctacccaaattactctcgatttttcgtaaagggaagctgagttcgaggattcaaactgctcggattctggaattcatcgcatcagacgccgattcgcagaggaagatagtcgaggagcaaggtttactccacgaattgcacgtattcaccagcacggagacgaaccggttcgcgatagaagccggtttatcaactctaatcgcggtttcaaccactcgactagcgaaaaaagagctcatccggttcggaattgtacaagcaattggaaaagtccttaccggttcagaaaccgctcggccggtggttgagaagtcgttaaaactcttagaaacagtagcaacctgtacggaagggagaacggcgatcgggaaatgcgaggagtgcttatcggcgatagttacgcgcctgatgaagagcacgagagccgccacggagcacggcgttgcggtgctgtggagcgtgtgcagcttagcgcgtgatgcggcggcgcgtgaggtggtgcggaaggtgaatgggctgacgaaggtgttgctggtaatgcaaagtgattgttcagccggcgtacggcaaatgtgtggggagttggtcaaagcattgcgcgtggggaataataataagaactattcaaagtcgtgtttggcgagttatgataccaaaactactcacattatgccctactgaaaataatactaataaatataccactcagaatttgtgttgactgaccaaaccaaaagaaccaaacactagtttttcttttctttttctctttttgttattattaatgatactccatttgtttatagaaaattgaattaggtagattcatgttgtaaattcaaaggaattttgctaatgatacaaatgacatcaaactgttagcaaaatatatcagaagctcgatattacttcattatc

SEQ ID NO: 890 - DNA, 1792 bp, Nicotiana benthamiana
cccattatcttaggtgcatatatgaaaaaaatttccccttgtttacttaaacaaagcaaatatagttgaccaaatcgacgtcccccctttccactttgactcttcctttataagcacaaataccgtccacataactagctatattattcccccaaggcagaaaatagaaagagtagcaaaaaatgatgagaaataggagagaagaattatacgttaccgttccgagccttttccgatgtccgatatcaatggacgtaatgaggtctccggtaagtctctgcaccggcgtcacatacgatcgtagctccattcaaacttggctttctcaaggccacaatacctgtcccgccaccatgcaaatccttccctcgaccgatttcacacctaacctcactctccggcgactcatcaacgtctggcttcagcatcagccagctaactcaccctccgcctccaccacgctgtcttcctcctccgccgtctcaaagtcagaagttctcgaaattgtcaaaaatctcaacggcgagaatcggttgagttcgttggtgaagattgcggatttcgtgaagtattccgatgacaatcggagattttttgttaattcgagtggtgcgattgcgaatgttgttgacgttttggtggattctgatgtggttgagatttgcgaatctgtttttgcggttttggatttggttgtattagagaatggagttaaagaggagttgaataaggaggttttgcggagcgatcgagcttttctttcgaagtttctactgattcttcgaaaaggaaagctgagttctcgcattcaaagcgctcgaattctggaattcatcgcattagacgccgattcgcagcgaaaaatagtcgaggatcaaggtttactctacgaattgcacgtattcacccgcacagagacaaatcggttcgcggtcgaggccggtttatcagctctaatctcgatctcaaccaccagaccaacgacaaaagagctagtccgtttcggaatcgtacaaaccctcgggaaaatccttagccgttcggattccgctagagcggttgtggagaagtcgctgaagcttttggaaacggtggcgacatgtacggaagggagggcagcgatagggaagggcgaggagtgcttgacggcagtagttacgaggctcatgaagagctcgagggcggcgacggagcacggcgtgacggtgctgtggagcgtgtgctgcttggcgcgtgattcggcggcgcgtgaggttgtagggaaggtcaatgggctgaccaaggtgttgctggtgatgcagagtgattgctccagcggtgcacggcagatatgtggggaattggtcaaagcattgcgagtggtgaataataataatagtaagaattattcaaagtcgtgtttggcgagttatgataccaagactactcacatcatgccctactgaaaacatattaaattaaatgcctctcctaattgtattgactgaccaaaccaaaagaatcaaacactagctttctttattagtatttgtttttccaaactggattaggtagattcatgttgtaaattcaaaggaattttgctaatgatacaacaacattaaattggtcaatacatcaaaagctcatgactattattgctactgtcactgattttattattgttgtcattttataaattggtaggggtagtggggtactaggtgttttatttttttacggatcatttgatgtgtttattatccagacgtgtaaaaattgatgaaaattactattaaaaaaacttatattc

SEQ ID NO: 891 - DNA, 1702 bp, Solanum phureja
ttttcttctttcttacttttcttccaacctagcattttaaaaacaaaaaaaataagcataatctgtaaagcattaattcttttcccaaatacttagaagaaatccaggaatcttcccttttttctattcagaaaatccaatttcctcttgatttccttgttctagaagattcctttttttttttccaatttcttatgttgacacacacgtaattttttcttgtatataagaggattatttgatgttttgttctcccaacaatattaaattgcagattttgcgtttatacaatttgggtttgctatttcttgaattttttgtcttaaagttgttatttttatctgaaattttggatatgagttcagggggagaaaagaaaaatgtggttgtgattgggggtggagttgctggttctgttgttgctaaaacccttaaaagtgaggtcaatgtttccctcattgatgagaaagagtactatgagataacatgggcaagcttgaggtgtatggttgaacctgaatttgcaaaaagatctgtcatttctcactctgaataccttcctcatgcgaaaatcattccatcagctgcagttgacatcacagacactgatgtattgaccaaacaaggcagccgaattgcatatgactatcttgttgttgccactggtcatacacaaagcggtgctgaggcgagaacggagaagatcagtcaataccaagcagagtatgaaaagataaaggctgctgactccatattaatagtcggaggagggccaacaggtgtggagttggctgctgaaattgttgcagattttcctgctaagaaggtgacattggtgcacaggggatcaagattattggaatttattggagaaagcgccagcaaaaaggcacttaattggcttacttcgaagaaagttgaagtcatattggagcaatctgtcgttgttaactctcaatcagatggtgtttatagaacatctggtggagaaactatagttgctgattgctattttctttgcaccggtacactatttggttcagcatggttaaaagaaactatcttgaaggatagtttggacagtcgtggaagggtaatggttgattcaaatttgaggattaagggtcgcaacaatatctttgctattggggacatcactgatgttccggaacttaaacaaggatatttggctcaagaacatgcaaaggtagtagccaagaacatcacgtcgttaataaagggagtggaagatgatcacaaattggctgtatataaaccagcaaccaaggcattggctatagtttctctagggagaaaagatgcagtggctcaatttccttgtttgtcaatcgctggacgcgttccaggcatgataaaatctggggatctatttgttggaaagacgcgcaaaggacttggtctacagcccggtgtttagttgtcctgcttatagggaaatatgcctgctatagaagttgcgtttatttatttatattcaaactttttcgtttgattattacatgttataggttaaggtctacgtatacagtaccatctccatactccgtttgtgggtgcagggattgcactgtatatgttgctggtggtggttattttaagtggtgtgtggttctgcagccctcagttcttttattccccatctttctgagcacttaaaaattggcatgctccaaaaaaaaaa

SEQ ID NO: 892 - DNA, 1680 bp, Capsicum annuum
cttttctagaacacaaattttggacttttggttcatttcatgaccttcttgaacattcctttaattttttattgtatataagagggtatttaatgttctattttcccaacaaaatcaaattgcaattgtgcattaatataatttgggtactgctttgttttgttattagggaaattgggtttgctaattcttgattttttttttttcataaagttgtgatttttatctggaatattggatatgagtttagggggtgaaaagaaaaatgtggtagtgactggtggtggagctgctggttctgtcgttgccaaaacccttcaaaatgaggccaatgtttccctcattgatgagaaggagtattttgagataacatgggcaagcttaaggtctatggttgaaccggaatttgctaaaagatcagtcgtttctcactctgaatacctacctcatgcaaaaatcatttcatcagctgcagtagacatcacagacattgatgtattgaccaaacaaggcagccgaattgcgtatgattatctggttgttgccactggtcatacacaaagcggtgcttggacaaaaacggagaagatcagtcaatatcaagcagagtatgaaaagataaaggctgctaactccatattaatagttggtggagggccaaccggtgtggagctggctgctgaaattgctgcggattttcctgctaagaagctgaccctggtgcacaggggatcaagattgttggagtttattggacaaagcgccagcaataaggcactgaattggcttacttcaaagaaagttgaagtcatattggggcaatccgtcgatgtaaactctccaacagatggtgtttatcaaacatctggtggtgaaactgtagttgctgattgccattttctttgcatcggtacaccatttggttcagcgtggctaaaagaaactatcttgaaggatagtttggacagtagtggaagggtaatggttgattcaaatttgaggatcaagggtcgcaacaatatctttgctattggggacatcactgatattccggaacttaaacaaggatatttggctcaagaacacgcaaaggtagtagccaagaacatcacgtcattaataaagggagtagaagatgatcacaaattggctgtatataagccagcaaccaaggcattggctatagtttctctagggagaaaagatgcagtggctcaatttccttgcttgtcaatcgctggtcgcattccaggcatgataaaatctggggatctatttgttggaaagacgcgcaagggacttggtctctctagttaaggcagcctggtgtgctaaagctcttgctttgggcgaaaacaattgtgcatccaaggaaacaacatatgcatgtatggttgcacgttatacaaagttgttaatttttcccgtttgatgttattttaagtggtgtattcagttacatggttcttcttttccgagaaaaaataaccaaaataaccgtccatcctctagttagggtggatgtttaatatatgtataattcatgtataatatgtgtatgattgtttaatttatgtataccggctagaaaaagtaaacaataaacaataactctgcccgggtatttgtgtacagatccgtcctaacagttctctcattttgttttgctactttcaatct

SEQ ID NO: 893 - DNA, 958 bp, Solanum tuberosum
gagaaaatcaacatcaatggctgctccaagtgtacaggaagttctaccaccatctctggattctacttctcaacccccgtctctctttgatggaactaccaggttgtatatcagttatcaatgcccctatgctcaacgtgtgtggattaccaggaatgttaagggcttgcaagacaagatcaacttagttccaattgatcttcagaacaggcctgattggtacaaggaaaaagtttaccccccaaataaggtgccatccctggagcacaacaacaaagtgataggagagagtttggatctggttaaatatattgatagcaactttgaaggaccatcacttttgccggatgatcctgaaaagcagaaatttgctgaagaattgatagcttatagtgatacattcgtcccggaaatatatagatcgttcatgagagatgcacagacattggctggtgcacaattcgattacctagaaaaagctctcggcaaatttgacgatggacctttcttcctcggtcaattcagtcaggttgacatagcatatgttccatttatcgaaaggtttcaaattttcatgccagcggggtttaactatgacattacatccgggaggcctaaactagccaaatggattgaggaaatggacaagcttgacggatacaagcaaacaaaggtcttggaaccggagaaactggttgaatactacaagaacctctttctgaaggcttgaaacttcaaaaatgcattgatcaatcactggtgaaagttacatgggatagttctttggtatcaaatatgttgtgaaattctataatgttatgcatcagtaataaattgtctctatgtttttcttcatctgtagtgtttgatatttgtattttcctgttagagagacttgtattatcattagatgtaactttcatgtatctgtaatttcacggatggtcattcaactttt

SEQ ID NO: 894 - DNA, 993 bp, Solanum tuberosum
ttcaactgcagagaaaatcaacatcaatggctgctccaagtgtacaggaagttctaccaccatctctggattctacttctcaacccccgtctctctttgatggaactaccaggttgtatatcagttatcaatgcccctatgctcaacgtgtgtggattaccaggaatgttaagggcttgcaagacaagatcaacttagttccaattgatcttcagaacaggcctgattggtacaaggaaaaagtttaccccccaaataaggtgccatccctggagcacaacaacaaagtgataggagagagtttggatctggttaaatatattgatagcaactttgaaggaccatcacttttgccggatgatcctgaaaagcagaaatttgctgaagaattgatagcttatagtgatacattcgtcccggaaatatatagatcgttcatgagagatgcacagacattggctggtgcacaattcgattacctagaaaaagctctcggcaaatttgacgatggacctttcttcctcggtcaattcagtcaggttgacatagcatatgttccatttatcgaaaggtttcaaattttcatgccagcggggtttaactatgacattacatccgggaggcctaaactagccaaatggattgaggaaatggacaagcttgacggatacaagcaaacaaaggtcttggaaccggagaaactggttgaatactacaagaacctctttctgaaggcttgaaacttcaaaaatgcattgatcaatcactggtgaaagttacatgggatagttctttggtatcaaatatgttgtggaattctataatgttatgcatcagtaataaattgtctctatgtttttcttcatctgtagtgtttggtatttgtattttcctgttagagagacttgtattatcattagatgtaactttcatgtatctgtatttcatggatggtcatcacttttattttcgattttaaacctgcagcccggg

SEQ ID NO: 895 - DNA, 1020 bp, Solanum phureja
aaatttacacttccgggtcgtcttcaattgcagagaaaatcaacatcaatggctgctccaagtgtataggaagttctaccaccatctctggattctacttctcaacccccgtctctctttgatggaactaccaggttgtatatcagttatcaatgcccctatgctcaacgtgtgtggattaccaggaatgttaagggcttgcaagacaagatcaacttagttccaattgatcttcagaacaggcctgattggtacaaggaaaaagtttaccccccaaataaggtgccatccctggagcacaacaacaaagtgataggagagagtttggatctggttaaatatattgatagcaactttgaaggaccatcacttttgccggatgatcctgaaaagcagaaatttgctgaagaattgatagcttatagtgatacattcgtcccggaaatatatagatcgttcatgagagatgcacagacattggctggtgcacaattcgattacctagaaaaagctctcggcaaatttgacgatggacctttcttcctcggtcaattcagtcaggttgacatagcatatgttccatttatcgaaaggtttcaaattttcataccagcggggtttaactatgacattacatccgggaggcctaaactagccaaatggattgaggaaatggacaagcttgacggatacaagcaaacaaaggtcttggaaccggagaaactggttgaatactacaagaacctctttctgaaggcttgaaacttcaaaaatgcattgatcaatcactggtgaaagttacatgggatagttctttggtatcaaatatgctgtggaattctataatgttatgcatcagtaataaattgtctctatgtttttcttcatctgtagtgtttggtatttgtattttcctattagagagacttgtattatcattagatgtaactttcatgtatctgtaatttcacggatggtcattcaacttttatttttcgattttaccttcgtgttattttt

SEQ ID NO: 896 - DNA, 1084 bp, Solanum melongena
tgacaaaccgacactcacctaccactcctttttacggactcacacttctagaatttcccggatcttctcaatttctggaaaaatcatcatcaatggctgccccaagcgtacaagaagttctaccaccatctctggattctacttcccaacctccgcctctcttcgatggaactaccaggttgtatatcaactatcaatgcccttttgctcagcgtgtgtggatcaccaggaatgctaagggtttgcaaggcaagatcaagttagttccaattgatcttcagaaccggcctgattggtacaaggaaaaagtttaccccccaaataaggtgccatccctggagcacaacaacaaagtgataggagagagtttagatctggttaaatatgttgatagtaactttgaaggaccatcacttttgccggatgaccctgaaaagcggaaatttgctgaagaattgatagcttatagtgatacattcgtcccagaagtatacagatcgttcacaagagatgcacggacattggctggtgcacaatttgattacctagaaaaagctctcgacaaatttgatgatggacctttcttcctcggtcaattcagtcaggttgacatagtatatgctccatttatcgagaggttccaaattttcatgtcaggggcgtttgactatgacatcacatctgggaggcctaaactagccaaatggatcgaggaaatggacaagcttgacgcatacaagcaaacaaaagtcttggaaccagagaaactggttgaatactacaagaagcgctttctgcaagcttaggacttcaaaaatgcactgatcaatcactggtgaaagttgctggcactttgggatcataaatatgtaatggagttctatactgttatgcagcagttataaataaataagtactccagtaaaataatgcggttctgtgtgtttcttttatctgtagtatttgggattgtattttcctattagagagacttggattacaggttatgtaactatacaagtctttgacataatatataaacatgttctttaacttaatatcaactggcattatgccttttaac

SEQ ID NO: 897 - DNA, 754 bp, Solanum phureja
tgttgatggggttattcttttatttgcacagaattgtacaagaagttctaccaccaactttggattctacttcccaacccccatctctctttgatggaactaccaggttgtatatcaattatcaatgcccctattctcagcgtgtgtggattaccaggaatgttaagggtttgcaagaaaagatcaagttagttccaattgatcttaagaacaggcctgattggtacaaggaaaaagtttaccccacaaataaggtgccatccctggagcacaacaacaaagtgataggagagagtttggatctggttaaatatgttgatagtaactttgaaggaccatcacttacgccggatgaccctgaaaagcgaaaatttgctgaagaattgatagcttatagtgatactacattcgtcccagaagtatatagatctttcgcaaaagatgcacggacactggctggggcacaatttgattacctagaaaaagctctcctcaaatttgacgatggacctttcttcctcggtcaattcagtcaggttgacatagcatatgctccatttatcgaaaggttccaagttttcatgccagaggggtttgactatgacatcacaaccgggaggcataaactagccaaatggattgaggaaatgaacaagcttgacggatacaagcaaacaaaagtattggaacatgagaaaatggttgagtactacaagaaccgctttctgccggtactcactttgcaaatattaga

SEQ ID NO: 898 - DNA, 754 bp, Solanum phureja
tattgatggggttattcttttatttgcacagaattgtacaagaagttctaccaccaactttggattctacttcccaacccccatctctctttgatggaactaccaggttgtatatcaattatcaatgtccctattctcagcgtgtgtggattgccaggaatgttaagggtttgcaagaaaagatcaagttagttccaattgatcttaagaacaggcctgattggtacaaggaaaaagtttaccccacaaataaggtgccatccctggagcacaacaacaaagtgataggagagagtttggatctggttaaatatgttgatagtaactttgaaggaccatcacttacgccggatgaccctgaaaagcgaaaatttgctgaagaattgatagcttatagtgatactacattcgtcccagaagtatatagatctttcgcaaaagatgcacggacactggctggggcacaatttgattacctagaaaaagctctcctcaaatttgacgatggacctttcttcctcggtcaattcagtcaggttgacatagcatatgctccatttatcgaaaggttccaagttttcatgccagaggggtttgactatgacatcacaaccgggaggcataaactagccaaatggattgaggaaatgaacaagcttgacggatacaagcaaacaaaagtattggaacaggagaaaatggttgagtactacaagaaccgctttctgccggtactcactttgcaaatattaga

SEQ ID NO: 899 - DNA, 673 bp, Capsicum annuum
atggctgccccaaatgtacaagaagttctaccaccatctctggattctacttcccaacctccatctctctttgatggaactaccaggttgtacatcaattatcagtgcccctatgctcagcgtgcctggattaccagaaatttcaagggtttgcaagacaagattgagttagttccaattgatcttcagaacaggcctgcttggtacaaggaaaaagtttaccctccaaataaggtgccatccctggagcacaacaacaaagtgatcggagagagcttggatctgattaagtatattgatagtaactttgaaggaccatcacttctgccggatgatcctgaaaagcgaaaatttgctgaagaattgatagcgtacagtgacacatttgtcccggaagtgtatggatcgttcaaaaaagatgtacagacattggctggggcacaatttgattaccttgaaaaagctctccacaaatttgattatgggcctttcttccttggtcaattcagtcaggttgacatagcatatgttccatttattgaaaggttccaaattttcttgcaagaggtgtttaactacgacatcacatctgggaggccaaaattagccaaatggattgaggaagtgaacaagcttgatggatacaagcaaacaaaagtcttggatccaaaga

SEQ ID NO: 900 - DNA, 754 bp, Solanum phureja
tgttgatggggttattcttttatttgcacagaattgtacaagaagttctaccaccaactttggattctacttcccaacccccatctctctttgatggaactaccaggttgtatatcaattatcaatgcccctattctcagcgtgtgtggattaccaggaatgttaagggtttgcaagacaagatcaagttagttccaattgatcttaagaataggcctgattggtacaaggaaaaagtttaccccacaaataaggtgccatccctagagcacaacaacaaagtgataggagagagtttggatctggttaagtatgttgatagtaactttgaaggaccatcacttttgtcggatgaccctgaaaagcggaaatttgctgaagaattaatagcttatagtgatactacattcgtcccagatgtatacagatctttcgcaaaagatgcacggacgctggctggggcacaatttgattacctggaaaaagctctcctcaaatttgacgatggacctttcttcctcggtcaattcagtcaggttgacatagcatatgctccatttatcgaaaggttccaagttttcatgccagaggggtttgactatgacatcacaaccgggaggcctaaacttgccaaatggattgaggaaatgaacaagcttgacggatacaagcaaacaaaagtattggaacaggagaaaatggttgagtactacaagaaccgctttctgccggtactcactttgcaaatattaga

SEQ ID NO: 901 - DNA, 2560 bp, Solanum phureja
ggaggaatactatataactaggagtcgcaaatacgcgtgcattgattatgtgtctagcggcagttccacaaagtttgggttgattagatcctctatattcttgtaactaaactttcctcgtatttttctaagttcacgcggtaggtaattcatcgttgcctactaattctggttattttcttggatttttcttcttcaaatcttgaaagcccccatttttccaagttgtggatttgattaatcagtaaaagcaacaatattttattcaagattctcttcttttaatgcagaagacgacattgacttaaacaagactattggtatcactcccaaattggactttgatggtacagaaacggaatatcaatcaggataatgatgaaaactctgagtttccatctagggaatctaagcgccaacatccttctaatgcgtttttttcagggttaaggagttactcttctccacaagaacttgcactaaggttggagccctcaatccgaagctgggtgcgtgaagagattgagagaacacttcaatctaccctgagatcctcacttaatgatgacaagacttctcaatctagggctattcagttactttttgacgatattctcccttcttcccttttcacgggcagtaatgtatccagggacaataggcccattaaagttctcttgcatgatgctagttcgaaccagagaataacatctggaccgttatcttcggcaaaagttgatgtggttgttcttaatggggaatttaaccccaacgatctagaagactggagtgaggaagagttcagcaaaaaggttattcgtgcaagagaaggaaaacgtccattattaactggagatttaatcattcagctaagggatggtgtgggatatctgggtgatatcagcttcactgacaattcaagctgggtaaagagcaggacctttaggttgggactgaaattgattaaccgctctggtgaatttagggtcagagaaggagttagcaagccttttactgtgagagatcatcgtggggaggcttataagaagcattaccctcccactttggatgatgagatctggcggttggaaaagattgccaaagatggtgcttcacacaaacggttgagtaatgaaggaatatcatgtgtgaaagagttcctacggctgtttgtcactgacccatctcttttacgtaagatgctggcttgtgggaacaacatatgggagaaaataactgaacatgtgagcacttgtccgttagacaacagcgagtggtacatctacaacgccggagaaagtattgtacttctgttcaactgcatctatgaacttgtaggtgcaattcttgatggacaaaatttccagtccattgacaaattagatgtatttcagaagcggatggtggaagactttaagcgtagtgtttataaaaatttgaattgtctagctccccttgaggaccgttctttgattggccaagcagcccttacatccaatctgcaaaatggcctttctcatattcctagttcaagccaacagaatatgaactactcagatgagcaaggtcaagtggagttccagagcaactctgatcatgccacaatttcatcaccgctagcctacacagctcaacaggatagtccaactgcagtgtccatgcctgaaagctttcatggaatgcaagcatttaattcgaccttggcaaacagtttcttggttggtgatccctgctccagtatctaccctggtgattatgattggggttccaatggttcatttgattcactagggatgagcgattatctacctcccaacaacaattatcagtttgagacaccagtgtggcaagggaatggattgttagcgagttcaagtgttcagccggtgtcacctaatattggcattcacatcacaagacgtggaaatcctagagccatttggtgcacaatccgtgctgtcctgaaatggaaaacattggttaagcgaaagtagctatttgaaggtggaaaggcttttacaagtagatatctgaagtttgttcgagatataaccaggaaacttcacctccatctctcagcctattctttgaactcttgggtattttgaaacataaatatatttatatgtccattacatatagcatccatcgtatatatgtgagtaaattgtacatatagtaaggtttttgtcaggatgaaggtgcatgtaggataaattttcttgcagaaacagtagcaagatatcaaatgttatgctaccgcaaatgccatcgtccttggaggagtttagtgctacctctttactaatagtactagtagttttcttgtgtgttttctgcatcagatgtaataaatggtgcttgtacaggaagtaatattattaccttaattattagtttataataatgagatgctatgtcaattgttgtcagctgtatccttggagctcgtctggccccattgtacattttctgtcattacacttcgtggtatataaacatatagctgtacattacctaattgttgggaatcttagtaactcggttggctgactatttg

SEQ ID NO: 902 - DNA, 1557 bp, Solanum tuberosum
tcttaagaaacttctagaaacaaaaaaacgcaaatttctcaattttctcgtcttctcgatctgtttagaagaggtttggatctgaattagcagcaacggtggaagccatggtgccatcgtctattgaacattccggcgaatctgcctccggggagaatcagagatctcttccgacgccatttctgacgaaaacttaccagcttgtagatgattctgccatggatgagttgatctcgtggaatgacgatggaacgacattcattgtttggaaacctgctgagtttgctagggatttgcttccgaaatattttaagcataataatttttccagttttgttcggcagcttaatacttacggattcagaaaaattgtacctgatcgatgggaattcgcaaatgactgtttccgtaggggtgagaaaggactacttcgtgacattcaacgccggaaaatctcaccggcatgtaccgtcgtgagtgcggttgttgcaccagcagtagcggtgaatgcagcacaagcagtgacggtagcggtagcaccggctgtgaggatggtttcttcgtcgaattccggtgatgaacaggtgttatcatccaactcatcgcctgcagctacggcagcggcgatgttaaggaccaccacgtgtacgacgacgcaggaacttatagaggagaacgagcggttgagaaaggagaacgcgcaactgaatcaggaattgaatcggttgagaagtttatgcaataacgtatacaatctgatgtccaattactcggtgaatccggcggatataccggcaagaataccggaaggacgagctctggaattgcttgacggcagcggtgcagccttcacagcggcggaggaagatataagcccacggttgtttggtgtatcaattggggtaaagcgcgtgaagagaagcaacgaagaagaatctgatacagttgaggatcaggatcaagtacaaccgcatggatcagacatggaatcagagccgttggattcaggaagcgctcatcatgatgatcaaccatggatctatcgattagatttagggtgatgatttgtcactcagaacaagtcagtcccttgtaggtggggtccacagaagcacttgggtgttgatgaacaacacgtgtacaatggaagattgttggttgtttctggtggtttctagaagaagtgagaaattgagtccaatggtttttagaaaaggtcacaatattagaaaattataaaaggccccaaaagaggtggaaaaggagaaaaaaagtggctttttaatatgatttcataattggattggaaaaatagagggagctgagctggtaggttaaaaaagatgattagtcaatgttttaattagttgggattagggaaatatttatgttaacaatacaaggtgccaactaatttttggctagggaaattgtttgtgcataattgaaacattaataatgttgtaactttatgtttgaagtacttggtaaatttactgaatatttgctcttactcattttccttcttagcctgcttgtaaaaaaaaaaaaaaaaaa

SEQ ID NO: 903 - DNA, 1638 bp, Nicotiana benthamiana
  misc_feature (1586)..(1586): n is a, c, g, or t
ctctttctatattaacctcctacgaaccttctagaaacaaaaaacgaaaacacggctttctctcaatccctctttgggtttggatctgtaatagaagtagcagtggatgtcatggtgccgtcgccggttgaacaaaccggcgaatctgtcgctggtgagaatcagagatctcttccgacgccatttctgacaaaaacttatcaactcgtcgatgatcctgcaatcgacgagttgatctcgtggaatgaagatggaacgacgttcattgtttggaaacctgctgaatttgctagagatttgcttcctaaatattttaagcataataatttttccagtttcgttcggcagcttaatacttacggattcagaaaagttgtacctgatcgatgggaattcgcgaacgattgtttccggaaaggagaaaaaggacttcttcgtgacattcaacgccggaaaatctctccggcagggactgccgttactgcggtttcaccgacagtagcggtgaatgcagcacaagcggtgacgatagcggtggcaccggcagcgcggttggtatctccgtcaaactccggtgacgagcaggtgttgtcgtcaaattcgtcgccggcggcaactgctgccgcagcggcggtgttacggaccaccacgtgcacaacgacaccggagcttctggaagagaatgaacggttgaggaaagagaatgcacaattaagtcaggaattaaatcggttaagaagcttatgcaataacgtatacaatctgatgtcgaattacacggggaatccatcagagatgccggcaggaattccagaaggaagagctctcgaattgcttcctgcaggtcaggttgcggcggagatggacggcggagccaccgctacgccagcggaatgcagcggtgttaaggcggaggaagatataagcccgcggttgtttggagtatcaattggggcaaagcgcgtgaggagaagcaacgaagaagaatcagaaagagaaggaatagtgcaggatcaagtacagctccacggatcagacgtgaaatcagagccgttagattcaggaagcggacatcataatggtcagccagatcgattaggctgatgattagatggagaaccaaaaaagacaaaattaagaagtggtccccagcaaccgggccccactaaaagcacttactagagcaacgaggaagatgaggatgttgaaaaagaacacgtgtacaatgaaagtaattatcaatgttggttctgggagtttctggaacagcgagtgggtcaatgttgtaaaacgtcactgtatttgaaaactatggttcacaaaaaagctcacaaaaagcggtggaaaggagaaaaaaggtggctttcaaaatgatccataattggattgaaaatgggggagcagggctagcctagttgaaaaagatggacaaatatggaattaggtcaatgttttagttagatgggacctatttaggttgcaaggtgcaaaagaatttttagttagaaaattgtttgtacataattgaaacaaaataatgtattgtaacttaaacttcttattaaacttactgaactttgctcttnctatattggataattgttattgtttagcttaaacatcttattattcttactg

SEQ ID NO: 904 - DNA, 833 bp, Solanum tuberosum
ctcactagtaaagatgaatgtgttgatgatcaagttgtgtttttttctagtccttatttccaatggttattcaacaaaattggattcttatcctccaacttgtcaaagaattgagtgcccaaattatgatgtgattgaatctgtaaaagactatgaaattcgtcgttacaattcccctatgtggatgtctactgaaccaattgatgatatatcatttgtttccgccaccagaactggtttcctcaggttatttaagtatattcaaggaaagaatgataagcatgataaaatagagatgacagcaccagttatgactcaagtgaagccaagtgatggaccattatgttcaacttcatttattgtgagctttaatgtaccaaagaagaatcagccaaatcctccttcagctgaaggcctacacccccaaaaatggaacgaaagtagttatgccgcggtcaggcaattcagtggatttgcatctgatgctgttattccgaaagaagctgctgccctgagtgccagcattgctggcacgaaatgggcagcagccatcgaaaaaagccggggtaaagataatagtacactttatacagttgaacaatacaactccccgtttgagttcaggggcagagttaatgagatgtggtttacttttgttatggacagtgcaattgccatttgagaggttattgttcaagaataaagtttactatcacattttcttgttttgtattatcaacagtatagttgagaagtcctagttattatgtatgaccagaatgttacattatatattgcaaataagataggttgtataatacaatctgattctg

SEQ ID NO: 905 - DNA, 855 bp, Solanum phureja
gtagcacaccaaaaagaaagaaatactcactagtaaggatgaattctttgatgatcaaagtgtgtttttttctggtccttatttccaatggttattcaacaaaattggattcttatcctccaacttgtcaaagaattgagtgcccaaattatgatgtgattgaatctggaaaagactatgaaattcgtcgttacaattcccctatgtggatgtctactgaaccaattgacgatatatcatttgtttccgccaccagaactggtttcctcaggttatttatgtatattcaaggaaagaatgataagcatgagaaaatagagatgacagcaccagttatgactcaagtgatgccaagtgatggaccattatgctctacttcatttgttgtgagtttttatgtaccaaagaataatcagcaaaatcctccttcagctgaaggcctacacccccaaaaatggaacgaaagtagttatgctgcggtcaggcaattcagtggatttgcatctgatggtgatattccgaaagaagctgctgccctgagtgccagcattgctggcactaaatgggcagcagccatcgaaaaaagccggagtaaagataatagtacgctttatacagttgcacaatacaactccccgtttgagttcaggggcagagttaatgagatgtggtttacttttgttatggacagtgcaattgccatttgagaggttattgttcaagaataaagtttactatctcattttcttttttgtattatcaaaagtatagttgagaagtcctagttattatgtatgaccagaatgttacattatatattgcaaataagataggttgtataatacaatctgattc

SEQ ID NO: 906 - DNA, 862 bp, Solanum tuberosum
  misc_feature (626)..(626): n is a, c, g, or t
gcctcgtgccgattcggcacgagggaaatactcactagtaaagatgaatgtgttgatgatcaagttgtgtttttttctagtccttatttccaatggttattcaacaaaattggattcttatcctccaacttgtcaaagaattgagtgcccaaattatgatgtgattgaatctgtaaaagactatgaaattcgtcgttacaattcccctatgtggatgtctactgaaccaattgatgatatatcatttgtttccgccaccagaactggtttcctcaggttatttaagtatattcaaggaaagaatgataagcatgataaaatagagatgacagcaccagttatgactcaagtgaagccaagtgatggaccattatgttcaacttcatttattgtgagctttaatgtaccaaagaagaatcagccaaatcctccttcagctgaaggcctacacccccaaaaatggaacgaaagtagttatgccgcggtcaggcaattcagtggatttgcatctgatgctgttattccgaaagaagctgctgccctgagtgccagcattgctggcacgaaatgggcagcagcatcgaaaaaagccggggtaaagataatagtacactttatacagttgnacaatacaactccccgtttgagttcaggggcagagttaatgagatgtggtttacttttgttatggacagtgcaattgccatttgagaggttattgttcaagaataaagtttactatcacattttcttgttttgtattatcaacagtatagttgagaagtcctagttattatgtatgaccagaatgttacattatatattgcaaataagataggttgtataatacaatctgattctg

SEQ ID NO: 907 - DNA, 614 bp, Solanum phureja
aaaataaaaaaataaaaaaaaatggcgatttttggtgatccttttagaagattcttattgagtccgacgatttatcgaagcttttctggttctcctgctcttctcgattggattgaatctcctaattctcacatcttcaaaatcaatgttccagggtatagcaaggaggatataaaggttcaagttgaagatggaaatgtgttggtggtgaaggcggaggggcacggcggcaagaaggacgaattccacggtaaagataaggatgtagtgtggcatgtggcggagcgaggaggagggagagggagaggtggcgatttctcgagggaaatcgagctgccggaagatgtgaaggtggatcaaatcaaagctcaagttgaaaatggtgttcttaccattgttgtaccaaaagatgcaactccaaaaacatctaaagttaggaatattaatatcactagcaagttataaaatcttggttatggtacaataaaaattagggatagttgtttgtgtacgttgtcacaagttgtggaattgaatggatgcaacaaagtacttgtagaataaataaggttttgttgtatccaagcttaatgtactttctataatttgcgtat

SEQ ID NO: 908 - DNA, 745 bp, Solanum melongena
acatataaacctctcctacatcatcttctccattgtaccaaaacttacgataagccttacagaaccttccagagcttctagagatttttttttaaatcttcattcctttatttatatatcattttcctcctcagataaaataaaatcatttttagaagaaaaaatggcgatttttggtgatccttttagaagattcttattgagtccgacgatttatcgaactttttctggttctcctgctcttctcgattggattgaatctccgaatgctcacatcttcaaaatcaatgttccagggtatagcaaggaggatataaaggtacaagttgaagatggaaatgtgttggcggtgaaggcggagggtcgcggtggcaagaaggacgaattccacgggaaagagaaggagatagtgtggcatgtggcggagcgaggaggagggaaagacggtgatttctcgagggaaattgagctgccggaagacgtgaaggtggatcaaatcaaagctcatgttgagaatggtgttctcactattattgcaccaaaagaagcaactccaaaaacatttaaagttaggaacattaatatcactagcaagctataaaattttggttatggaacaataaaaattaaggatagtttgtgtatgttgtcacaagttgtgaaattggatggatgtaacaatgtacttgtagaataaataagtgcttttatatccaagcttaaagaacatactattccccccttg

SEQ ID NO: 909 - DNA, 1150 bp, Capsicum annuum
aaaatttcacaacaaataaataaaaattagaaaaagggaaaaaattatgtctatttttggtgatccatttagaagatttttattgagtccaacaatttatagaacatcatatggttctaatgctcttcttgattggattgaatctcctaatgctcacattttcaaaattaatgttccagggtacagcaaggaggacataaaggtgcaagttgaagatggcaatgtgttggtggtgaaggcggaggatcgaggtggcaagaaggacgaataccacggtaaggacaaggagatagtgtggcacgtggcggagagaagcggaggaggaaaaggcggcggggatttctcgagggaaatcgagttgccggaagatgtgaaggttgatcaaatcaaagctcaagttgagaatggtgttcttactattgttgtaccaaaagatgcaactccaaaaccatctaaagttaggaacataaatatcactagcaagctataaaatcttttccggatctcgcacgcagcagcaagaactttagtgcaccgagctgtccttttggtttttggaatagtaaaagttaaggatagtttgtttatgttgtcacaaaaaatgtgggattggatggatgtaacaaaagtacttgtagaataaatttaagtgtttgtatctgaaactttattacctgtgcggattcttctctgtgttggcttaataatcgtactgcagctgctcaatatattattgagcacggaggagatgtaaatgctgcagatcatacagggcaaacagcattgcactggagtgctgttcgaggtgcagtgcaggttgctgagctcttattacaagagggtgctcgtgtaaatgctgccgacatgtatggctatcagccaacgcatgttgccgcacagtatggtcagacagctttcctttattacgttgttacaaagtggaatgctgatcctgatgtacctgacagtgatgggagaagccctttacactggtagttctgagaactatagtatactctttttctgaataacaagcttgagttgttagaaacatgcaatagcctttctttgttgcaaacaagtgctgatacttttggagcttctttatctgtctattacatggttctttgatactatgtgaaaacttgtg

SEQ ID NO: 910 - DNA, 727 bp, Nicotiana tabacum
  misc_feature (91)..(91): n is a, c, g, or t
ggccattacggccggggagattaagaaaaaaattaaaaaatacgcagagaagtagaagaaaaaaaaaggtgtagaaatggcgctttttggngatcctttcagacaattcttattgagtcccacaatttaccgcagctcttctggttctgctgctcttctggattggtttgaatcccctaattctcatatcttcaaaatcaatgtcccagggtataacaagaaggacataaaggtgcaagtcgaagatgggaatgtactagtagtgaaggcggagggtggcggcaaaaaggacgaattccacggaaaagaggagatagtgtggcatggggcggagagaggcggaggaaagggagatttctcaagggaaattgagctgccagaagatgtgaaggtggatcaaatcaaagctcaagttaagaatggtgttctcaccattgttgtaccaaaagatgctactccaaaaccatctaaagttaggaacataaatattaccagcaagttgtaaaatcttggctatggaacaatggaaataaggatgtgttttgtgtaggttgtgttatggaatttgataatgtaacaaagttgttgtagaacaatcaaagtttttgtatctaagttaatgcatttcaatttctatcatcccttttttctttcctaattttacactacaatatactaaaccattgatcttgttgaaatgtcatttgtcttgattagcggccgcatg

SEQ ID NO: 911 - DNA, 545 bp, Petunia hybrida
cagaaatggcgctttttggtgaccccttaagacgatttttgtggagcccaactatttacggcacctcacctggttcagctgctcttctggattggcttgaatctcctaatgcacacgtcttcaaaattaacgtcccagggtatagcaaggaggacataaaggtgcaagtagaagatgggaatgtattggtggtgaaggcggagggtggtggcaagaaagacgaattccatggaaaagagaaggatatagtgtggcatgtagcagagagaggcggcggaaaaggcgatttctcgagggaaattgagctgcccgaagatgtgaaggttgatcagatcaaagctcaagtggataatggtgttcttactattttagtaccaaaagatgctactccaaaaccatctaaagttagaaacattaatatcactagcaagctgtaaaatcttggttatggagtgatacaaataacggtactgtgtatgttatagaataagctatgtttttgtatcatggttagtgtactcgtatctttctttttccttaatttt

SEQ ID NO: 912 - DNA, 969 bp, Solanum phureja
ctcaatacttgcacatcatacaaattaaaaaaatatgaagaaacatcacatttttcaggaagatcatcaaaattcttctggcagttctttagccatgagctcctcttttggaacaagtactccagaaagacattcttctttttctcaagattctgaatctactgctagcgctcttcacagtccatcttcttcagattactcacccagagttactccaagtcaggatgattcagctgtaattattcagaagaggaaattggggaagaaggcaaaaagttatgcatatagaattcgtgagcatgtgaaattgggttcaaagttttcagaaacggtgaaggggaaattgaatatagtgaaagaaggagggagaagaaatatattcaggcatatgtttaatgtgaatgatggagagaaattgcttaaggcatcgcaatgctatttgtacacaacaacaggtccaattgctgggattctgttcatatcaacagataaaatagctttctgcagtgaaagacccattgctgttccttgtccctctggaggaattcttagaacaccttataaggtggttattccagtgacgaaaattaaaagagctcatccgagtgtaaacgagaataaaccatctcaaaagtacattgaaatagtaaccgaagataattttgaattttggtttatgggttttgtacgatatgaaaaagctttcttgaatttacaaaaagctatatccatgtcgaattaaatatttacacgttagaatctttaggattttaaagagctttgctagtactctagagttttttatttctttttaacttttttgttgaattggtggcattttaggactggttattctttgtttacctttctgtcgatgatcataatttcaactatttaggctctagggatatgaattttatgttcaagtgtaattatctatggttatttgaggtacttttggactccctg

SEQ ID NO: 913 - DNA, 932 bp, Solanum melongena
atactttctcaccacacaaatcaaaaaagtcaatagttaatattcaactctaacatgaacaaacatcacaattttcaggaagatcatctaaattcttctggtagttctttagccatgagctcctcttttgggacaactactccagaaaggcattcttctttttctcaagactctgaatctactcttcacagcccatcttcttcagatcattactccccaacaataattacaccaagtcatgatgattcagctgtaattattcagaagaggaaattggggaagaaggcaaaaagttatgcatatcgaattcgtgagcatgtgaaattgggtccgaagttttcagaaactgtgaagggaaagttgaagatagtgaaagaaggaggtagaaaaaatatattcaggcatatgtttaatgtgaatgaaggagagaaactgctgaaggcatcacaatgctatttgtacacaacagcaggtccaattgctgggattctcttcatatcaacacataaaattgctttctgtagtgaaagacccatctctgttcctttcccctccggaggaattcttagaacaccttacaaggtggttattccagtgaagaaaataaaaagagctcatccaagtgtgaacgagaacaaaccatctcaaaagtacatggagatagtaactgaagataattttgagttttggtttatgggttttgtacgatatgaaaaagctttcttgaatttacaaaaagctatttcaatgtcgttttagacattagaatgtttaggattttaaatagcctgtgagagtacttaatctagagatctttgtggaattgatggcattttaattaggactgtttattcatcgtttacgtttctaaaattatgaaggtatgtttaagtgtaattatctatggcatataaatccaaggtcatttgaag

SEQ ID NO: 914 - DNA, 953 bp, Solanum tuberosum
gctcaatacttgcacatcatacatacaaattaaaaaaatatgaagaaacatcacattgatcatcaaaattcttcttgcagttctttagccatgagctcctcttttgggacaagtactccagaaagacattcttctttttctcaagattctgaatctgctgctagcgctcttcacagtccatcttcttcagattactcacccagagttactccaagtcaggatgattcagctgtaattattcagaagaggaaattggggaagaaggcaaaaagttatgcatatagaattactgagcatgtgaaattgggttcaaagttttcagaaacggtgaaggggaaattgaatatagtgaaagaaggagggagaagaaatatattcaggcatatgtttaatgtgaatgatggagagaaattgcttaaggcatcgcaatgctatttgtacacaacagcaggtccaattgctgggattctgttcatatcaacagataaaattgctttctgcagtgaaagacccattgctgttccttgtccctctggaggaattcttagaacaccttacaaggtggttattccagtgacgaaaattaaaagagctcatccgagtgtaaacgagaacaaaccatctcaaaagtacattgaaatagtaaccgaagataattttgagttttggtttatgggttttgtacgatatgaaaaagctttcttgaatttacaaaaagctatatccatgtcgaattaaatatttacacgttagaatctttaggattttaaagagctttgctagtactctagagttttttctttttttgttgaattggtggcattttaggactggttattctttgtttacctttctgtcgatggtcataatttcaactattttggctatagggatatggattttatgttcaagtgtaattatctatggttatttgaggtacttttggactccct

SEQ ID NO: 915 - DNA, 999 bp, Capsicum annuum
gcacgaggacgttatattctctgcaaacacacaaaaatatagtcaatatgaaggaacatcaaaacaattttcatgaagatcataatgtaaattattctggtagttctttagctatgagctcttcttttggtacaacaccagaaaggcattcttctttttctcaagattctgagtcaggcagccctcttcatagcccatcttcttctgattattcaccaagaataatcactccaagtcaagatgattcagctgtaattattcagaagaagaaactgggaaagaaggcaaaaagttatgcctatagaattcgtgagcatgtaaaactggggccgaatttttcagagacggtgaaagggaaattgaagatagtgaaagaaggagggagaagaaatatattcaagcatatgtttaatgtaaatgaaggagagaaacttctcaaggcatcacaatgctatttgtacacaacggcaggtccaattgctgggattctattcatatcaacacataaaattgctttctgcagtgaaagacccattgctgttccattcccatctggtggaattcttagaacaccttacaaggtggttattccagtgacgaagattaaaagagctcatgcgagtgtgaatgagaacaaaccatctcaaaaatacattgagataataactgaagataattttgagttttggtttatgggttttgtacgatatgaaaaagcttttctgaatttacagaaagctatttccatgtccaattaaaatatttagacattagaatctttaggattttaaatagcctttgccagtaccgtagagtttctctctctctctctcgttgttgaattggtgggatttatggaatgatgtttattcatcgtttacctttctgtcaatgattcatactaatcaaaatttgactttacgagaaattggaccaaaaactgttaaacataataaaataagatatatatatatattttgaattgttcgattgataaaa

SEQ ID NO: 916 - DNA, 968 bp, Nicotiana tabacum
caaatcactcgtatttcaaaaatactcaaattaaacatgaaggaaaatcattaccaatttgaagatcaacaaaattattgtggcagctcttccgccatgagctcctcctttgggacaactccagaaaggcattcttctttttctcaagattctgaaactgtcagctctcttcacagttcttcttcttctgataattactctcccagagttactccaagtcaagatgattctgctataattgttcacaagaggaaattgggaaagaaagcaaaaagttatgcttatagaattcgcgagcatgtgaaattggggccaaagttttcagaaacggtgaaggggaagctgaaaatagtgaaagaaggagggagaaggaatatattcaggaatatgtttaatgtgaatgaaggagagaagctgctaaaggcatcacagtgttatttgtacacagcagcgggtccaattgctgggattttgttcatatctacagagaaaatagctttctgcagtgaaagacccatagctgttcctttcccctctggaggaattcttagaacaccttacaaggtggttattccagtgaagaaaattaaaagagcttatgcaagtgtgaacgagaacaaaccatctcaaaagtacatcgagatagtgactgaagataattttgaattttggttcatgggctttgtacgatatgaaaaagctttcctcaacttacaaaaggccatttccatgtcgaactagctagctattagatattagaatttttaggattttaaagaggattcgtaaatctgtagtttttttttccttattagatgttgaactaatagcatctaattaatctatgcttgttcatcattttcttttctctcaacggaagaggatttgagatttatgagaattgaattttgtagattctgaaatttaatgatttctcaacatatatataagatttagaccaaagttac

SEQ ID NO: 917 - DNA, 1127 bp, Solanum tuberosum
ataattttccttttatctctctctgtacaattctttcgatttgcctaattctcaggtcatctttccagctccacttggttgtgtagtgcatttctttccaagaaagcttttttattggagatggctgaggacggtcacaaggttatcttgaatgtctatgacctgagccaaggtttagctcgacaattgtctactacttttttgggaaaagctattgaaggaatatggcacacaggagtagtggtttatggtcatgaatattattttggaggtggtatacaacatgctccagctgggacgacaccatatggaactcctattcaagttgtagacctgggtgtcacccacataccaaaggatgtctttgaaatgtatttacaagagataagccctcgatatactgcagagacatacagtttgcttacccacaactgcaacaatttcagcaatgagattgctcaatttttggttggtgcaaccattccagattatattttgaatcttcctaatgaggttacgaacagcccgatgggtgcccttataatgcccatgatacaacaactggaatcaacgttgagggctaatgcggtaccacaagcaccccagttcagaccagctactgttgctcctgcttcccagccgacactttctgttgggaagtcctctagtagtggtgtttatcaatctaaaaagcccgagagccaagatggagagaagaagaatgtgccctctgcggtgaaacctgtgggagagcaggagaagacgcctgctaatggtgttgtgaaagatcctcttggggatgctcggagcaaggtacaagaggaaatcacccgtgaatttgctgcaatcatggctactgggacattgcgtgcaagtgaggctgctgctttagcaactaaaaaagttatgcaaagatatggagatacatttgctgctatgaactaatgacaacgaagttgtctttataaattcatctgtgttggaaatttaatatccaactgatttgatgtaaggtagacttattggatgcttagtatgagatgagcaaacattcttccttgaaagagatacgcatattgtgctctttctggacttgatacattgaataagaactacgttttacaact

SEQ ID NO: 918 - DNA, 1232 bp, Solanum tuberosum
atcgccaaacaaataacataattttccttttatctctgcacgattctttcgatttgcctaattctcaggtcatctttccagctccacttggttgtgtagtgcatttgtttccaagaaagcttttttattggagatggctgaggacggtcacaaggttatcttgaatgtctatgacctgagccaaggtttagctcgacaattgtctactacttttttgggaaaagctattgaaggaatatggcacacaggagtagtggtttatggtcatgaatattattttggaggtggtatacaacatgctccagctgggacgacaccatatggaactcctgttcaagttgtagacctgggtgtcacccacataccaaaggatgtctttgaaatgtatttacaagagataagccctcgatatactgcagagacatacagtttgcttacccacaactgcaacaatttcagcaatgagattgctcaatttttggttggtgcaaccattccagattatattttgaatcttcctaatgaggttacgaacagcccgatgggtgcccttataatgcccatgatacaacaactggaatcaacgttgagggctaatgcggtaccacaagcaccccagttcagaccagctactgttgctcctgcttcccagccgacactttctgttgggaagtcctctagtagtggtgtttatcaatctaaaaagcccgagagccaagatggagagaagaagaatgtgccccctgcggtgaaacctgtgggagagcaggagaagacgcctgctaatggtgttgtgaaagatcctcttggggatgctcggagcaaggtacaagaggaaatcacccgtgaatttgctgcaatcatggctactgggacattgcgtgcaagtgaggctgctgctttagcaactaaaaaagttatgcaaagatatggagatacatttgctgctatgaactaatgacaacgaagttgtctttataaattcatctgtgttggaaatttaatatccaactgatttgatgtaaggtagacttattggatgcttagtatgagatgagcaaacattcttccttgaaagagatacgcatattgtactctttctggacttgatacattgaataagaactactttttacaactacgacttgagtttatgaatcattttccttgaaagagatacgcatactctactctttctcgaaattgaaaattgaagcttatcctggataaac

SEQ ID NO: 919 - DNA, 1139 bp, Solanum phureja
cgccaaacaaataacataattttccttttatctctgcacgattctttcgatttgcctaattctcaggtcatctttccagctccacttggttgtgtagtgcatttgtttccaagaaagcttttttattggagatggctgaggacggtcacaaggttatcttgaatgtctatgacctgagccaaggtttagctcgacaattgtctactacttttttgggaaaagctattgaaggaatatggcacacaggagtagtggtttatggtcatgaatattattttggaggtggtatacaacatgctccagctgggacgacaccatatggaactcctgttcaagttgtagacctgggtgtcacccacataccaaaggatgtctttgaaatgtatttacaagagataagccctcgatatactgcagagacatacagtttgcttacccacaactgcaacaatttcagcaatgagattgctcaatttttggttggtgcaaccattccagattatattttgaatcttcctaatgaggttacgaacagcccgatgggtgcccttataatgcccatgatacaacaactggaatcaacgttgagggctaatgcggtaccacaagcaccccagttcagaccagctactattgctcctgcttcccagccgacactttctgttgggaagtcctctagtagtggtgtttatcaatctaataagcccgagagccaagatggagagaagaagaatgtgccccctgcagtcaaacctgtgggagagcaggagaagacgcctgctaatggtgttgtgaaagatcctcttggggatgctcggagcaaggtacaagaggaaatcacccgtgaatttgctgcaatcatggctactgggacattgcgtgcaagtgaggctgctgctttagcaactaaaaaagttatgcaaagatatggagatacatttgctgctatgaactaatgacaacgaagttgtctttataaattcatctgtgttggaaatttaatatccaactgatttgatgtaaggtagacttattggatgcttaataggagatgagcaaacattcttccttgaaagagatacgcatattgttctctttctggacttcatacattgaataagaactactttttacaacta

SEQ ID NO: 920 - DNA, 1230 bp, Solanum tuberosum
cgccaaacaaataacataattttccttttatctctgcacgattctttcgatttgcctaattctcaggtcatctttccagctccactcggttgtgtagtgcatttgtttccaagaaagcttttttattggagatggctgaggacggtcacaaggttatcttgaatgtctatgacctgagccaaggtttagctcgacaattgtctactacttttttgggaaaagctattgaaggaatatggcacacaggagtagtggtttatggtcatgaatattattttggaggtggtatacaacatgctccagctgggacgacaccatatggaactcctgttcaagttgtagacctgggtgtcacccacataccaaaggatgtctttgaaatgtatttacaagagataagccctcgatatactgcagagacatacagtttgcttacccacaactgcaacaatttcagcaatgagattgctcaatttttggttggtgcaaccattccagattatattttgaatcttcctaatgaggttacgaacagcccgatgggtgcccttataatgcccatgatacaacaactggaatcaacgttgagggctaatgcggtaccacaagcaccccagttcagaccagctactattgctcctgcttcccagccgacactttctgttgggaagtcctctagtagtggtgtttatcaatctaataagcccgagagccaagatggagagaagaagaatgtgccccctgcagtcaaacctgtgggagagcaggagaagacgcctgctaatggtgttgtgaaagatcctcttggggatgctcggagcaaggtacaagaggaaatcacccgtgaatttgctgcaatcatggctaatgggacattgcgtgcaagtgaggctgctgctttagcaactaaaaaagttatgcaaagatatggagatacatttgctgctatgaactaatgacaacgaagttgtctttataaattcatctgtgttggaaatttaatatccaactgatttgatgtaaggtagacttattggatgcttaataggagatgagcaaacattcttccttgaaagagatacgcatattgttctctttctggacttcatacattgaataagaactactttttacaactacgacttgagtttatgaatcattttccttgaaagagatacgcatactctactctttctcgaaattgaaaattgaagcttatcctggataaac

SEQ ID NO: 921 - DNA, 1214 bp, Solanum melongena
attctagaagatctgagaggttttgactaccaatataacaataacaagtcccaatttccgtggagtttaatctctgtttggatgctaacaataacttaatttctgtttcactctgcaggctttcctcattctcaggtcatctttccagctccacttggttgcgtagtgcgtttcccaagaaagttttttattggagatggctgaggatggtcacaaggttaccttgaacgtctatgacttgagccaaggtttagctcgacagttgtctactacttttttgggaaaatctattgaaggaatatggcacacaggagtagtggtttatggtaatgaatattattttggaggtggtatacaacatgctccagctgggacgacaccatatggaactcctgttcaatttgtagatcttggtgtcacccatgtacccaaggatgtctttgaaatgtatttacaagagattagccctcggtatactgcagagacatacagtttgcttacccacaactgcaacaatttcagcaatgagattgctcaatttttggtcggtgcaaccattccggattatattttgaatcttcctaatgaggttacaaacagcccaatgggtgcccttataatgcctatgatacaacaactggaatcaactttgagggctaacgcggttccccaagcaccccagttcagatcacctactgttgctcctgcttccctaccggcaccttctggtgggaagtcctctagtagcggtgttgatatatctaaaaagcccgagagccaagatggagaaaagaagaatgctaatgtgccctctacggtcaaatctgtgggaaaggaggaaaagacatctgctgatgctgctgctgtgaaagatcctcttgggaatgctcggagcaaggtgcaagaggaaatcacccgtgaatttgctgcaatcatggctactgggacattgcgtgcgagtgaggctgctgctttagcaactaagaaagttatgcaaagatatggagacacaactgctgctatgaactaatatagcgaagttgtgtcttttataaaaactcatttgtgtttggaaaattaatatccaattgaattgatgtaaggtagatttattggacgccaattaggagatgaccaaaggttcttccttgaaaaagatcttgtactctttttggacattgatacattgaattagaactatttttttgcaactg

SEQ ID NO: 922 - DNA, 1492 bp, Capsicum annuum
ttttttttttgagaaaatcacagagaaacaatcctgaatttataatttatatgaaaattgagatcatatttagaaaaaattgggtgataaggagtttacccacagacatcttaagaaccctttgggaaataggactacaagaatttattcaatcctatctatcttgtaacaacttgaattggagaataccaaacccaaagaattacaaagtagtagcagtcttacatacctcaatacaatagacaaactcgtgactagaagaagaggggttgggcttgataattgcttattgtcacgagcctattttaagatgcgtgcggaaagcttaacacactcaaaagtgatgctaaacgccaaatgagaacataattttcctttctctctgcacgtttccttcgatttcccctctttctcagttcatccttccagctccacttggttgtattagaaagcatttttattggagatggctgaggatggtcacaaggttaccttgaacgtctatgacttgagccaaggtctagctcgacagttgtctactacctttttgggaaaagctattggaggaatatggcacacaggagtagtggtttatggtcatgaatattattttggaggtggtatacaacatgctccagctgggactaccccttatggaactcctgttcaagttgtagatcttggtgtcacacacgtacccaaggatgtctttgaaatgtatttacaagagataagccctcggtatactgcagagacgtacagtttgcttacccacaactgcaacaatttcagcaatgagattgctcaatttttggtcggtgcaaccattccagattatattttgaatcttcctaatgaggttatgaacagcccgatgggtgcccttataatgcctatgatacaacaactggaatcaacgttgagggctaacgcggttccacaagcaccccagttcagaccacatactgatgatcctgcttcccagccgacactttctggtgggaagtcctctagtagccatgttgaacaatctaaatccgccaagagccaagatggagaaaagaatgctattgtgccacctgtggtcaaatctgtgggagagcatgagaagacacctgctaattctgccaagaaagatcctcttggggatgctcggagcaaggtacaagaggaaatcacccgtgaatttgctgcaatcatggccactgggacattgcgtgcaagtgaggctgctgctttagcaactaagaaagttatgcaaagatatggagacacaactgctgctatgaactaatggcaaccaagtttgcctttataaattcatctgtgttggaaaattaatacccaactggaatgatgtaatgtagacttactgggttccaagtaggagatgacgatggattcttccttgaaagagacacacatcttgtactcttttttggactactttattcattgaataagaacttttttgcaactgtgaaaaaaaaaa

SEQ ID NO: 923 - DNA, 1184 bp, Nicotiana tabacum
ctacacaaaaaaaaaagtctcttttctatttttggacgctaaagcgagcataactttcctctctttccctctctctgcacgcttccttggatttccctcttctcaggtcatcttttcagctcactgagttttacattgcagtctacctaagaaagcctttttattggactgtttgagatggctgaggagggtcacaaggtttccttgaacgtctatgacttgagccaaggtttagctcgtcagttgtctactacatttttggggaaagctattgaaggaatatggcacacaggagtggtggtttatggtcatgaatattattttggaggtggtatacaacatgctccagctgggacgactccatatgggactcctattcgagttgtagaccttggtgtcacacacgtacccaaggatgtctttgaaatgtatttacaagagataagccctcggtatactgcagagacatatagtttgctaacccataactgcaacaatttcagcaatgaggttgctcaatttttggtcggtgcaaccattccagatgatattttgaatcttcctaatgaggttatgaacagcccaatgggtgcccttataatgcccatgatacaacaactggaatcaacattgagggctaacgcagttcctcaagcaccccagttcagaccacctactgttgcttctgcttcccagccgatggtttctggtggaaagagccaagtcggagaggataaatctggatcagtagtgaagcctgccaaacgtgaagaaaaacctgtgggagagcaagagaagacacctgctaatactgctgtgagggatcctctgggggactcacgaagcaaggtacaagaggaaatcacccgtgaatttgctgcaatcatggcaactggaacattgcgtgcgagtgaggctgctgctttagcaactaagagagttatgcaaagatatggacacacaactgctgctttgaactaatgacaaaaatgtttgtcaattcttaattttttcacatctgttggataagtaatatccaattgaatgatgtgagcctagacatttaggctattaagtagtaggaggtatctcgaattattgattcctaactaagattgttccttgaaagagatccgtatcttgtacgccttttggattttattaattgaataagaactttttgc

SEQ ID NO: 924 - DNA, 893 bp, Solanum phureja
aacttatttcaccacatttgtgagaggatggaagagataataggagaaaaaaagatgaagattctttgtttgcatggatttagaactagtggaaatttcttaaaaaaacaattaagcaaatgggatccttctatttttgctcattttgaaatggaattcccagatggaatatttgcagcaggggggaaatcagatattgagggcatatttccaccaccatattttgagtggttccagtataatgaggattttacagaatatgagaacttagaagaatgcatttcgtacttgtgtgagtatattacaagcaaagggcctttcgatggtcttctcggattctcccagggagcgactttatcaggccttttactagggtacatggaacaggggaagattctgaaagagcatccaccaatgaaattatttgtatcaatatcaggggccaaatttagggacccaaatatttgtaacattgcatacaaagatatgatgaaggttaaatcagtccattttattggagagaaagattggctcaaacttccttcacaagagcttacaacagcttttgaaaatcctctcatcataaggcatcctcaaggccacactgtgccaagactaggcaaatgaagcagctgtggagacattaaaaacttggacaagggaaattggcttctattccattgagagttgtgttggtggaggaccaaatgaagcctgcaaacacgttaacattgaaaatggtgtggaagaaggcaaaaaactagagatgcctaatgaagtagagatccaaaaggctcaagaataatagttctcaaattttagtttaaaataaatatattatgcatgtagagacgacttaacatagtatgcaactatttctatctatttaattt

SEQ ID NO: 925 - DNA, 1027 bp, Solanum melongena
tattatttggacacaaaagcttctaataactcgttcattttagtacttgtgctttgtggttgtgggaggatggaagagatcataggagaaaaaaagatgaagattctttgtttgcatggattcagaactagtggaaatttcttaagaaaacaattaagcaaatgggatccttctatttttgctcattttgaaatggattttccagatggaatatttgaagcaggggggaaatcagacattgagggcatatttccaccaccatattttgagtggttccagtataatgaggattttacagaatatgggaatttagaagaatgcatttcgtacttgtgcgagtacatcacaagcaaagggccttttgatggtcttcttggattctcccagggagcgactttatcagcccttttactagggtacatggaacaggggaagattttgaaagaacatcccccaatgaaactatttgtatcaatatcaggtgccaaatttagggatccaaatatttgtaacattgcatacaaagatgtgatgaaggttaaatcagtccattttattggagaaaaagattggctcaaacttccttctcaagagcttacaacagcttttgagaatcctctcattatgaggcatcctcaaggccacaccgtgccaagactagatgaagcagctgtggagacattaaaaacttggacaagcaaaattgtcctctcttacaatcagagttgtcttgatggaggaccaaatgaagcctccaaacatgttaacattgagaatggtctcgaagaagccaaaaaaactgagaagcctaatgaaatagagatccaaaaggctcaagaataacagaacgcttctctattatctttacttttacattgcaaattgttaaataagtactcatttcaagttattttgagattcgtatcataaatttattttgattatttttcagataaatatattattatgcatgtagagacttaacttaatatgcacctattgaaaatatactaggtcattctattcc

SEQ ID NO: 926 - DNA, 757 bp, Solanum tuberosum
  misc_feature (678)..(678): n is a, c, g, or t
ctgctgacgagataataggagaaaaaaagatgaagatctttgtttgcatggatttagaactagtggaaatttcttaaaaaaacaattaagcaaatgggatccttctattttttctcattttgaaatggaattcccagatggaatatttgcagcaggggggaaatcagatattgagggcatatttccaccaccatattttgagtggttccagtataatgaggattttacagaatatgagaacttagaagaatgcatttcgtacttgtgtgagtatataacaagcaaagggcctttcgatggtcttctcggattttcccagggagcgactttatcaggccttttactagggtacatggaacaggggaagattctgaaagagcatccaccaatgaaattatttgtatcaatatcaggtgccaaatttagggacccaaatatttgtaacattgcatacaaagatatcatgaaggttaaatcagtccattttattggagagaaagattggctcaaacttccttcacaagagcttacaacagcttttgagaatgctcttatcataaagcatcctcaaggccacactgtgccaagactagatgaagcagctgtggagacattaaaaacttggacaagggaaattggcttatcttccaatgagagttgtcttggtggaggaccaanatgaatcctgcaaacatgttaacattgaaaaatggtgtggaagaaggaaaaaagctagagaagcctaatgaaagtagag

SEQ ID NO: 927 - DNA, 1211 bp, Solanum phureja
cttttttcttcttcttcaatcgaagcttcctctgcaagatcgatttcttctagaacattctgcaacagcggagaacttgatcaatcttcatcggctccacactaccaacgaatcactgaattctctcaactttgaagatttcagaggttatggctgattcctccaaggacgatttcctccagctcctcaagagaattggggcatttcttactctcaagatttctaatctctcacaaacactggactcaagatctgcaggagctatagcaggtcttgcatttgcaatagtatttatctggagaatattgagatcacctagtggaccacagaggagacatcctaagcaacaagctgttacacctggtagttctggtgtaagcagacattttagtgaaaatataccgacttcagaagttagccccccttcagaggattcaaatgcacaaaatgtcattgatgagttctttcagcccataaagccaactcttgggcaaatagttaggcaaagattgggtgaggggaggaaggtaacatgtcggttgcttggagtaatcctggaggaaacgagcccagaggaactacagaaacaagctactgttcgatcctccgcgcttgaagtgttgctcgaaatcaccaaattttgtgatctttatctcatggagagagtacttgatgacgaaagtgaaaaaaaggtcctactggctttagaagatgctggagtgtttacatctggtggcatagtcaaagacaaggttctcttttgtagcattgagaatggacgaacatcatttgtccgacaactggaacctgattggcacattgatacaaatccggaaattgtttttcaattagcgagatttatcaaatatgagctacacattacgcctaccaagtcagaaagaactgctatgaatgtcttcagttcaacgtctttggagcagtttttcggaactgcttagattttggtttgttttaggtctcaccgtcctcttcaactttgggctgtgagttcatatttttaactcaattacatctttttctggtacctgcaactttatagttttgaggttcaaggaaaaaacttttgtatattactctgttgtatgcagaacaggtaacttcataattctatattattgtgctgtattcttgagaaaaaactagtcagcacaagaatgtcagttttccataatgcaaatctatttaacaac

SEQ ID NO: 928 - DNA, 1251 bp, Capsicum annuum
ctttgcaagatcaatttcttctagaagatttctgtaacagcaaagagagctcgatcaatctttcatcggctcaaacactaccaaggaaccacagaattccatcaattttgaagagttgagggggttgggtgggggtgggggtgggggcttatggctgatacttcgaaggacgatttggtggagctgataaagcgaattggggcttttcttactcttaagttttctaatctctccctaacattggactcaagatctataggcgctatagcaggtcttgcatttacaatagtttttgcctggagaatattgagaacatctagtccacagaggaggagtcctaaacgacaagctgttatacctggtagttctggtgtaagcagtcattttagtgaaaatatagcaacttcagaagttagccccccatcagaggattcgagtgcacaaaatgtaattgatgagttctttcagccagtaaagccaactctgggacaaatagtcaggcaaagactgagtgaggggaggaaggtaacatgtcggttgcttggagtaatcttggaggaaacgagcccggaggaactacagaaacaagctactgtccgatcctctgtgcttgaagtgttgctagaaatcaccaaattttgtgacctttatctcatggagagagtacttgacgacgaaagtgaaaaaaaggtcctactggctttagaagatgctggagtgtttacatctggtggcatggtcaaagacaaggttctcttttgtagcattgagaatgggcgaacatcatttgtccgacaactggaacctgattggcacattgatacaaatccggaaatcgtttttcagttagcgagatttatcaaatatgagctacacattacacctaccaagtcagaaagaacagctatgaatgttttcagctcaacgtctttggagcagtttttcggaactgtttagatgccatcatatcccaatgagttctaacatattttcattcgttttaggtctcacctgttgcccttcctattcaactttgggctgtgaaagttcatattttaaactcaattacgtctttttctggtacctgcaacttcataggttgaggtttaagggtgacactttgtatattactctgttgtattcagaacagatcactttataatttatatggttgctctgtataagccagtgtaccaaatggcttacacaaagatgtattattttgctagctttatggtgcaacctggttat

SEQ ID NO: 929 - DNA, 1357 bp, Capsicum annuum
gcacgaggatcaaaacttggactaacaaagtcacggtggttcaacccaaaaaaaaaacaaaaacaaagtcacggtggagaccaccttaaagcgcgattaatctatcacggaaaaactcaaccaccacagcgccgcccgccgcggagggctaagaaccaaattttgggtgaattaattattattattagtgcataataattactagaaataagatgggtgattattccaaagacgatttccttcagctcgtcaagcgattcggcgcttttttgaccgtcaagatttctaatctcttacatacactggattcaagatctgttggggccatagcaggtcttgcagttgctatagtttttacctggagagtgtggagatcacctagtgcaccacaaaggaggattccaaagcgacaaggtgcgacgcctagtagttctggtgtaagcaatcattcaagtgcaaatgcagcaacttcaggagttatctctacttccgaggattcaaatgctcaaaatgttattgatgagttctttcagccagtaaagccaacacttgggcaaatagttaggcaaaggctgagggaagggaggaaggtgacatgtaggttgcttggagtgatcctagaggaaactagcccagaggaacttcagcaacaagcgaccgtgcgatcctctgtacttgaagtattgctcgaaatcaccaaattttgtgacctttatctcatggaaagagttcttgatgacgaaagtgaaaaaaaagtcctcctggctttagagaatgctggagtgtttacctctggaggtctggtcaaagacaaggttctcttttgcagcactgagaatggacgcacatcctttgttcgacaacttgaacctgattggcacatagatacaaatccagaaatcacttttcagctagcgagattcatcaaatatcagttacacgtttcgccgaccaagccagaaagaacagcaatcaatgtcttcaactcaataacatttgagcagttctttggaaatgtttagatccaaccaacaagagctctagcaaatttcgtttattttaggtgtttttcgtctttttttcccctttcttttttgttgttgttccctcctttcttctctctactctactccggcatgtgaaaatcctcatttgtttcgactcatttttatggcttttcttggtatgtgctgcttaatagtgtgaaactaaggggcactaattggaaagcactggcattctcgaaacaaattcatttatgttgctgcaacatagatgaatatcacctatgttggaaagcattaagcactgatgtatcaatatcacctctcttttcaatatagatgtgagagtacct

SEQ ID NO: 930 - DNA, 1544 bp, Solanum lycopersicum
caaatatcaccttctcctcgaaggctgcgattcgctgtccctatttgtcaatttcatatttatttccatcaaaaacttggactacaaagtcacggtggagaccgccggaaaagctgaaagctcgattcatcggtcaccggaaactcaaccgacgaagacaactaggaggaggtggaggagccaaatttgctgaatttgatatatgattactacaagtaacatgggtgattcctccaaggacgatttccttcagctcatcaagcgattcggcgcttttttgaccgtgaagatttctaatatcttccacacactggattcaagatctgtgggggccatagcaggtcttgcagttgctatagtttttacctggagagtgtggagatcacctagtggaccacaaaggagaattcctaagcgacaaggtacgacgcctagtagttctggtgtaagcactcattcaagtgcaaatgtggaaacttcaggagttatctcttcttcggaggattcaaatgctcaaaatgttattgatgagttctttcagccagtaaagccaacacttgcacaggtagttaggcaaaggctgagtgaagggaggaaggtgacatgtaggttgcttggagtgatccttgaggaaactagcccagaggaacttcagcaacaagcaaccgtgcgatcctccgtactcgaagtattgcttgagatcaccaaattttgtgacctttatctcatggaaagagtccttgatgatgaaagtgaaaaaaaggtcctcctagctttagagaatgctggagtctttacatctggaggtctggtcaaagataaggttctcttttgcagcactgagattggacgtacatcctttgttcgacaactagaacctgattggcacatagatacaaatccagaaatcacttttcagctagcgagattcatcaaatatcagttacatgtttcgcctaccaagccagaaagaacagcaatcaatgtcttcaactcaacaacattggagcagttctttggaaatgtttagatcataccaacaagagctctagcagatttcgtttattttaggtgttctcgtcttctttttctctcctttttgttgttgttccctctttcttccacactctactctactcagcatgtgaaagtcttcacatgttttgactcctcattttttatggcttttcttggtatctgctgcttaatagtgtgagattaagtgcactaataggagagcactggtattgtggaaacaaatccatctatgttgctgtgtatcgatatcacccctctttacaaacatagatgtgagtacactgtaatttactgctaccttgcatttgttttatcttcctctacaaaatgctgaactcaggcctgcatctgtgttgcgctcgagctctgtacttggttttatcgtcctcttcaatcaaaggaagaaacaggaagaaaatagtataagtgaggatctatctgtgtaaacttttaactaaacgtagctcactcctgcaacttcagtttttttatttaaattctcagtt

SEQ ID NO: 931 - DNA, 1534 bp, Solanum lycopersicum
tctcctcgaaggctgcgattcgctgtccctatttgtcaatttcatatttatttccatcaaaaacttggactacaaagtcacggtggagaccgccggaaaagctgaaagctcgattcatcggtcaccggaaactcaaccgacgaagacaactaggaggaggtggaggagccaaatttgctgaatttgatatatgattactacaagtaacatgggtgattcctccaaggacgatttccttcagctcatcaagcgattcggcgcttttttgaccgtgaagatttctaatatcttccacacactggattcaagatctgtgggggccatagcaggtcttgcagttgctatagtttttacctggagagtgtggagatcacctagtggaccacaaaggagaattcctaagcgacaaggtacgacgcctagtagttctggtgtaagcactcattcaagtgcaaatgtggaaacttcaggagttatctcttcttcggaggattcaaatgctcaaaatgttattgatgagttctttcagccagtaaagccaacacttgcacaggtagttaggcaaaggctgagtgaagggaggaaggtgacatgtaggttgcttggagtgatccttgaggaaactagcccagaggaacttcagcaacaagcaaccgtgcgatcctccgtactcgaagtattgcttgagatcaccaaattttgtgacctttatctcatggaaagagtccttgatgatgaaagtgaaaaaaaggtcctcctagctttagagaatgctggagtctttacatctggaggtctggtcaaagataaggttctcttttgcagcactgagattggacgtacatcctttgttcgacagctagaacctgattggcacatagatacaaatccagaaatcacttttcagctagcgagattcatcaaatatcagttacatgtttcgcctaccaagccagaaagaacagcaatcaatgtcttcaactcaacaacattggagcagttctttggaaatgtttagatcataccaacaagagctctagcagatttcgtttattttaggtgttctcgtcttctttttctctcctttttgttgttgttccctctttcttccacactctactctactcagcatgtgaaagtcttcacatgttttgactcctcattttttatggcttttcttggtatctgctgcttaatagtgtgagattaagtgcactaataggagagcactggtattgtggaaacaaatccatctatgttgctgtgtatcgatatcacccctctttacaaacatagatgtgagtacactgtaatttactgctaccttgcatttgttttatcttcctctacaaaatgctgaactcaggcctgcatctgtgttgcgctcgagctctgtacttggttttatcgtcctcttcaatcaaaggaagaaacaggaagaaaatagtataagtgaggatctatctgtgtaaacttttaactaaacgtagctcactcctgcaacttcagtttttttatttaaattctcagtttt

SEQ ID NO: 932 - DNA, 1476 bp, Solanum tuberosum
gtcaatttcatatttattcccatcaaaaacttggactacaaagtcacggtggagaccgccggaaaagctgaaagctcgattcatcggtcaccggaactcaaccgacgacgacgacgacaactaggaggaggaggaggagccaaatttgctgagtttgtttatattactacaaataacatgggtgattactccaaggacgatttccttcagctcatcaagcgattcggcgcttttttgaccgtgaagatttctaatctcttccacacactggattcaagatctgtgggggccatagcaggtcttgcagttgctatagtttttacctggagagtgtggagatcacctagtgaaccacaaaggaggattcctaagcgacaaggtgcgacgcctagtagttctggtgtaagcactcattcaagtgcaaatgtggaaacttcaggagttacctcttcttcggaggattcaaatgctcaaaatgttattgatgagttctttcagccagtaaagccaacacttgcacaggtagttaggcaaaggctgagtgaagggaggaaggtgacatgtaggttgcttggagtgatccttgaggaaactagcccagaggagcttcagcaacaagcaaccgtgcgatcctctgtactcgaaatattgctcgaaatcaccaaattttgtgacctttatctcatggaaagagttcttgatgatgaaagtgaaaaaaaggtcctcctagctttagagaatgctggagtttttacatctggaggcctggtcaaagacaaggttctcttttgcagcactgagattggacgcacatcctttgttcgacaactagaacctgattggcacatagatacaaatccagaaatcacttttcagctagcgagattcatcaaatatcagttacacgtttcgcctaacaagccagaaagaacagcaatcaatgtcttcaactcaacaacattggagcagttctttggaaatgtttagatgtaatcaacaagagctatagcaaatttcgttactttaggtgttttcgtcttctttttttctctcttttttgttgttgttctccctttcctctcctctctactctactcaacacgtgaaaatcctcatatgttttgactcttcattttttatggcttttcttggtacctgctgcttaatagtgtgagattaagggggactaataggagagcactggtattgtggaaacaaatccatctatgttgctgtgtatcgatatcacctctctttttacaaacatagatgtgagtaccactgtaatatactggtaccttgcatttattttatttctcatctaccaaaaaaaaaggagaagaaggccaacaaactaagtgtccaaattggacatctgagtagttcggaacgagagcgtgcctagctcgctgtgacgctagcaagtggagtcgccgcactgggcacgttcgaactctgttgtggtcttatctggca

SEQ ID NO: 933 - DNA, 1484 bp, Solanum tuberosum
ccctatttgtcaatttcatatttattcccatcaaaaacttggactacaaagtcacggtggagaccgccggaaaagctgaaagctcgattcatcggtcaccggaactcaaccgacgacgacgacgacaactaggaggaggaggaggagccaaatttgctgagtttgtttatattactacaaataacatgggtgattactccaaggacgatttccttcagctcatcaagcgattcggcgcttttttgaccgtgaagatttctaatctcttccacacactggattcaagatctgtgggggccatagcaggtcttgcagttgctatagtttttacctggagagtgtggagatcacctagtgaaccacaaaggaggattcctaagcgacaaggtgcgacgcctagtagttctggtgtaagcactcattcaagtgcaaatgtggaaacttcaggagttacctcttcttcggaggattcaaatgctcaaaatgttattgatgagttctttcagccagtaaagccaacacttgcacaggtagttaggcaaaggctgagtgaagggaggaaggtgacatgtaggttgcttggagtgatccttgaggaaactagcccagaggagcttcagcaacaagcaaccgtgcgatcctctgtactcgaaatattgctcgaaatcaccaaattttgtgacctttatctcatggaaagagttcttgatgatgaaagtgaaaaaaaggtcctcctagctttagagaatgctggagtttttacatctggaggcctggtcaaagacaaggttctcttttgcagcactgagattggacgcacatcctttgttcgacaactagaacctgattggcacatagatacaaatccagaaatcacttttcagctagcgagattcatcaaatatcagttacacgtttcgcctaacaagccagaaagaacagcaatcaatgtcttcaactcaacaacattggagcagttctttggaaatgtttagatgtaatcaacaagagctatagcaaatttcgttactttaggtgttttcgtcttctttttttctctcttttttgttgttgttctccctttcctctcctctctactctactcaacacgtgaaaatcctcatatgttttgactcttcattttttatggcttttcttggtacctgctgcttaatagtgtgagattaagggggactaataggagagcactggtattgtggaaacaaatccatctatgttgctgtgtatcgatatcacctctctttttacaaacatagatgtgagtaccactgtaatatactggtaccttgcatttattttatttctcatctaccaaaaaaaaaggagaagaaggccaacaaactaagtgtccaaattggacatctgagtagttcggaacgagagcgtgcctagctcgctgtgacgctagcaagtggagtcgccgcactgggcacgttcgaactctgttgtggtcttatctggca

SEQ ID NO: 934 - DNA, 1591 bp, Solanum phureja
caaaaatcaccttctcctcgaaggctgcgtttcgctgtccctatttgtcaatttcatatttattcccatcaaaaacttggactacaaagtcacggtggagaccgccggaaaagctgaaagctcgattcatcggtcaccggaactcaaccgacgacgacgacgacaactaggaggaggaggaggagccaaatttgctgagtttgtttatattactacaaataacatgggtgattactccaaggacgatttccttcagctcatcaagcgattcggcgcttttttgaccgtgaagatttctaatctcttccacacactggattcaagatctgtgggggccatagcaggtcttgcagttgctatagtttttacctggagagtgtggagatcacctagtgaaccacaaaggaggattcctaagcgacaaggtgcgacgcctagtagttctggtgtaagcactcattcaagtgcaaatgtggaaacttcaggagttacctcttcttcggaggattcaaatgctcaaaatgttattgatgagttctttcagccagtaaagccaacacttgcacaggtagttaggcaaaggctgagtgaagggaggaaggtgacatgtaggttgcttggagtgatccttgaggaaactagcccagaggagcttcagcaacaagcaaccgtgcgatcctctgtactcgaaatattgctcgaaatcaccaaattttgtgacctttatctcatggaaagagttcttgatgatgaaagtgaaaaaaaggtcctcctagctttagagaatgctggagtttttacatctggaggcctggtcaaagacaaggttctcttttgcagcactgagattggacgcacatcctttgttcgacaactagaacctgattggcacatagatacaaatccagaaatcacttttcagctagcgagattcatcaaatatcagttacacgtttcgcctaccaagccagaaagaacagcaatcaatgtcttcaactcaacaacattggagcagttctttggaaatgtttagatgtaatcaacaagagctatagcaaatttcgttactctaggtgttttcgtcttctttttttctctcttttttgttgttgttctccctttcctctcctctctactctactcaacacgtgaaaatcctcatatgtttagactcttcattttttatggcttttctttgtacctgctgcttaatagtgtgagattaagggggactaataggagagcactggtattgtggaaacaaatccatctatgttactgtgtatcgatatcacctctctttttacaaacatagatgtgagtaccactgtaatatactgctaccttgcatttattttattttcatctacaaaatcctgatctcaggcctgcaactgcgttgcgctcgagttctgtatttggttttatcatcctcttcaatcaaaggaagaaacaggaagagagtagtataatttatctatgtgagcttttagctaaccgtagctccactcctacaacttcaatgtttttctttaaattctcagttttaaataatgattccattagatattttagttccattcgtttaaag

SEQ ID NO: 935 - DNA, 1195 bp, Nicotiana tabacum
  misc_feature (149)..(149): n is a, c, g, or t
  misc_feature (151)..(151): n is a, c, g, or t
  misc_feature (199)..(199): n is a, c, g, or t
  misc_feature (318)..(318): n is a, c, g, or t
  misc_feature (333)..(333): n is a, c, g, or t
  misc_feature (335)..(335): n is a, c, g, or t
  misc_feature (401)..(401): n is a, c, g, or t
  misc_feature (413)..(413): n is a, c, g, or t
  misc_feature (437)..(437): n is a, c, g, or t
  misc_feature (457)..(457): n is a, c, g, or t
  misc_feature (468)..(468): n is a, c, g, or t
  misc_feature (613)..(613): n is a, c, g, or t
  misc_feature (622)..(622): n is a, c, g, or t
  misc_feature (650)..(650): n is a, c, g, or t
gctttcgatcataacttggactacaaagtcacggttttagaccaccggaaaagctgaaagcttgattcatttatcatcggaaagctcaacccgacgacgacgaggaaccaaatttgctgaattgatatagtaataattactagtacaananaacatggctgataaagacgatttccttcagctcatcaagcgattcggngctttcttgaccgtcaagatttctaatctcctccactctctggattcaagatccgtaggggctatagcaggtcttgcatttgcagtagttttcacctggagactgtggagatcacctantggaccacaaaggangnttccaaagcgacaagctgctacgtctagtagttctggtgtaagaaatcattcaagtgcaaatgtancaacttcagganttaccccttcttctgaggattcanatgctcaaaatgttattgangagttctttcngccagtaaagccaacacttgggcagatagttaggcaaaggttgagtgaagggaggaaggtgacatgtaggttgcttggagtgatcttggaggaaactaacccagaggagcttcagcaacaagctactgtacgatcctctgtgctngaagtgttnctcgaaatcaccaaattttgtgaccttnatctcatggaaagagttcttgatgatgaaagtgaaagaaaggtcctcctggctttagagaatgctggagtatttacatctggcggcctggtcaaagacaaggttctattttgtagcactgagattggacgcacatcctttgttcgacaactagaacctgattggcacatagatacaaatccggaaatcacttttcagctagcgagattcatcaaatatcagttacacgtttcagctaccaagccagaaagaacagcaatcaatgtcttcaactcaacatcattggagcagttctttggaagtgtttagatgcaaccaacaagagctctagcaaatttcgtttattttagttttttttcttttttcttttccttttcttctcctcttaactctcttcggcatgtgagaaatttccatatgtttgatttctcattttaattgcttttcttggtacctacagcttcatagtttgaggttaaagggcactatttgtaacactggtattgtctgaaccaaatccatcaatttgctgtgagcggccgcatg

SEQ ID NO: 936 - DNA, 836 bp, Solanum tuberosum
cggggaatctaaaagagaccaaaaacctctcacttctttgaaactttgcaaacaaaatgaccacaaaagagatggaagtagtgaagaatttggatgttgaaaaatatatggggagatggtatgaaattgcctcatttccatcaagaaatcaaccaaaagatggtgtaaacacaagagccacttacactttaaaccaagatgggacagtacatgtgctaaatgaaacatggagtggtggaaaaagaggttcaattgaagggacagcttataaagttgatccaaaaagtgatgaagcaaaacttaaagtgaaattttacatcccacctttcttgccaattattccaattgttggagattattgggttttatatattgatgatgattatcaatatgctttgattggtcaacctagtaagaaatatctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacactaaaggaatttggtggatcaaatcaatcttgggaaaatagtcatcttgaatgtagttttttaaaaccaataactaaataaattttacaatataaattatgaaaagttgtcttgtaaagaagagtcttattgttgtttctatttcaaaatgttttttaaggttgtaattttcttttaggtgtgtatgtgtaatagtgtgttgttgtaacttgtaagagagtttgctgttaatttttacaatataaattatgaaatgttgaata

SEQ ID NO: 937 - DNA, 822 bp, Solanum tuberosum
aaagaaaccaaaaaaccctcgcttctttgaaactttgcaaaaaaaatgaccacaaaagagatggaagtagtgaagaatttggatgttgaaaaatacatggggagatggtatgaaattgcctcatttccatcaagaaatcaaccaaaagatggtgtaaacacaagagccacttacactttaaaccaagatgggacagtacatgtgttaaatgaaacatggagtggtggaaaaagaggttcaattgaagggacagcttataaagttgatccaaaaagtgatgaagcaaaacttaaagtgaaattttatatcccacctttcttgccaattattccaattgttggagattattgggttttatatattgatgatgattatcaatatgctttgattggtcaacctagtaagaaatatctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacactaaaggaatttggtggatcaaatcaatcttgggaaaatagtcatcttgaatgtagttttttaaaaccaataactaaataaattttacaatataaattatgaaaagttgtcttgtaaagaagagtttattgttgtttatatttcaaatgttttttaaggttgtaattttcttttaggtgtgtatgtgtaatagtgtgttgttgtaacttgtaagagagtttgctgttaattttacaatataaattatgaaatgttgaata

SEQ ID NO: 938 - DNA, 825 bp, Solanum tuberosum
cttctttgaaactttgcgaaaacaaatgaccaccaaagagatggaattagtgaagaatttggatgttgaaaaatacatgggaagatggtatgaaattgcctcatttccatcaagaaatcaaccaaaagatggtgtaaacacaagagccacttacactttaaaccaagatgggacagtacatgtgttgaatgaaacatggagtggtggaaaaagaggttcaattgaagggacagcttataaagttgatccaaaaagtgatgaagcaaaacttaaagtgaaattttatatcccacctttcttgccaattattccaattgttggagattattgggttttatatattgatgatgattatcaatatgctttgattggtcaacctagtaagaaatatctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacactaaaggaatttggtggatcaaatcaatcttgggaaaatagtcatcttgaatgtagttttttgaaaccaataactaaataaattttacaatataaattatgaaaagttgtcttgtgaagaagagtttattgttgtttatatttcaaatgttttttaaggttgtaattttcttttaggtgtgtccttgtagtgttggtagtatagtatgtgtaatagtgtgttgttgtaacttgtaagagagtttgctgttaattttacagtataaattatgaaatgttgaata

SEQ ID NO: 939 - DNA, 802 bp, Solanum tuberosum
caaaaacctctcacttctttgaaactttgcaaaagagatggaagtagtgaagaacttggatgttgaaaaatacatgggaagatggtatgaaattgcctcatttccatcaagaaatcaaccaaaagatggtgtaaacacaagagccacttacactttaaaccaagatgggacagtacatgtgttaaatgaaacatggagtggtggaaaaagaggttcaattgaagggacagcttataaagttgatccaaaaagtgatgaagcaaaacttaaagtgaaattttatatcccacctttcttgccaattattccaattgttggagattattgggttttatatattgatgatgattatcaatatgctttgattggtcaacctagtaagaaatatctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacgacactaaaggaatttggtggatcaaatcaatcttgggaaaatagtcatcttgaatgtagttttttaaaaccaataactaaataaattttacaatataaattatgaaaagttgtcttgtaaagaagagtttattgttgtttatatttcaaatgttttttaaggttgtaattttcttttaggtgtgtatgtgtaatagtgtgttgttgtaacttgtaagagagtttgctgttaattttacaatataaattatgaaatgttgaata

SEQ ID NO: 940 - DNA, 855 bp, Solanum phureja
atcaagaaaccaatctaaaagagaccaaaaacctctcacttctttgaaactttgcaaaagagatggaagtagtgaagaacttggatgttgaaaaatacatgggaagatggtatgaaattgcctcatttccatcaagaaatcaaccaaaagatggtgtaaacacaagagccacttacactttaaaccaagatgggacagtacatgtgttaaatgaaacatggagtggtggaaaaagaggttcaattgaagggacagcttataaagttgatccaaaaagtgatgaagcaaaacttaaagtgaaattttatatcccacctttcttgccaattattccaattgttggagattattgggttttatatattgatgatgattatcaatatgctttgattggtcaacctagtaagaaatgtctttggatattatgtaggcaaccacatcttgatgaagaaatatacaaccaacttgttgagaaggcaaaagaagtaggatatgatgtgagcaaacttcacaagacacctcaagctgatcctccaccagatggtgaagatgccccaaaggacactaaaggaatttggtggatcaaatcaatcttgggaaaatagtcatcttgaatgtagttttttaaaaccaataactaaataaattttacaatataaattatgaaaagttgtcttgtaaagaagagtttatatttcaaatgttttttaaggttgtaattttcttttaggtgtgtatgtgtaatagtgtgttgttgtaacttgtaagagagtttgctgttaattttacaatataaattatgaaatgttgaatatataatttgtttctttcaaataaagtttcttgaatttatat

SEQ ID NO: 941 - DNA, 866 bp, Capsicum annuum
gcacgaggaagcaacaaaaaaacccttattacaaaaaccattttctcccaacactctcaaaaataaactctttcttgaaattttgcaaaaaaaaatgaccacaaaagagatggaagtagtgagaaacttagatgttgaaaggtacatggggagatggtatgaaattgcctcatttccctcaagatttcagcccaaagatggagtggacacaagggctacttactctttgaatccagatgggacaatacatgtgttaaatgagacatggagtggtggtaaaagaggttcaattgaaggcactgcttataaagctgatccaaaaagtgatgaagctaaactcaaagtgaaattttatttacctcctttcttgccaattattccaattactggtgattattgggttctttatattgatcatgattatcaatatgctttgattggtcaacctagtaagaagtatctttggatattatgtaggcaaccacatcttgatgagggaatatacaaccaacttgttgagaaggctaaagaagtagggtatgatgtgagcaaacttcacaagacacctcaagctgatccaccaccagagagtgaagatgcaccaaaggacacaaaaggaatttggtggctcaaatcaatctttggaaaataatcatattagtaaatatgatttaaaaaaaaataaatcaagatttacaataaaaattatgaaaagttgtcttgtataaaaaggtttgttttgaagtttaaatggttttaaggttgtaattttcttaggcatctttgtaaaagttggtagtagtgtgtattgtaagaaagtttgttatcaattttgcataagaatttgggagtatgagaaatttgga

SEQ ID NO: 942 - DNA, 764 bp, Solanum melongena
ctcaaaaccacagttttggcaagaaaaaagatgacaacaaaagagatggaagttgtaagaaacttagatgttgaaagatacatgggaagatggtatgaaatagcctcatttccatcaagaaatcaaccaaaagatggtgtaaacacaagagccacttatagtttaaaccctgatgggacagttcatgtgttgaatgaaacatggagtggtggcaaaagaggttctattgaagggactgcttataaagttgatccaaaaagtgatgaagcaaaacttaaagtgaaattttatgttccacctttcttgccaatcattccaattactggggattattgggttttgtatattgatgctgactatcaatatgctctcattggtcagcctagtaagaattatctctggattttatgtaggcagacccatcttgatgatgaaatatacaacatgcttgttaacaaagcaaaagaagttggatatgatgtgagcaaacttcataagacaccacaagctgatcctcctccagaaagtgaaggcccagaggacaaaaaaggaatttggtggatcaaatcaatatttggaaaataaataatatttaataaagttttttttaaaaataaataaatataataaataaagaaaagttgttttaaatttcaaatgttgtaattttcttaggtgtgttcttgtagagatggtaatatgtaggtaatattgtggtgttgtaagagtaattttgtacatgaattatgagtatgaaatgttcg

SEQ ID NO: 943 - DNA, 869 bp, Nicotiana tabacum
  misc_feature (79)..(79): n is a, c, g, or t
  misc_feature (98)..(98): n is a, c, g, or t
cattacggccggggatcaaaaacccaatccaaaaccccttatataaaaattactaaaaccccttctccaaccttcaaanatcttgagaaaaaaaaaanattttcttgaaatctgaaaatattttcttgaaaaatgtccacaaaagaaatggaagtagtgaggaatttggatgttgaaagatacatgggaagatggtatgaaatagctagttttccatcaagaaatcagcctaaaaatggtgtaaacacaagagccacttactctttaaatccagatggtacagttcatgtgttaaatgaaacttggagtgatggaaaaagaggttcaattgaagggactgcatataaagctgatcctaaaagtgatgaagctaagcttaaagtgaagttttatattcctccatttttgccaattattcctattgttggtgattattgggttctttatattgataatgattatcaatatgctttgattggtcagcctagtaggaattatctttggatattatgtaggaaaacacatcttgacgaagagatatacaacatgctgattgagaaggctaaagaagtaggctatgatgtgagtaaacttcacaagacacctcagtctgatcctccaccagagggtgacgatagcccacaggacaccaaaggaatttggtggcttaaatcaatctttggaaaataaacatgcagtaaatatatatatggttaaaaaaaaaaaacaagaggacaaaaactgtggtgttgttgtaagagagtttttgctgttaattccatatgttttaaggttgtatttatttcctaaaatgtctttttattttctggaactttgtaaagttgatagtaagtagtgtcaagtatgtg

SEQ ID NO: 944 - DNA, 934 bp, Nicotiana tabacum
ggccattacggccggggatcaagaagtcgatccaaaaccccttacaaaatttttacaaaactcccttttctccaacctcaaaaatcttgaaaaaagaagaagagagagttactttcttgaaacttggaaaaaatgaccacaaaagaaatggaagtagtgaggaatttggatgttgaaagatacatgggaagatggtatgaaatagcttgtttcccatcaagaaatcagcccaaaaatggtgtagacacaagagccacttacactttaaatccagatggtacagtacatgtgttaaatgaaacttggagtaatggcaaaagaggttcaattgaagggactgcttataaagctgatcctaaaagtgatgaagctaagcttaaagtgaagttttatgttcctccatttttgccaattattcctattactggggattattgggttctttatattgataatgattatcaatatgctttgattggtcagcctagtaggaattatctttggatattatgtaggagaaatcatcttgatgaagagatatacaacatgctgattgagaaggctaaagaagttggttatgatgtgagtaaacttcacaagacacctcagtctgatcctccaccagagagtgaaaatgctccacaggacagcaaaggaatttggtggatcaaatcaatctttggaagataataagcagtaaatatatatatggttaaaaaaatctacagataaaaaaaaggggggtggtgttgtaagagagttttgctgttaattccatatgttttaaggttgtatttcctaagatgtcttttttttttttctggaattttgtaaagttgatagtaagtagtgtcaagtgtgtggtgattgtaaaatagagttttttgtcaattttgcatttgaattttatgtatgaaaatgttgttgctttctt

SEQ ID NO: 945 - DNA, 947 bp, Solanum lycopersicum
ctcttgtatatatatatatactctctaaaaacccaaaatcctacaatcaatgaaaattctccctatttaaagattccatttttatcaaaaaatctcccaaatcttgaaaaccccatttgtttaaacttcaaaataatggctacaaaagtaatggaagtggtgaaaaatcttgatttaaagaggtatatgggtagatggtatgaaattgcttcatttccatcaagatttcagcctaaagatggagtggacacaagggctacttatacattgaactcagatggcactgtacatgtgctgaatgagacatggtgtaatggcaaaagagggtttattgaaggaactgcttataaggctgaccctaatagtgatgaggcaaaattgaaagtcaggttttatgttccaccatttttgcctataattcctgttactggtgattattgggttttgtatattgatgaggattatcagtatgctttgattggtcagcctagtaggaggtatttatggatattaagtaggcaaacacgtcttgacgatgagatttacaaccagcttgttgagaaggctaaagaagaaggctacgacgtgagtaagctccacaagacgccacaatctgattccccaccagatagtgaagatagccccaaagacaccaaaggaatttggtggatcaaatcaatccttggaaaataggcaaaaacagtacaatggccaaaaaaggaaaactatccaaagaggtgttttgaaacagtatttaaagcttatgtttttacaagtgttttttactatgaaactatgtaaagttgatagtattgaaagtgtgtggtttgtatttgaatcttctgtgaaatgttgtgaacaagttttgatagttcccctttttatgtccctgtgtccccctccggctacatgagggcgaaaaaagggaaggaaagtatggttttttt

SEQ ID NO: 946 - DNA, 947 bp, Solanum lycopersicum
ctcttgtatatatatatatactctctaaaaacccaaaatcctacaatcaatggaaattctccctatttaaagattccatttttatcaaaaaatctcccaaatcttgaaaaccccatttgtttaaacttcaaaataatggctacaaaagtaatggaagtggtgaaaaatcttgatttaaagaggtatatgggtagatggtatgaaattgcttcatttccatcaagatttcagcctaaagatggagtggacacaagggctacttatacattgaactcagatggcactgtacatgtgctgaatgagacatggtgtaatggcaaaagagggtttattgaaggaactgcttataaggctgaccctaatagtgatgaggcaaaattgaaagtcaggttttatgttccaccatttttgcctataattcctgttactggtgattattgggttttgtatattgatgaggattatcagtatgctttgattggtcagcctagtaggaggtatttatggatattaagtaggcaaacacgtcttgacgatgagatttacaaccagcttgttgagaaggctaaagaagaaggctacgacgtgagtaagctccacaagacgccacaatctgattccccaccagatagtgaagatagccccaaagacaccaaaggaatttggtggatcaaatcaatccttggaaaataggcaaaaacagtacaatggccaaaaaaggaaaactatccaaagaggtgttttgaaacagtatttaaagcttatgtttttacaagtgttttttactatgaaactatgtaaagttgctagtattgaaagtgtgtggtttgtatttgaatctcctgtgaaatgttgtgaacaagttttgatagttcccctttttatgtccctgtgtccccctccggctacatgagggcgaaaaaagggaaggaaagtatggttttttt

SEQ ID NO: 947 - DNA, 738 bp, Carica papaya
ccaaatctcttttcctctcggtgactgtaacccctgtgcaaatcaaaattaagtcaggaattaacatggcgaagaaggaaatggaggtggtgaaggggttagatatcaaaagatacatgggacggtggtacgaaatagcttcgtttccgtcgaggtttcagcccaaagatggagtcaataccagagctacatacaccttgaacgacgatggaacggtgcatgttttgaacgagacatggagtggcggcaagagagggtatatagaagggactgcgtataaggctgatcctaacagcgatgaagccaagcttaaagttaggttttatattccgcctttcttgccgatcattcctgttactggagattattgggtgttgtatattgatgatgattatcggtacgctctgattggccagcccgcgagaaagtatctctggatattgtgcagggagacgcatatggatgaggagatatataatcagctggtgcagagggcgacagatgagggatatgatgtgagcaaacttcacaagacaccacagagtgatccgccaccggagggagatgaagggccgaaggacactaagggtatttggtggattaaatcgatttttggtaaataaaaaccagtgctcatgatttttggtatatatatatatatatatatagttggtattgtattatgttttctgtatatttgaatgtgtgatcatcaacagaaaggcttatgggtctttc

SEQ ID NO: 948 - DNA, 977 bp, Triphysaria pusilla
  misc_feature (820)..(820): n is a, c, g, or t
aaataccgccattacggacggagatccaaaacccgaaaaccaaaaaacacagaaaaaaatccctttttgaaattttcaatcttttgcaagaaaaatggcgaccaaagaaatggaagtggtgaagggtttgaacatagagaaatacatgggtagatggtacgaaatagcttcatttccttcacgatttcagcccaagaatggtgcagatacaagggctacatatactctaaaccctgatggtactgtccatgttttgaacgagacttggtctaatgggaaaaggggttttattgaggggtctgcttataaagccgatccgaagagcgatgaggcgaagcttaaagtgaaattttatgtgccaccttttttgcctataattccagtgactggggattattgggttttgtatattgatgaagattatcagcatgctttgattggccaaccatcaaggagttatctttggattctgagcaggcagcctaagcttgatgaagagatatacaatcaatttgtggagaaggctaaagaagttggatatgatgttagcaagctgcacaaaacacctcaatccgagactgcaccggatagtgaggattcggagaaggacacgaaagggatatggtggattaagtccattttcgggaaatagatggaatatcaagtctagatatgaaaagggcatcataagcactctagtttgaataaaatttggtttgctcttaaactatgtgtaatactgtaattagcgatattaagtttgttttctctgttgaagatttgtgtgttttaatatattttgcgtttcagtttttttttntctcaaagtttatactatcaatatgagccaaaatgctgcaatcttgtttgggtcttagaaaaatgtggagtgttttgaagaggtttgtgatttaggtgaaatacgaggttattctagtttgtttttataaaaaaaaatagataaaaccttacatcta

SEQ ID NO: 949 - DNA, 780 bp, Antirrhinum majus
  misc_feature (718)..(718): n is a, c, g, or t
atcacaaggagcatacaaaacgtactcttaaacccacgatcccaaatcttgaaaagtttctgatctttaacaatggcgaataaagagatggaagtggtgaagaatttggacatatcgaggtacatgggaaggtggtatgaaatagcctcattcccatcaagatttcagcctaaaaatggtgtggacactagggctacatacactctcaaccctgatgggaccactgttcatgttctgaacgagacttggagtgatgggaagaggggttacattgagggctctgcttataaagctgatccaaacagtgatgaggccaaattgaaggtcaagttctatgttccgcctttcttgcctataatcccagtggttggggactattgggtgctctacattgatgaagattatcagcatgctctgattggccagcccagcaggaggtatctctggattctaagcaggcaggctcatcttgatgatgagatatacaaccagcttgtagagaaggctaaaggagaggggtacgatgtgagcaagctgcataaaacaccgcagtctgaaactccgccggacagtgaggatgctcccaaggacacaaaaggcatttggtggattaaatccatcttcggaagataggaaagcaccatcaccgctatcactatccaaacgtttttagaaataaatggcattccccagtttggaaaattacttctgtttctgnatatctaaattatgtatattaggatgttgagtgttgttgcttttatggatcaataaaacatt

SEQ ID NO: 950 - DNA, 1118 bp, Theobroma cacao
  misc_feature (961)..(961): n is a, c, g, or t
  misc_feature (1071)..(1071): n is a, c, g, or t
cggggacccaaacctgtttcctcttcccatagatgggacggcctagaagcttccatgtggatctggtggttaaaaccagacataagcacacatgtagggcccttagtcctccacgtctcacttgagaatctccattgcaccaaacgttttttcctatattaccttatcaagaatcaacaaaaagcagattacgaaccgtcttgaaccccaaccaaaatctctcctctctcgcgatctaaaacaggaacccggaacaatgtcccagaaaccaatggaagtggtaaagcatttggacatcaacagatacatgggaaggtggtacgagatcgcctcattcccgtcgaggtttcagcctaggggtggggtgaatacgagggctacctacactctgagagaagatggaactgtccatgtgcttaatgagactttcactgatggcaaaagagggtatatagaaggcactgcctacaaggctgatcccaagagtgatgaggcaaagctgaaagtcaaattctatgttcccccattcttgcccatcattcctgttgttggggattactgggttttgttcattgatgatgattatcagtatgctctcattggtcagcctagcaggaagtatctctggattttatgcaggcagccacatatggatgatgaaatctacaatcagctggtgcagaaggccaaagatgagggctatgatgtgagcacactgcacaagaccccacaaagtgatcctccaccagaaggagaggagacccccaaggacaccaaaggaatatggtggatcaaatccatttttggaaagtaggactcagtatgaatatgacaaccttatggtttagtataaatatgcaaataaaatattgggtcaaaacccagtttgaagcatagggcctgcagtcgattcctatctttttctttgttacatgtaaacaatagggtctgtgaactcatnttatagctgtatgcaagtttggtttggtgtgtagggtgaagcatgatggggaggattgtaagacttggacactacagttaaattaattttgtttgttggaatccaatgangaacagctgaatatctgggtgcagtcttgaaactctccccttttcca

SEQ ID NO: 951 - DNA, 934 bp, Solanum tuberosum
ctctctatataaagattccatttttatcaaaaatctcccaaatcttgaaaaccccatttgttaaaacttcaaaaaaaatggctacaaaagtaatggaagtggtaaagaatcttgatttaaagaggtatatgggtagatggtatgaaattgcttcattcccatcaagatttcagcctaaagatggagtggacacaagggctacttatacattgaactcagatggcactgtacatgtgctgaatgagacatggtgtaatggcaaaagagggtttattgaaggaactgcttataaggctgatcctaatagtgatgaggcaaaattgaaagtcaggttttatgttccaccatttttgcctattattcctgtaactggtgattattgggttttgtatattgatgaggattatcagtatgctttgattggtcagcctagcaggaggtatttatggatattaagtaggcgaacatgtcttgatgatgagatttacaaccagcttgttgagaaggctaaagaagaaggctacgacgtgagtaagctccacaagacaccacaatctgattccccaccagagagtgaagatagtcccgaagacaccaaaggaatttggtggatcaaatcaatccttggaaaataggcaaaaacagtacaatggccaaaaaataaaactatccaaagacctattgaaatgaggtgtttataacagtctttagtgtgttaaatcctacgtgtttaaagcttatgtttttacaagtctttttcctatgaaactatgtaaagttgatagtattggaagtgtgtggtttgtacgtgtttggtagaattcagcaatttgagtcgacttgaaatttatcgtactgaattttatcaaaccaatgaacatattttgtcaaaatatactacatgaaaatttatcaaatcgaagtttgatttact

SEQ ID NO: 952 - DNA, 907 bp, Solanum tuberosum
atcaaaaatctcccaaatcttgaaaaccccatttgttaaaacttcaaaaaaatggctacaaaagtaatggaagtggtaaagaatcttgatttaaagaggtatatgggtagatggtatgaaattgcttcattcccatcaagatttcagcctaaagatggagtggacacaagggctacttatacattgaactcagatggcactgtacatgtgctgaatgagacatggtgtaatggcaaaagagggtttattgaaggaactgcttataaggctgatcctaatagtgatgaggcaaaattgaaagtcaggttttatgttccaccatttttgcctattattcctgtaactggtgattattgggttttgtatattgatgaggattatcagtatgctttgattggtcagcctagcaggaggtatttatggatattaagtaggcgaacatgtcttgatgatgagatttacaaccagcttgttgagaaggctaaagaagaaggctacgacgtgagtaagctccacaagacaccacaatctgattccccaccagagagtgaagatagtcccgaagacaccaaaggaatttggtggatcaaatcaatccttggaaaataggcaaaaacagtacaatggccaaaaaataaaactatccaaagacctatgaaatgaggtgtttataacagtctttagtgtgttaaatcctacgtgtttaaagcttatgtttttacaagtctttttcctatgaaactatgtaaagttgatagtattggaagtgtgtggtttgtacgtgtttggtagaattcagcaatttgagtcgacttgaaatttatcgtactgaattttatcaaaccaatgaacatattttgtcaaaatatactacatgaaaatttatcaaatcgaagtttgatttact

SEQ ID NO: 953 - DNA, 926 bp, Triphysaria pusilla
gaaattttcaatcttttgcaagaaaaatggcgaccaaagaaatggaagtggtgaagggtttgaacatagagaaatacatgggtagatggtacgaaatagcttcatttccttcacgatttcagcccaagaatggtgctgatacaagggctacatatactctaaaccctgatggtactgttcacgttttgaacgagacttggtctaatgggaaaaggggttttattgaggggtctgcttataaggccgatccgaagagcgatgaggcgaagcttaaagtgaaattttatgtgccaccttttctgcctataattccagtgactggggattattgggttttgtatattgatgaagattatcagcatgctttgattggccaaccatcaaggagttatctttggattctgagcaggcagcctaagcttgatgatgagatatacaatcaatttgtggagaaggctaaagaagttggatatgatgttagcaagctgcacaaaacacctcaatccgagactgcaccggatagtgaggattcggagaaggacacgaaagggatatggtggattaagtccattttcgggaaatagagggaataccaagtctagatatgaaaagggcatcataagcactctagtttgaataaaatttggtttgctcttaaactatgtgtaatactgtaattagcgatattaagtttgttttctctgttgaagatttgtgtgttttaatatattttgcgtttcagtttttttttatctcaaagtttatactatcaatatgagccaaaatgctgcaatcttgtttgggtcttagaaaaatgtggagtgttttgaagaggtttgtgatttaggtgaaatacgaggttattctagtttgtttttataaaaaaaaatagataaaaccttacatctaaaaaaaaaaaaaaaaaa

SEQ ID NO: 954 - DNA, 905 bp, Ricinus communis
caaatatcacattgtataaaaaccctttcttttttctcttctctctccctaatccctatatattagccttatccctggtatcggttcaacaaacccacaagttttaataggttagagaaatctacaaacagaacccaagttttttttttccaagattttactcgctataaaaagatggctgctgccaagaatgagatggaagtggtgaaagggctagacataaagaggtacatgggaagatggtatgagatagcttcattcccatcaagatttcaacccaagaatggagtgaacacaagggccacgtacactttgaatgaagatggtaccgtgcatgtgttgaatgagacatggagtgatggcaaaagagggtatattgaaggtactgcttataaggctaatcctaaaagtgatgaggctaaactcaaggtcaaattttatgtcccaccattcttgcctattattcctgttgtgggagattactgggttttgtatcttgatgatgactactcctatgctttgattggccagcctagcaggaattatctttggatactttgcaggagaactcatctagatgatgagatttacaatcaattggtggagaaggctaaagaagaaggctatgatgtgagcaaactccataagacacaacaaagtgacccaccaccggaaggagaagagggtcccaaggacaccaaaggaatttggtggatcaaatccattctcggaagataggaatagttcatagagatttggagcatggtatatgattaaatagattttagtagccatcaaatatgcatttggatcagtagtttactgtgtgctagtttcctggcaattttaggttctgtaaattgtcaatctggaatcttttaataatttttatatttaatatagaa

SEQ ID NO: 955 - DNA, 760 bp, Ipomoea nil
aatcaaaatcaaagaaatgggtagcacaaaagagatggaagtagtgagaaatcttgatgtggagaggtacatggggaggtggtacgagatagcctcattcccatcaagatttcagcccaaagatggggtggacaccagggctacctacactctaaaccctgatggcacagttcatgtgttgaatgagacttggagtggtgggaagagaggttacatcgagggaactgcatacaaggctgaccctaaaagcgatgaggctaagctcaaggtcaggttttatgttccccctttcttgcccatattccctgtcactggggactactgggttttgcacattgaccctgattaccagtatgctttgattggccagccaagcaggagttatctctggatattgtgtaggcagcctcggcttgatgatgagacctacaacgagctggttgagaaggcgaaagaggtggggtacgatgtaagcaagcttcacaagacaccgcattctgagactccaccggagggggaagtcgcgagcgacaaagggatttggtggatcaagtccatctttggaaagtaggacatactacactactagctgcagcaaccaagtcttatattgaaaaaataaggagctttatgttgtaggatgtaaatgtgaactgagaagaaggatatgagggcagtgtttttttttggcatatatatgttttttatggattgattgtgtaatcttgaaaagattgtatgtatgtagtatgtgtatgtt

SEQ ID NO: 956 - DNA, 807 bp, Ipomoea nil
  misc_feature (554)..(554): n is a, c, g, or t
aattgccatatcccatatagagaaacactaaaactccaaacaaaacccttccttaaaatcaaaatcaaagaaatgggtagcacaaaagagatggaagtagtgagaaatcttgatgtggagaggtacatggggaggtggtacgagatagcctcattcccatcaagatttcagcccaaagatggggtggacaccagggctacctacactctaaaccctgatggcacagttcatgtgttgaatgagacttggagtggtgggaagagaggttacatcgagggaactgcatacaaggctgaccctaaaagcgatgaggctaagctcaaggtcaggttttatgttccccctttcttgcccatattccctgtcactggggactactgggttttgcacattgaccctgattaccagtatgctttgattggccagccaagcaggagttatctctggatattgtgtaggcagcctcggcttgatgatgagacctacaacgagctggttgagaaggcgaaagaggtggggtacgatgtaagcaagcttcacaagacaccgcattntgagactccaccggagggggaagtcgcgagcgacaaagggatttggtggatcaagtccatctttggaaagtaggacatactacactactagctgcagcaaccaagtcttatattgaaaaaataaggagctttatgttgtaggatgtaaatgtgaactgagaagaaggatatgagggcagtgtttttttttggcatatatatgttttttatggattgattgtgtaatctgaaaagattgtatgtatgtagtatg

SEQ ID NO: 957 - DNA, 740 bp, Petunia hybrida
gggacataatcagcaaccaaaaaatcctaaaaagcaaagaaacccaccccacaaaaagatctcaaacacccttttcaaccaaaccccaacaaattcttgaaaacaccattttgcaaaatggccacaaaagtaatggaagttgtaaagaatcttgatgtaaaaagtacatgggaagatggtatgaaatagcttcattcccatcaagatttcagccaagaaatggtgaaaacacaagggctacgtacactttaaacgaagatggaacagtgcatgtattgaatgagacatggacaaatggtgaaagagggtatattgaaggcactgcttataaggctgatcctaaaagtgatgaggccaaacttaaagtcaagttttatgtaccacctttcttgcctattattcctgttgttggtgattattgggttttgtccattgatgataaatatcaatatgctttgattggtcagcctagtagaagctatctttgggtattatgtaggcagacatctcttgatgaggggacttacaacgagcttgttgagaaggctaaagaagaaggctacgatgtgagtaagctccacaagacaccacagtctgatcgcccaccagaaagtgaagaggccctcaaggacgacactaaaggaatttggtggatcaaatcaatcctaggaaagtagtcaaaggcagtctaatggtaaaaacacccaaaagtaccaatgatgagtgtttataacagtgtc

SEQ ID NO: 958 - DNA, 1054 bp, Gossypium hirsutum
atccaaaatcttcttcttaacgatctaaaagcgaaaaacccaaaacaaatgtcccagaaaacaatggaagtggtgaagaatttggacatcaaaagatacatgggaaggtggtacgagatagcttcattcccatcaaggtttcagccaaggaatggggtgaatacaagggctacctatactttgaatgaagacggaacagtgcatgtgcttaacgagactttcactgatggcaaaagagggtttatagaaggcactgcgtacaaggcggatccccagagtgatgaggcaaagctgaaggtgaaattctatgttcctcctttcttgcccatcattcctatcgttggagattactgggttttgtaccttgatgatgattatcagtatgctctcattggtcagcctagcaggaattatctttgggtattgtgcaggcaaacacatatggatgatgaaatctacaatcagctggtgcagaaggctaaagatgagggctatgatgtgagtaaattgcacaagaccccacaaagcgatcctccacctgaaggagatgacactcccaaggacaccaaaggcatttggtggatcaaatcccttttaggcatgtaggaaattaagaaaatgtttgtattcatggtttcgtgggacgcatgaaaatatatattccatatcttgtctttgctttggaaagatataggtcggttttcatgctttatccatttaaaaggtcacctaattccatatcttattcaagcgtaacactttgttctggcatggatcatataatggttcagacaagcgcttagcatgaacatatttactttgcgattgcctggccctgggctgggtagaaaatgaattgattgccatttcagtctttgttagtgatactgagttgacatccatcatttgggatcttgcaagccatcctagtaaggctaacatctgcagtcagtgagcccaagacccgatcaaacaaacatctagacatcctttgaatcttggaagagtattctgttagcattttccaaatacaaccatgaagattgatatgaca

SEQ ID NO: 959 - DNA, 1543 bp, Capsicum annuum
gcacgaggctaaatacaaagaaaagaaaaaagcaatttcccaaaaatgtaagttccttaaccatccatattccttccataacataaatctcaccctcctatatatatgcacacatagctaaattcctaaaatcaatgaaaaaatattccaatcctcattttctccaaaatcttgaaaaccctcatttgttaaaaatcttcaaaaagaaatatagaaaaatattccaaacctcattttctccaaaatcttgaaaaccccatttgttaaaagatctccaaaaaaatatatatatatatacaatggcatcgaaagtgatggaggtggtaaagaatcttgatttgaagaagtacattggtagatggtatgaaatagcttcatttccatcaagatttcaaccaaaagatggtgcagacacaagagctacatacacattgaaccaagatggaactatacatgtgttgaatgagacatggtgtaatgggaaaagggattatattgaagggactgcttataaggctgatccaaaaagtgatgaggcaaaattgaaagtgaagttttatgttccaccattcttgcctgttattcctgttgttggtgattattgggttttgtatattgatgaggattatcagtatgctttgattggtcagcctagtaggaggtatctatggatattatgtagacgaccacatcttgatgacgagatttataaccagcttgttgagaagggtaaagcagaaggctacgatgtgagtaagcttcgcaagacaccacaatccgattccccgccaagtgaagatggccccaaggacgacaaaggaatatggtggatcaaatcaatccttggaaaataggcaaagaaagtacaacaacaacaacagacccagtgacgcagtccataccacaacctccggagaggtagcaaggttgtttccgttagaccccaggcaaagaaagtacaatggtataaaagaaaactatacaaagaccaatgaaatgagtgtttaaaacaatctttagtatattgaatcctaagattatgattttagtagtctttttcctttgaaactatgtgaagtttttttttttttttttggggggcgggggggttcaatccggtgtccggtgctcgcatcggagccccgactaatccggatcgcacgttacaggacccattaaggtggcagcgctcccaaaagagttttctccatatccagggtcgaaccctcgacctctggttaagggtggagcagccctattcactgcatcacagatggaaactatgtgaagttgatagtactaaaagtgtggtttgtatttgaatcttgtgtgaaatgttgaacaagttgacagttcccctttttttacgtccctatcccccctctcctccgcgacatgggggagaaaaagtggaaaggaaaacgatggggtttctcacgcttttggcattgtaggccccagcgggaggcttgcatgacgggttattaactacattttctttgacgcgaagattcttgaatacaaacaagctaggatttcacat

SEQ ID NO: 960 - DNA, 594 bp, Vaccinium corymbosum
  misc_feature (558)..(558): n is a, c, g, or t
aaagagatggaagtggtgaagggtgtagacttagagaggtacatgggtcggtggtacgaaattgcctcattcccatcaagatttcaacccaagaatggaatcaacacgagggctacgtacacattgaaggaagatgggactgtaaatgtgctgaatgagacttggaatgatgggaagcgagggtatattgaagggacagcttacaaggctgaccctaacagtgatgaggccaaactcaaggtcaaattctatgttccccctttcctacccatcatccctgttgttggcgattactgggttttgtatcttgattctgattatcagtacgctttgattggccagcccaccaggaagtatctttggatattatgcagacagaaccatcttgatgaagagatctacaatcagcttctggagaaggccaaagaagagggttatgatgtgagcaagcttcacaagacaacacaaactgatcccccaccagaggcagatgaaggccccaaggacaccaagggcatttggtggatcaaatccattctagggaaataggcagtgccnaaaccctagttggttcaagatattataatgaagcat

SEQ ID NO: 961 - DNA, 994 bp, Gossypium hirsutum
accatttatcccctgtcttgggggagttgagaattttttacatttccaaattattttatttattttggacaaggaatttgggttttgttttggttgtggtttcaaagtttggtaaagtaaaatttcgagtttattggaatgttaatttagttcctgttttgaaaaaaaaaaaaaaaaaaaacgcgagactagaaaaccccatccaaaatcttcttcttaactatctaaaagcgaaaaacccaaaacaaatgtcccagaaaacaatggaagtggtgaagaatttggacatcaaaagatacatgggaaggtggtacgagatagcttcattcccatcaaggtttcagccaaggaatggggtgaatacaagggctacctatactttgaatgaagacggaacagtgcatgtgcttaacgagactttcactgatggcaaaagagggtttatagaaggcactgcgtacaaggcggatccccagagtgatgaggcaaagctgaaggtgaaattctatgttcctcctttcttgcccatcattcccatcgttggagattactgggttttgcaccttgatgatgattatcagtatgctctcattggtcagcctagcaggaattatctttgggtattgtgcaggcaaacacatatggatgatgaaatctacaatcagctggtgcagaaggctaaagatgagggctatgatgtgagtaaattgcacaagaccccacaaagcgatcctccacctgaaggagatgacactcccaaggacaccaaaggcatttggtggatcaaatcccttttaggcatgtaggaaattaagaaaatgtttgtatttcatggtttcgtgggacgcatgaaaatatatattccatatcttgtctttgctttggaaagatataggtcggttttcatgctttatccatttaaaaggtcacctaattccatatcttattcaagcgtaacactttgttctggcatggatcatataatggttcagac

SEQ ID NO: 962 - DNA, 950 bp, Arachis hypogaea
ctcataaatcataatcataaaccgtaaacccttttgcaacaacaacaacaactacaacaaaacccctcttttattctgttctttcaatggcggagaaagagatgtctgtggtgaggaacctggatgtgaaacgttacatgggtcggtggtacgagatagcgtccttcccatcaaggttccaacctaaaaatggtgttgacacgagagccacctacactctcaacgaggatggaaccgtgcacgtgctcaatgagacttggagtgatggcaaaagaggcttcattgaaggtactgcatacaaggctgatcccaatagcgatgaagctaagctcaaggtcaagttctatgttcctccattcttgcctatcatccctgttactggtgactattgggttctcttcattgatgatgattatcagtatgctctcattggccaacccagtaggagatatctttggatattgtcaaggcagaaccgattagatgaggagatcttcaatgagcttgttcagaaagctaaggatgtggggtatgatgtgagcaaactccacaagactccacagagtgagacaccaccagagggagaagaaggccccaaagacaccaaaggcatttggtggatcaaatccattctggggagatagatatcatgtgctatatatgatgatgaggttcgagagttattccatgttataaataaaggggtcaagaagtctgaattgtagtagttatgtttggatcttggtgatgaatgtattggtttgtcctgtatatagactaagctgataggttgaagttgaaatttgatgctttgcttgtgtatgttcttattgtttttgttgaaagctttagggtatcaatgaagtaattggaacttaaaagtgcttgtatatgctgaatctgggttgtgaaatatatgttgcatagagacttatgaattcgtccatgaa

SEQ ID NO: 963 - DNA, 969 bp, Arachis hypogaea
atccaaattcaacaactttattaaataaagagaaccttatcaatctcatgaactcataatcataaaccgtgaaccctcttacaacgacaaaacccctcttctattctgttctttcaatggcggagaaagagatgtctgtggtaaggaacctggacgtgaaacgctacatgggtcggtggtacgagatagcgtccttcccatcaaggttccaacccaaaaatggtgttgacacgagagccacctacactctcaacgaggatggaaccgtgcacgtgctcaatgagacttggagtgatggcaaaagaggcttcattgaaggtactgcatacaaggctgatcccaatagcgatgaagctaagctcaaggtcaagttctatgttcctccattcttgcctatcatccctgttactggtgactattgggttctcttcattgatgatgattatcagtatgctctcattggccaacccagtaggagatatctttggatattgtcaaggcagaaccgattagatgaggagatcttcaatgagcttgttcagaaagctaaggatgtggggtatgatgtgagcaaactccacaagactccacagagtgagacaccaccagagggagaagaaggccccaaagacaccaaaggcatttggtggatcaaatccattctggggagatagatatcatgtgctatatatgatgatgaggttcgagagttattccatgttataaataaaggggtcaagaagtctgaattgtagtagttatgtttggatcttggtgatgaatgtattggtttgtcctgtatatagactaagctgataggttgaagttgaaatttgatgctttgcttgtgtatgttcttattgtttttgttgaaagctttagggtatcaatgaagtaattggaacttaaaagtgcttgtatatgctgaatcagggttgtgaaatatatgttgcatagagacttatgaat

SEQ ID NO: 964 - DNA, 926 bp, Solanum phureja
actctctagaaaccaaaatcctaaaatcaaagaaaatcctccctgtataaagattccatttttatcaaaatctcccaaattttgaaaaccccatttgttaaaacttcaaaaaaaaaatggctacaaaagtaatggaagtggtaaagaattttgatttgaagaggtatatgggtagatggtatgaaattgcttcattcccatcaagatttcagcctaaagatggagtggacacaagggctacttatacattgaactcagatggcactgtacatgtgcttaatgagacatggtgtaatggcaaaagagggtttattgaaggcactgcttataaggctgatcctaatagtgatgaggcaaaattgaaagtcaggttttatgttccaccatttttgcctattattcctgtaactggtgattattgggttttgtatattgatgaggattatcagtatgctttgattggtcaacctagcaggaggtatttatggatattaagtaggcgaacatgtcttgatgatgagatttacaaccagctttttgagaaggctaaagaagaaggctacgacgtgagtaagctccacaagacaccacaatctgattccccaccagagagtgaagatagccccgaagacaccaaaggaatttggtggatcaaatcaatccttggaaaataggcaaaaacagtacaatggccaaaaaagaaaactatccaaagaccaatgaaataagatgtttaaatcttttatgtttttacaagtctttttcctatgaaactatgtatagttgatagtattaaaattttgtggtttgtctttcaatcctctgtcaaatgttgtgaataagttttgattgttccccttttttatgtccccgtgtccccctccggctacatgaggacgaaaaaagggaaggaaagtatggtgttt

SEQ ID NO: 965 - DNA, 922 bp, Juglans hindsii x Juglans regia
ttgtgttggtcccggggatcggccttacggccggggatcaagagcaagcgcaatatcctttaactgcaaaaacacctcgggaactctctctctctctgactgtacactgcgaattgcaagcaatggcaaagaaagagatggaagtggtgaagggtctggacctaaatcggtacatggggcggtggtatgagatagcctcgttcccgtcaaggttccagcccaaaaatggtgagaacacaagggctacgtacactttgaaagatgatggaactgtgaatgtgctcaatgagacctggtctgatgggaaaagagggtacatagaaggaactgcatacaaggctgacaccaacagtgatgaggctaagctcaaagtgaagttctatgtgcctccattcctgcccatcatccctgtggtcggggactactgggtcttgtaccttgatgatgattatggatatgccttgattggccagcctagcaggaagtatctttggatattatgcaggcaaacccatatggatgaagagatatacaatcagctagttcaaagggccaaagatgagggctatgatgtgagcaaactccacaagacgccacagagtgatcctcccccagagggagaaggccctagtgacaccaaaggcatctggtggtttaaatccattttgggaaaatagctgaatggtaatggtatattggggtttcaccgttctatgtattttataaagtaaaagaccaaaaatccaaagagcagcatccagatttagggctattgtgtttattgcttattttgtagtgtttgtacagcaggaaagtgtgtgaagacagttttaatgcctagattatgaagttggggactattccttgtaaatatcattgggtcttattcaatttgaattgttgtgagagtttgatttacttt

SEQ ID NO: 966 - DNA, 959 bp, Populus trichocarpa
caaaaagatcctagaagctcccatgatcatccagcacatttcacacccaccacatgcaaggtcattagccctccacatctacacctcaaatatctcagcccaccaaacccttcctatatttgccttataaagaagtattcaaagttcaagatacataacttgtaaagcgaaaaaagcaaggcgataaaaccctctccatcaaagctttgaaacaatggctaccaaaaaagaaatggaagtggtgaaaggagtagacttgaagaggtacatgggaagatggtacgaaattgcttcatttccatcaagattccaacccaagaacggagtgaacacaagggccacttatacgctgaatgaggatggcactgtccatgtgcttaatgagacgtggaatgatggcaagagagggtacatagagggttctgcttataaggctgatcctaacagtgatgaggctaaactcaaggtcaagttttatgtcccgccattcttgcccatcattcctgttgttggagattactgggttctgtctcttgatgaggattatcagtatgctttgattggccagcctagcaggaaatatctctggatactatgcaggaagacccatatggaggatgagatctataatcagctagtggagaaggccaaagaagagggatatgacgtggagaagctccacaagactccacagactgacccaccaccggaagaagaagggcccaaggacaccaaaggcatctggtggatcaaatccattctaggaaagtaaagtagataaaaataagaaagattatcaagcagagggttaagcacatgcacaacatagagcagtactactgtgttttaatacccctttgtgcctttgtttctgtaaaggaggttcttgtttttaaatagtcggttcctgaattatatagaagaaggtgcataactttttctaaataattttgatgtgt

SEQ ID NO: 967 - DNA, 897 bp, Castanea mollissima
gcaacggcaaaaacccaacaaaatcccagaaagcaaaaaagctcaaactctctctgtgtctatcttctgcaacaactgttacacacaacacaagcaactatggccaagaaagagatggaagtggtgaagggtgtggacctaaacaggtacatgggacggtggtacgagatagcttcattcccatcaaggtttcagcccaagaatggtgcgaacacaagggctacatacactctgaaagaggatgggactgtgaatgtgctgaatgagacctggactgatgggaaaagagggtacatagagggcagtgcatacaaggctgatcccaacagtgatgaggctaagctcaaagttaaattctatgtccctccattcctgcccatcatccctgtggttggggactactgggttttgtaccttgatgatgattatcagtatgccttgattggccagcctagcaggaagtatctttggatactatgcaggcaaacccacctagatgaagagatttataatcagctagttcagaaggccatagatgagggctatgatgttagcaagctccacaagacaccacagagtgatcctccaccatcggaagaggaaggccctaaggacaccaaaggcttttggtattttaaatcccttctgggaaaatagggagaatagcatttgtttatatattgtggtttgactgtttctagtgtatgcataaataaaagatcaaaaccacccctgatttcagcatccagattagggatatatttgtgttattttttgctggctattttagtttttgtaagtcaagaatgggtaaatgttgggtgcctagcagcgtaggccctagactatgttatttttttttttactgtaaagcctagactatgaagttgaagttct

SEQ ID NO: 968 - DNA, 772 bp, Lactuca sativa
attagcactcaccgatagcagaaaaccccaaaatcatgtctaagaaagcgatggaagttgtaaagggcatagatctaaaaaggtacatgggcagatggtatgaaatagcttcattcccatcgaggtttcagcccaaagatggtatcaacacaagggctacatacacattgagagacgatggcactgttaatgttctaaacgagacttggagtggtggaaagagaggattcattgaaggaactgcttataaagctgatcccaaaagcgatgaagcgaaattgaaggtgaaattctacgtgcctccatttttgccaatcatacctgttgtgggtgattactgggtgttgtatcttgacgatgattatcagtatgctctgataggtcagccttccaggagttatctctggatactatgcagacaaacccatcttgacgatgagatatacaacaagctggttgagaaggcgacggaggaagggtatgatgtgagcaaactgaagaagacaacacagacagaaccaccgccggaatccgaagatgctccggccgacaccaaagggatttggtggtttaaatcgttatttggcaaatagaccttgaaaacaaagaacacccttaataaatgtaggtatagtgatgttgaatttggttgaagtctgaaagaatgcagtggttatgtagttgttcatattgcctatctgtgtgacagtgtgaggtacaatttctgtttagttcatatggtgatgattaatgaaaatgttattggtatttt

SEQ ID NO: 969 - DNA, 782 bp, Lactuca sativa
tcatcttcttcattagcactcaccgatagcagaaaaccccaaaatcatgtctaagaaagcgatggaagttgtaaagggcatagatctaaaaaggtacatgggcagatggtatgaaatagcttcattcccatcgaggtttcagcccaaagatggtatcaacacaagggctacatacacattgagagacgatggcactgttaatgttctaaacgagacttggagtggtggaaagagaggattcattgaaggaactgcttataaagctgatcccaaaagcgatgaagcgaaattgaaggtgaaattctacgtgcctccatttttgccaatcatacctgttgtgggtgattactgggtgttgtatcttgacgatgattatcagtatgctctgataggtcagccttccaggagttatctctggatactatgcagacaaacccatcttgacgatgagatatacaacaagctggttgagaaggcgacggaggaagggtatgatgtgagcaaactgaagaagacaacacagacagaaccaccgccggaatccgaagatgctccggccgacaccaaagggatttggtggtttaaatcgttatttggcaaatagaccttgaaaacaaagaacacccttaataaatgtaggtatagtgatgttgaatttggttgaagtctgaaagaatgcagtggttatgtagttgttcatattgcctatctgtgtgacagtgtgaggtacaatttctgtttagttcatatggtgatgattaatgaaaatgttattggtattt

SEQ ID NO: 970 - DNA, 807 bp, Lactuca sativa
atcttcttcgttagcactcaccgatagagaaaaaccccaaaatcatgtctaagaaagcgatggaagttgtaaaaggtttagatctacaaaggtacatgggcagatggtatgaaatagcttcattcccatcgaggtttcagcccaaagatgggatcaacacaagggctacatacacattgaaagacgatggcactgttaatgttctaaacgagacttggagtggtggcaagagaggattcattgaaggaactgcttataaagctgatcctaaaagcgatgaagcgaaattgaaggtgaaattctacgttccaccatttttgcccatcatacctgttacaggtgattactgggtgttgtatcttgatgatgattatcagtatgctctgataggtcagccttccaggagttatctctggatactatgcaggcaaactcatcttgacgatgagatatacaaccaacttgttcagaaggcgacggaagaagggtatgatgtgagcaaactgaagaagacaacacagacagaaccaccgccggaatctgaagatgcaccggcggacaccaaagggatttggtggtttaaatcattatttggcaaatagaccttgaaaacaagaacactcttaataaatgaacgtatattgatgttgaattcagttgaagtgtggaagaatgtagtggttatgtagttgtacatattgctttacttgtgtgtggtacaacttctttctagttcatatgggaatgattaatgaaaatgttattggtgtttgaatgtttgatcgcattttggaggttgaaattatg

SEQ ID NO: 971 - DNA, 933 bp, Elaeis guineensis
  misc_feature (652)..(652): n is a, c, g, or t
ctcttgtcaaaccccacccaataaccaacccatcgctgaaagaaactaaaatctcatggcgacgacgtcgacgaaggagatgacggtggtgaagggcctggacgtggagcggtacatggggcggtggtacgagatcgcgtcgttcccttctttcttccagcccaagaacggggagaacacgcgggccacctacacgctcaactcggacggcaccgtccacgtgctgaacgagacgtggagcgacggcaagcgcgacgccatcgaaggaaccgcctacaaagcgaacccgaacagcgacgaggccaagctcaaggtcaagttctacgtgccacccttctttcctataattccggtgaccggcgactactgggtcctctacatcgatgacgactaccagtacgcactcatcggccagccctccaggaagtacctctggattctatgcaggcagacccacatggatgacgaggtctacaacctgttgctggagaaggctaaggaagaagggtatgatgtgaagaaactccacaagacgccgcaagcagaccctcctccggaggcggaggcaggtcccaaggacaccaagggcatttggtggatcaaatccctctttggcaaataaatggataacgttctgctggaataaaaaaanaaatagtttgagaaatttctttcttttggtccgctgtaaatagccgttggttgatgctgatgtactttttagtggtgtatatcgtgtgtaggtggaaatgttagaaataatgtctgtggtcttgcacatgttcatgtctacgtttcaaagtcgtcttcacggcgatcatgtgttcactgtaattaacaagactcgacatggaagatggcgagtctgataaaaatttgatgtattaaatataaatcaaaataatgatataatactggttaccgtggtttaaa

SEQ ID NO: 972 - DNA, 942 bp, Populus trichocarpa
gccaaaaagatcctagaagctcccatgatcatccagcacatttcacacccaccacatgcaaggtcattagccctccacatctacacctcaaatatctcagcccaccaaacccttcctagatttgccttataaagaagtattcaaagttcaagatacataacttgtaaagcgaaaaaagcaaggcgataaaaccctctccatcaaagctttgaaacaatggctaccaaaaaagaaatggaagtggtgaaaggagtagacttgaagaggtacatgggaagatggtacgaaattgcttcatttccatcaagattccaacccaagaacggagtgaacacaagggccacttatacgctgaatgaggatggcactgtccatgtgcttaatgagacgtggaatgatggcaagagagggtacatagagggttctgcttataaggctgatcctaacagtgatgaggctaaactcaaggtcaagttttatgtcccgccattcttgcccatcattcctgttgttggagattactgggttctgtctcttgatgaggattatcagtatgctttgattggccagcctagcaggaaatatctctggatactatgcaggaagacccatatggaggatgagatctataatcagctagtggagaaggccaaagaagagggatatgacgtggagaagctccacaagactccacagactgacccaccaccggaagaagaagggcccaaggacaccaaaggcatctggtggttcaaatccattctaggaaagtaaagtagaaaataagaatgagattatcaagcagagggttaagcacatgcacaacatagagcagtactactgtgttttacccctttgtgcctttgtttctgtaaaggaggttcttgtttttaaatagtcggttcctgaattatatagaaggtgcataactttttctaaata

SEQ ID NO: 973 - DNA, 754 bp, Taraxacum officinale
ctctcattctactcatcttctcgttattagcactcaccgaaatcgaaaacaccaaaatcatgtccaagaaagcgatggaagttgtaaagggaatagatctacaaaggtacatgggcagatggtacgaaatagcttgtttcccatcgaggtttcagcccaaaaacggcgtcaacacgagggctacatacacattgaacgacgacggcactgttcatgttctaaacgagacttggagtgatggaaagagaggattcatcgaaggaacggcttataaagcggaccccaaaagcgatgaagcgaaattgaaggtgaaattctacgtgccgccatttttaccgatcattcctgttacaggcgattactgggtactgcatttagatgatgactatcagtacgctttgattggtcaaccttccaggagttatctctggatactgtgcaggcaaactcatatagatgaggagatatacaacaaactggttgagaaggcgaaggaagaagggtatgatgtgagcaaactgaagaagacaccacaatcagaatcaccgccggaatccaaagatgcaccggccgacaccaaagggatttggtggttgaaatcgatatttggcaaatagaccctcgaaacaagaactcgtaataactgtaggaagaatatagtggttgtgtagttctggatgtatattacctatctttgtggtaatacttttgtttagttcatatggtaatgaaaatgttattcgtgttttgaaaa

SEQ ID NO: 974 - DNA, 993 bp, Quercus alba
atggggacgtatcgatcacttcgaccttatcaaaaggtgaccagcctacaccaggacaaacccttaaaatcccagaaagcaaaagagctcaaattaaaactctctctgtgtctctcttctgcaacaactgtgacacgcaacacaagcaattatggccaacaaagagatggaagtggtgaagggtgtggacctaaacaggtacatgggacggtggtatgagatagcttcattcccatcaaggtttcagcccaagaatggtgtgaacacaagggctacatacactttgagagaggatgggactgtgaatgtgctgaatgagacctggactgatgggaaaagagggtacatagagggcagtgcatacaaggctgatcccaacagtgatgaggctaagctcaaagtcaaattctatgtccctccattcctgcccatcatccctgtggttggggactactgggttttgtaccttgatgatgattatcagtatgccttgattggccagcctaccaggaagtctctttggatattatgcaggcaaacccacctagatgaagagatttacaatcagctacttcagaaggccacagatgagggctatgatgttagcaagctccacaagacaccacagagtgatcctcccccatcgggagaggaaggccctaaggacaccaaaggcttttggtattttaaatctcttctgggaaaatagggagaatagtgtttgcatatatactgtggtttgactgtttccagtatatgcataaataaaagatcaaaaccacccctgttttcggcatccagattagggatatatttgtgttattttttgctggctattttagtttttgtagagcaagaatgggtatatgttgggtgcctaggccctagactatgaatttttttttttggactgtaaagcctagactatgaagttgaagttctgaaatatgtccttatatgtaggctgcgtttggttgaatgtaaaatattttt

SEQ ID NO: 975 - DNA, 765 bp, Cichorium intybus
tcttcttgtattcacatttcacactcaccgaaagagaaaacaccagaatcatgtccaagaaagaaatggaagtagtaaaaggcctagatgtacaacgatacatgggcaggtggtacgaaatagcttcattcccgtcgttttttcagcccaaaaacggcgtcaacacaagggcaacatacacattgaacgacgatggcactattcatgttctgaatgagacttggagtgatggcaagagagattccatcgaaggtactgcttataaagctgatcccaagagcgatgaggcgaaactgaaggtgaaattctatgtgccgccatttttaccgatcatacctgttacgggtgattactgggtactgtttatatgtgaaaattatcagtatgctttgattggtcagccttccaggaagtatctctggatactgtgcaggcaaacccatattgacgatgaaacatacaatcagctggttcagaaggcgatagacgaagggtatgatgtgagtaaactgaagaagacaccacaagcagacccaccaccggaatctacggatgcgccggccgacaccaaagggatttggtggctgaaatcaatttttggcaaataaaacctcaaaataagaactcataatgaatatccatgttgatgttgaatttggtcgaattgtcgaagaatgaagtcgttgtatagctgtacatattacctatctttgtggttatgaacttatgatacagcttcagtttagtttcatctagtaatggaaa

SEQ ID NO: 976 - DNA, 773 bp, Lactuca sativa
tcttcttcgttagcactcaccgatagagaaaaaccccaaaatcatgtctaagaaagcgatggaagttgtaaagggcatagatctacaaaggtacatgggcagatggtatgaaatagcttcattcccatcgaggtttcagcccaaagatgggatcaacacaagggctacatacacattgaaagacgatggcactgttaatgttctaaacgagacttggagtggtggcaagagaggattcattgaaggaactgcttataaagctgatcccaaaagcgatgaagcgaaattgaaggtgaaattctacgttccaccatttttgcccatcatacctgttacgggtgattactgggtgttgtatcttgatgatgattatcagtatgctctgataggtcagccttccaggagttatctctggatactatgcaggcaaactcatcttgacgatgagatatacaaccagcttgttcagaaggcgacggaagaagggtatgatgtgagcaaactgaagaagacaacacagacagaaccaccgccggaatctgaagatgcaccggcggacaccaaagggatttggtggtttaaatcattatttggcaaatagaccttgaaaacaagaacactcttaataaatgaacgtatattgatattgaattcagttgaagtgtggaagaatgtagtggttatgtagttgtacatattgcctacctgtgtgtggtacaacttctttctagttcatatggtaatgattaatgaaaatgttgttggtgtttgaa

SEQ ID NO: 977 - DNA, 930 bp, Mimulus guttatus
cacacactacattaaataataaaaattaaaaataaaaataaaaatggcgaagaaagcgatggaagtggtgaagtgtttggatgtggagaggtacatgggaagatggtacgagatagcttcgttcccatctaggtttcagcccaagagcggcgccgacacccgggccacctacacactcaaccccgacggcaccgtacacgttttgaacgagactttttccgacggtaagaggggtttcatcgaaggctccgcttacaaggttgacccaaacagcgacgaggctaagcttaaagtcaaattctatgtgccgccgtttctgcccattattccggtcaccggagattactgggttctgcacattgatgacgattatcagtatgctctcgttggtcagcccaccagaaaatatctatggattttaagcaggcagcctcggttggatgaggagatatacaatcagctattggagaaggctaaagaagagggatatgatgtcagcaaactgcagaaaacagcacaatcagaaactccaccggagagtgagagtgcaccgaaagacactaaaggagtttggtggatcaaatcgattcttgggaaatagtaagctacattgttgttattaatacgagtacgatcagtcttgagatattatcaagtttcgatgaataagtggggcatatgttttgatgtttttgtagtccgaatatctgtgttttgtattgtgaatctatgttgatgacaattccgcgtattttcagttctttgaggttttctttatatgtgtagtcttgatctgtatataagatccaagatttccgaggttcggagcttgtaatataatttgttttcaattatgatttgtatatgttatgtatgtaccgagagtttcaagtgtgaaacggtgcaaatttatgcatcacggtttgatct

SEQ ID NO: 978 - DNA, 976 bp, Mimulus guttatus
gaacacaacacacacacacacacacactacattaaataataaaaattaaaaataaaaataaaaatggcgaagaaagcgatggaagtggtgaagtgtttggatgtggagaggtacatgggaagatggtacgagatagcttcgttcccatctaggtttcagcccaagagcggcgccgacacccgggccacctacacactcaaccccgacggcaccgtacacgttttgaacgagactttttccgacggtaagaggggtttcatcgaaggctccgcttacaaggttgacccaaacagcgacgaggctaagcttaaagtcaaattctatgtgccgccgtttctgcccattattccggtcaccggagattactgggttctgcacattgatgacgattatcagtatgctctcgttggtcagcccaccagaaaatatctatggattttaagcaggcagcctcggttggatgaggagatatacaatcagctattggagaaggctaaagaagagggatatgatgtcagcaaactgcagaaaacagcacaatcagaaactccaccggagagtgagagtgcaccgaaagacactaaaggagtttggtggatcaaatcgattcttgggaaatagtaagctacattgttgttattaatacgagtacgatcagtcttgagatattatcaagtttcgatgaataagtggggcatatgttttgatgtttttgtagtccgaatatctgtgttttgtattgtgaatctatgttgatgacaattccgcgtattttcagttctttgaggttttctttatatgtgtagtcttgatctgtatataagatccaagatttccgaggttcggagcttgtaatataatttgttttcaattatgatttgtatatgttatgtatgtaccgagagtttcaagtgtgaaacggtgcaaatttatgcatcacggtttgatcttacgcacaattacacacaaacttacg

SEQ ID NO: 979 - DNA, 806 bp, Lactuca sativa
atcttcttcgttagcactcaccgatagagaaaaaccccaaaatcatgtctaagaaagcgatggaagttgtaaaaggcatagatctacaaaggtacatgggcagatggtatgaaatagcttcattcccatcgaggtttcagcccaaagatgggatcaacacaagggctacatacacattgaaagacgatggcactgttaatgttctaaacgagacttggagtggtggcaagagaggattcattgaaggaactgcttataaagctgatcccaaaagcgatgaagcgaaattgaaggtgaaattctacgttccaccatttttgcccatcatacctgttacaggtgattactgggtgttgtatcttgatgatgattatcagtatgctctgataggtcagccttccaggagttatctctggatactatgcaggcaaactcatcttgacgatgagatatacaaccagcttgttcagaaggcgacggaagaagggtatgatgtgagcaaactgaagaagacaacacagacagaaccaccgccggaatctgaagatgcaccggcggacaccaaagggatttggtggtttaaatcattatttggcaaatagaccttgaaaacaagaacactcttaataaatgaacgtatattgatgttgaattcagttgaagtgtggaagaatgtagtggttatgtagttgtacatattgcttacctgtgtgtggtacaacttctttctagttcatatggtaatgatcaatgaaaatgttattggtgtttgaatgtttgatcgcattttggaggttgaaattatg

SEQ ID NO: 980 - DNA, 850 bp, Eschscholzia californica
ggtcttcccttcctctctcaactttttatcccctctttatatctctctatctagattctagtagaatggcagcaaagaaagaaatggaagtggtgaaagatttagatgtgaaaagatacatgggtagatggtatgaaatagcttcattcccatcaagatttcaacctaaaaatggggtaaatacaagagctacttatacattaaatgaagatggtaccactgttcatgttttaaatgaaacttggagtgatgggaaaagagggtttattgaaggtacagcatataaagctaatccaaatagtactgaagctaaattgaaagttaaattttatgttcctcctttcttgcctattatccctgttgttggtgattattgggttttgaccattgatgatgattattcctatgctttgattggtcagcctagcagaaactatctttggatcttatgcaggaatactcacctagatgaagagatatataatcagctggtggagaaggccatagctgagggatatgatgtgaagaaactgcataagacaccacaatctgatcccccacctgaaggagatgaaactcccaaagacactaaaggaatctggtggttcaaatctctctttgggaagtaaaatcaatcactactcacaagaatggattaataaataaaaaaatggatgaatgaagtggaatgttgtttctagctagtttgtggtttagtagtaaatgtcagtttgatttgcatgtttgttttatgaacttccaatggttgataatcttgttatgatttctcagtggttttattgtaaataagatttgtcatatttgtgtaggtaaatggtaatattgcctt

SEQ ID NO: 981 - DNA, 754 bp, Curcuma longa
gcacgcggtctcgtgccgaattcggcacgaggcaatggcgaagcaggaggagatgaccgtggtgaaagggttggacttggagcgctacatggggaggtggtacgagatcgcctccttcccctcccgcttccagccgcgggacggccaggacacgcgggctacgtacacgctgcggtccgacggcaccgtgaacgtcctcaacgagacttggagcggcggaaggcgcggatccattgagggcacggcctacaaggccgacccctccagcgacgaggccaagctcaaggtcaaattctacgtgccacccttccttcccatcttccccgtcgtcggagattactgggtgctctacatcgacgacgactaccagtacgcgctcatcggccagccctcccgcagttacctctggattctgtgcagacaaacccacctggatgaggaagtatacaacatgttggtggagaaagctaaagaagtgggttatgacgtccagaaactgcacaagacgccccaaaccgatcctcctccggaagccgacacagctcccagggataccaaaggcatttggtggatcaaatccctctttggcagatgaaatcttcatttttcccttttaatggagtgtctaccgcccagtttggagtcgaccgtcacatccttggtctgtatgatcctatcaatatatactgaagtattcactgcgtgtgatgtgttgaatagtatgtacaatcgaagtaatattggtatctttgtg

SEQ ID NO: 982 - DNA, 992 bp, Tropaeolum majus
tgccgggaattcggccattacggccggggaacacaacacaacacaacacaacaatggcgaaccagatgcaagtggtgaaaggcctagacgtgaagagatatatggggcggtggtacgaaatcgcttctttcccctccaggtttcagcctaaagacggagagaacactcgagccacttacactttaaatgaagacggcactatccatgttctgaatgagacatggagcggtggtaagaggagcttcatagaagggacggcgtacaaagctgatccgaacagcgatgaagctaagctcaaagtcaagttctatgttcctcctttcttgcctatcatccctgttactggtgattactgggttttgttcattgacgatgattataactatgctttaatcggccagccttccaggaaatatctttggatattatgcaggcagccacatctggatgaggggatttacaatcagctggtggagagggctaaagatgtggaagggtatgatgtgaccaaactccatagaacaccccagagtgataccccaccggagggagacgaaggtcctaaagacaccaaaggaatttggtggttcaaatcacttttgggaaaataggattctatatatacatatatatatgtacatatatatgtgtgtaggtgtagtacctattttctgggttttttttaatacagtcatgtaataaaaaggttcgaactttagagtaggaagtgaaaactagtgtgtgtgtggttttttggttttggttttactaaaagaattagtattaaaatgtgttgtgtgggttgcaagtttttgaatatgtatgatatgaaattattaattatgtgttaagttgcatttcatgttttaatttaaccatcaaaacaaatcattacaagactttgctgaacatgttggaaactactagaaaacctgttgaaagtgccgagtgatatccagaccaaaagaaagacacgaacgaaataaccccat

SEQ ID NO: 983 - DNA, 940 bp, Tamarix hispida
gggggacttatttaaaccctgaatccgggttacctacccacggagttctttagtacgcttaagaaaattcctgttagcaatctctcggcatcagcaatcaaccatggggaacaacaaagagatgaaagtagttaaaggattagacgtaaagaggtacatgggtcgttggtatgaaatcgcttcattcccgtcattctttcagcccagaaatggagagaacactagagctacttacactttgaattcggatggaacaattcatgtacttaatgaaacttggagtagtggaaaaagagatgctattgagggaactgcctataaagctgatcctaagagtgatgaggctaaattgaaagtgaagttttatgtgcctccatttttgccgatcattcctgttgttggggattactgggttctttatattgatgatgattatcagtacgctttgattggtcagcctagcaggaagtatctttggattctatgcaggcaaactcatatggacgatgagatatacaaccagctggtgcagagggccctggacgaaggctatgacgtgaagaaactgcacaagacacctcaggcagaccccccaccagaaagtgatgatggccccaaggacaccaagggtgtctggtggatcaaatccctgttcggtaaataagcattaatgcccgtcgacgtggttaatcttgcgttactgcagctgaaaaggccttgtccctgttagagtacactatagcaagggccatacttttcagtacttagacttgtctctacctttgtgtgctgcacgtaatgttagtttcgtcttttgcttgtttctatgttctcaaagtctgaacgcgtgtacagtaagatatatatgtcttcttgttggtgtaattgaattattggtacttacttcttgttgtgaatgtcctttgagaattttaacgtt

SEQ ID NO: 984 - DNA, 976 bp, Manihot esculenta
aaagaaaacactagaaactctcatatcacacacacggttcacagccctccacgtctctctctaaaatctcaccgcaccaaaaacctcatccatctctctatataaccctcattatcttcacccaagaatctctcactcaaacccattagcagaaatcggatcatttcactcttaaccagaagcaatcgacatggcatccagtaaaaagatggaggtggtgaagggcgtggacataaagagatacatggggagatggtacgaaatagcttcattcccatcaagattccagcccaaaaatggagaaaacacaagagcaacctatactttgaatgaagatggcactgttcatgtcttgaatgagacatggagtgatgggaagagaggatacatagagggtactgcttacaaggctgatccaaacagtgatgaagctaagctcaaggttaaattttatgtgcctcctttcttgcccatcattcctgttgttggggattactggattttgtttttggatgaagattatagttatgctttgattgggcaacccagcaggagatatctttggattctttgcaggcggcctcatcttgatgagaagacctacaaccagctggtggagagggctaaagaagaagggtatgatgtgagcaagcttcacaagacaccacaggcagaaacaccaccagaggaagatggccccaaggacaccaaaggaatttggtggatcaaatccattttgggatggtagaaatcccaattgaattcgcatcttgatcatgctgtgtgcttggtagtcttgttattgtcaggtttttgattagataggaatccaaggaggagcattgggctccatcttatatgtgtattagcttattctgtgtattattgctgggctttgtaggattacagtgtgctaaagaaaataatagtttattaatgtgaagccaatagaaattatcctgtcattttccatgct

SEQ ID NO: 985 - DNA, 826 bp, Heritiera littoralis
gagaatacaaactgtcttaaaccccaatcaaaatcccttctcttgcaatctaaacaaggacccaaaacaatgtctaagaaaacaatggatgtggtgaagaatttggacatcaacagatacatgggaagatggtacgagatagcttcattcccatcattttttcagcctagaaatggggtgaacacaaaggctacctacactttgaatgaagatggaacagtacatgtgcttaatgagacttttactgatggcaaaagagtgtctatagaaggcagtgcctacaaggctgatcccaagagtgatgaggcaaagctgaaagtgaaattctatgttcctcctttcttgcccatcattcctgttgttgggaattactgggttttgttcatcgatgatgattatcagcatgttctcattggtgagcctaccaggaagtatctttggatattatgcaggcagactcatttggatgatgaaatctacaaccagctggtgcagaaggccaaagatgagggctacgatgtgagcaaactgcacaagactccacaaagcgatcctccaccaggagaggacacccccaaggacaccaaaggcatatggtggatcaaatccatctttggaaaataggaaccttaacgatgatctatgcatggttcagtactagtataaatattgaaccgaaatccagtttgtagcatagagtttgcagtctaaagttaatttgtttcttgtgttttgttctgtaaagtgtttgttttcatccctgaaccacattttgataactgttgcgagtttgctttggtgtgaacagcgaagcatgaatgcataa

SEQ ID NO: 986 - DNA, 1091 bp, Quercus alba
atggggacgtatcgatcacttcgaccttatcaaaaggtgaccagcatacaccaggacaaaccctcaaaatcccagaaagcaaaagagctcaaattaaaactctctttgtgtctctcttctgcaacaagtgtgacacgcaacacaagcaattatggccaacaaagagatggaagtggtgaagggtgtggacctaaacaggtacatgggacggtggtacgagatagcttcattcccatcaaggtttcagcccaagaatggtgtgaacacaagggctacatacactctgagagaggatgggactgtgaatgtgctgaatgagacctggactgatgggaaaagagggtacatagagggcagtgcatacaaggctgatcccaaaagtgatgaggctaagctcaaagttagattctatgtccctccattcctgcccatcatccctgtggttggggactactgggttttgtaccttgatgatgattatcagtatgccttgattggccagcctaccaggaagtctctttggatattatgcaggcaaacccacctagatgaagagatttacaatcagctacttcagaaggccacagatgagggctatgatgttagcaagctccacaagacaccacagagtgatcctccaccatcgggagaggaaggccctaaggacaccaaaggcttttggtattttaaatccctttttggaaaatagggagaatagtggttgtttgtataccgtggtttgactgtttccaatatatacataaataaagatcaaaaccaccccggattgcagcatccagattagggatatatttgtgttattttttgctggctattttagtttttgtaaagcaagaatgggtatatgtaatatatttttttttgctaaacaggtatatgtaatatgttgggtgcctaggccctagactttgaattttattttattttatttttttagtggtactgttaagcctaaactatgaagttgaagttctgaaaaatgtccttatatttcattggggccgttttgagtttgctttaatgtgaaagttcgataaaaattttcaatgatgattccactactttttaca

SEQ ID NO: 987 - DNA, 1076 bp, Quercus alba
ataggcctccacgtatcacttcgaccttatcaaaaggtgacagcctccaacggcaaaatccctcaaaatcccagaaagcaaaaaaggtcaaaattcacactgtgtctctcttctgcaacaagtgtgacacgcaacacaagcaattatggccaacaaagagatggaagtggtgaagggtgtggacctaaacaggtacatgggacggtggtatgagatagcttcattcccatcaaggtttcagcccaagaatggtgtgaacacaagggctacatacactctgagagaggatgggactgtgaatgtgctgaatgagacctggactgatgggaaaagagggtacatagagggcagtgcatacaaggctgatcccaaaagtgatgaggctaagctcaaagttagattctatgtccctccattcctgcccatcatccctgtggttggggactactgggttttgtaccttgatgatgattatcagtatgccttgattggccagcctaccaggaagtctctttggatattatgcaggcaaacccacctagatgaagagatttacaatcagctacttcagaaggccacagatgagggctatgatgttagcaagctccacaagacaccacagagtgatcctccaccatcgggagaggaaggccctaaggacaccaaaggcttttggtattttaaatccctttttggaaaatagggagaatagtggttgtttgtataccgtggtttgactgtttccaatatatacataaataaagatcaaaaccaccccggattgcagcatccagattagggatatatttgtgttattttttgctggctattttagtttttgtaaagcaagaatgggtatatgtaatatattttttttgctaaacaggtatatgtaatatgttgggtgcctaggccctagactttgaattttattttattttatttttttagtggtactgttaagcctaaactatgaagttgaagttctgaaaaatgtccttatatttcattggggccgttttgagtttgctttaatgtgaaagttcgataaaaattttcaatgatgattccactac

SEQ ID NO: 988 - DNA, 970 bp, Actinidia deliciosa
aaatatctctctctagcaatggccaagaaagagatggaagtggtgaagggactagacctagagaggtatatggggaggtggtatgaaatagcctcattcccctcaagatttcaacccaaaagtgggatcaacactagggctacctatacattgagggaagatggcattgtgaatgtgctgaatgagacttggactgatggcaagagagggttcatagaagggactgcctataaggctgaccctaagagtgatgaggccaagctaaaggtcaagttctatgttccccctttcttgcccatcatccctgttgttggggattactgggttttgtttattgatgatgattatcagtatgctttgattggccagccctcaagaaagtatctctggatattatgcagacaaaatcatattgctgaagagacctacaaacagcttgttcagagggctaaagatgagggctatgatgtgagcaagcttcaccagacaacacacactgatcccccacctgagggagaagatggccccaaggacaccaaaggcatttggtggtttaaatccattttcggaaagtaaaaagctggggcaaatagtaaattgaaaagttcatctatgaaaatagaaataaaagggtacgagaaacccttgcagaaaaatctagattctagattgaggttgtgcttgttcttgtaaagtgtgtgtgtgtgtgtgtgtgcaagttttgaagaatgcttgtgaatgtggatattgtgagcttcctttgttgtgaagtttgtgggatattttcatgtgtttggtgagaaagtaatgtatttcaaacttggggtccaagattgaaaaagagtcttattatgtaagtgatgttttaagtgatgcctattgttttctttgaacctgattgaaatgtgttttcatcctcaggtgtaattggtacaatgacatctcaggatttccacgcaaaacaaaaaaa

SEQ ID NO: 989 - DNA, 803 bp, Lactuca sativa
tctgttctccattctactcatcttcttcgttagcactcaccgatagagaaaaaccccaaaatcatgtctaagaaagccatggaagttgtaaaaggcatagatctacaaaggtacatgggcagatggtatgaaatagcttcattcccatcgaggtttcagcccaaagatgggatcaacacaagggctacgtacacattgaaagacgatggcactgttaatgttctaaacgagacttggagtggtggcaagagaggattcattgaaggaactgcttataaagctgatcccaaaagcgatgaagcgaaattgaaggtgaaattcttcgttccaccatttttgcccatcatacctgttacaggtgattactgggtgttgtatcttgatgatgattatcagtatgctctgataggtcagccttccagaagttatctctggatactatgcaggcaaactcatctcgatgatgagatatacaaccagcttgttcagaaggcgacggaagaagggtatgatgtgagcaaactgaagaagacaacacagacagaaccgccgccggaatccgaagatgctccagccgataccaaagggatttggtggtttaaatcattatttggcaaatagaccttgaaaacaggaagactcttaataaatgaacgtatattgatgttgaattcagttgaagtgtggaagaatgtagtggttatgtagttgtacatattgcttacctgtgtgtggtacaacttctttctagttcatatggtaatgatcaatgaaaatgttattggtgtttgaatgtttgatcg

SEQ ID NO: 990 - DNA, 838 bp, Mimulus guttatus
ctacactaaataataaaaatagaaataaaaatggcgaagaaagcgatggaagtggtgaagtgtttggatgtggagaggtacatgggaagatggtacgagatagcttcgttcccatctaggtttcagcccaagagcggcgccgacaccagagccacctacacactcaaccccgacggcaccgtacacgttttgaacgagactttttccgacggaaagaggggtttcatcgaaggctccgcttacaaggttgacccaaatagcgacgaagctaagcttaaagtcaaattctacgtgccgccgtttctgcccattattccggtcaccggagactactgggttctccacattgatgatgattatcagtatgctctcgttggtcagcccaccagaaaatatctttggattttaagcagacagactcggttggatgaggagatatacaatcagctattggagaaggccaaagaagagggatatgacgtcagcaaactgcagaaaacagctcaatcggaaactccaccggagagtgagagtgcaccgaaagacactaaaggagtttggtggatcaaatcgattcttgggaaatagtaagctatattgttgttattaatacgagtacgatcaatcttgggatattatcaagtttcgatgaataagtggggcatatgttttgatgtttttgtagtccgaatatctgtgttttgttttgcaaacctatgttgatgacggttccgtgtgttttctgctcttcgacgtgttctttgtatgtgtagtcttgctctgtatataagatccaagatttccgaggttcggagcttgtaatataatttgttttcaa

SEQ ID NO: 991 - DNA, 1056 bp, Quercus alba
tcgatcacttcgaccttatcaaaaggtgaccagcctacaccaggacaaacccttaaaatcccagaaagcaaaagagctcaaattaaaactctctttgtgtctctcttctgcaacaactgtgacacgcaacacaagcaattatggccaacaaagagatggaagtggtgaagggtgtggacctaaacaggtacatgggacggtggtatgagatagcttcattcccatcaaggtttcagcccaagaatggtgtgaacacaagggctacatacactttgagagaggatgggactgtgaatgtgctgaatgagacctggactgatgggaaaagagggtacatagagggcagtgcatacaaggctgatcccaacagtgatgaggctaagctcaaagttaaattctatgtccctccattcctgcccatcatccctgtggttggggactactgggttttgtaccttgatgatgattatcagtatgccttgattggccagcctaccaggaagtctctttggatattatgcaggcaaacccacctagatgaagagatttacaatcagctacttcagaaggccacagatgagggctatgatgttagcaagctccacaagacaccacagagtgatcctccaccatcgggagaggaaggccctaaggacaccaaaggcttttggtattttaaatccctttttgggaaaatagggagaatagtggttgtttgtataccgtggtttgactgtttccaatatatacataaataaagatcaaaaccaccccggattgcagcatccagattagggatatatttgtgttattttttgctggctattttagtttttgtaaagcaagaatgggtatatgtaatatatttttttttgctaaacaggtatatgtaatatgttgggtgcctaggccctagactttgaattttattttattttatttttttagtggtactgttaagcctaaactatgaagttgaagttctgaaaatgtccttatatttcattggggccgttttgagtttgctttaatgtgaaagttcgataaaaattttca

SEQ ID NO: 992 - DNA, 1000 bp, Quercus alba
tcaaattaaaactctctctgagtctctcttctgcaaaaactgtgacacgcaacacaagcaattatggccaacaaagagatggaagtggtgaagggtgtggacctaaacaggtacatgggacggtggtatgagatagcttcattcccatcaaggtttcagcccaagaatggtgtgaacacaagggctacatacactttgagagaggatgggactgtgaatgtgctgaatgagacctggactgatgggaaaagagggtacatagagggcagtgcatacaaggctgatcccaacagtgatgaggctaagctcaaagtcaaattctatgtccctccattcctgcccatcatccctgtggttggggactactgggttttgtaccttgatgatgattatcagtatgccttgattggccagtctaccaggaagtctctttggatattatgcaggcaaacccacctagatgaagagatttacaatcagctacttcagaaggccacagatgagggctatgatgttagcaagctccacaagacaccacagagtgatcctcccccatcgggagaggaaggccctaaggacaccaaaggcttttggtattttaaatctcttctgggaaaatagggagaatagtgtttgcatatatactgtggtttgactgtttccagtatatgcataaataaaagatcaaaaccacccctgttttcggcatccagattagggatatatttgtgttattttttgctggctattttagtttttgtagagcaagaatgggtatatgttgggtgcctaggccctagactatgaatttttttttttggactgtaaagcctagactatgaagttgaagttctgaaatatgtccttatatgtaggctgcgtttggttgaatgtaaaatattttcaggtgaaaatattttccggaaaggaaaatattttcttagtgtttggttgcattttgcaaattgtattagaaactattttcaggtatttggtaaaa

SEQ ID NO: 993 - DNA, 4314 bp, Solanum phureja
accttgattgctattatgcttcttagaagctatgcttaccttcttcgaaagccgtctccgtacatagctgttttcttggtcccgactgttgttctggtgactcagcaaggagatgctctgatgttgcatactgacttaaaagtgggcaaatattggggagaaatgggtgttgattattgggatgctgctacatggcaacaacaagtggacgatcatgaggtacttgttatgactccggcaatactacttgctgctttgaggcacagctttttacaaatagacatgataaaagttataatatttgatgagtgccacaatgcacgaggcaaacacccctatgccagcataatggtggagttttatcatcaccagttaacccatgagagcgcacaacttccaagaatatttgggatgactgcttcccctataaagtctaaaggtgctagcacggcacatagttattggcaaaagattcgtgacctcgagaatcttatgaattccaaggtgtacacgtgtagcagtgagtctgttctggcagagtatatcccattctcaaatccgaagttgaagatatatgaacatgtggatattccttgcacattgtttaatactttagctcaggacctcgaaaggttgaaagaaaagcatgaatgttcgatttcaaagtcaaacctgtcttctatgagtgctggatctgcaagaagacgtttatcaaaacttcacttggctttcttattttgtttgagtgagatgggtgtgtggctggctttcaaggcagctgagttcttgtcctttgaagaaaatgatttcttttcatggggagaattcgatgcatgtgctcagacaattgttagaaatttcagtttgggtgcatctaagattttctcggctcgtttaccttcaggcccacattggtcaattggtggtgatattcaggcaaatgcagatgctggatatttgtcatccaaagttaattgtcttctagagtctcttctcgagtacagggaccgaaaggatttgagatgcatcatatttgttgagagaattgttacagccattgttcttcggtctctactgaatgagttgcttctggaacgaagtggttggagaactgagtacacagcagggcatatttctgttctccagtcacagagtagaaaaaatcaaaataaaattgttgaagaatttcgcaaggggttggtgaacattattgtagcgacatctattcttgaagagggcttggatgttcaaagttgcaaccttgtgattcgatttgatccatcagctactgtttgtagctttatacaatcacgtggacgagctcgaatgcaaaactccgactttcttctgatggtcagagatggggatgatccgacccttactcgcatgcaaaactatatggctagtggagagataatgcggcaagaatcattacgtcatgcttctattccatgttcacctctagatgatgaattgtatgatgagccttgctacaaagttgaaagcacaggagcagttgtcaccctcagttctagcgtgtcattgctatacttctattgctcaaggctaccgtcggatgggtactttaaacccaatcctaggtgtgtgattgataaggaaacaggaacctgcacgctacaacttcccaaaagttcgccactgcaaagagttattagtgtacaggggaatagaaaaatactgaagcaacttgcatgcctggaagcttgtaaagaacttcatcatgtgggtgccttgactgacaatcttgttcctgatattgtggaggaagaagccatcaacaaagaattggaatgtcaaatccatactgttgaagaatcaaaatactttccaccagaattggttagtcattgcagcaatgattcagaagcagtgtactactgctacctagttgagatgcaacatgcctcttacaacgacttccagcttcatgggattatacttgctgttaggacaaggctcaagtgtgatgatgaaatactggcatttgacttggacgttgataggaggggactcttgcaagttcaacttaattatagtaaagttgttacacttactgctgaagagattcgacggtgtcagaggtttcaagtcagtgtcttcagagttcttcgtgaccgtgatctgagtaaactgcaggacgctttggctgcagttcaattacctattggttctgcagtttctgattatcttttgctcccatctttgggtagtacccctgaaataaattggaaatgtgtgaattctttgctgtttccgtctcaagttcttgaggataagcatatggattggtgttctactcaagatcgcaaacgcagtgtgaacatcaaaactggggtggtatgtagctgcatgttggagaattcattggtctttacacctcataatggccatatatactgcattaccggttttttggataatttggattgctactcattgttgggtatgagaactggagaatccatcacctacacagaatactacaaaaagcggcatgggatcaacatatgctttgaagaagaaccacttcttaggggaaaacatatttgtaaagtgcacaattaccttcagagaagcagaactcagaaggctaaagattcaactgattcatctgtcgagttgcctcctgaactttgttccctcatcatgtcacctctctctatttctacccttaatacctattcatatgttccttcgatcatgcatcggattgagtccttggttatggcctcaaacttgaaaagaacgcatttggatcaccgcacactaaatgttcctattccaaccgctaagattttggaagcaattacaacgaagaaatgccttgagaagtttcatttggaatcacttgagacacttggagactcttttctcaaatatgctgccagtataaagctgttcaagacttacgaaaatcatcatgagggtcttctcaccgttaagaaaaatcagattatttccaatgctgcactatgcaagcttggatgtgctcgtaaaataccgggatttatccgtaatgaaccattcgatcttaaagcatggatcattcctggtgataattctcaagttcacagcttcgacgacgagtttctaacgtcctcagataaaatgtatagtagggtaaaacagaagattaaaagtaagagagtagctgatgtggtcgaggcactaataggtgcctacctcagctcgggtggggaagtagcggctttatcatttatgaaatggcttggggtggacatcaattttgttgatgcacctatgtcaaggcactttcccatgaatgctgagaagctagttaatgtcagatacttggaatccctgctgcattacaagttcaatgatccttctctgcttgttgaagctctaactcatggatcttacatgctacctgagattccacgatgctatcagcgcttggaatttcttggagatgcagtgctcgattatgttgttacagcacatctctattccaaatatccgggactgactccaggactaattactgatttgaggtctgcctccgtaaacaacgaatgctatgctcaatctgcagttaaggctggcctgcacaagcacattcttcatgcctcgcaagatctgcaaaggcagatatgtagtactgttgaggatttcgataaattgaaccttgtctccacgttcggatgggaggctgaaactactttcccaaaggtgcttggagatgttatcgagtcccttggtggtgcgatctttgttgattctggtttcgacaaagatactacatttcagtgcatacgacctcttttggaaccgttggttacacctcagacattaaagccccatccagtaagagagttaactgaactatgtgaccagaaaggttatataaagaagaaggatgtcgtctgtcgtgagaatggtatagcctatattacagtagaggttgaagcaaatggcgttattcacaagagcacgtgctcaggacgagataaactaatgggcaggaaggtggctagcaaaaatgtgctcaagtctctgaaagaatgtccatccaatgcttaacagtagttacaaaattcccagaattgcttaatattgtaagggtcatttgtttggatgtgttgtttcataatgtatcgtaatgtactactggatttgttgttatgtaaaaatgaagattctccttttgtgattattttctttagtaaaggtggatttagccaaggaatcttctttttttgaacagtctcaacatcctcgttgagagtagctttgtgagacgtttagtagtctctggcttggtcttcgaat

SEQ ID NO: 994 - DNA, 4151 bp, Solanum lycopersicum
accttgattgctattatgcttcttagaagctatgcttatcttcttcgaaaaccatctccttacatagctgttttcttggttccgactgttgttttagtgactcagcaaggagatgctctgatgatgcaaactgacttgaaagtcggaacatattggggagaaatgggggttgatttctgggatgctgctacatggaaacgtcaagtagatggccatgaggtacttgttatgactccggctatactactttctgcgttgaggcacaactttttgcagatagatatgataaaagttataatattcgatgagtgccacaatgcacgaggcaaacacccctatgcaagtataatgatggaattttatcatcgacaattaacccgtgagagtgcacaacttccaagaatattcgggatgactgcttcgcctattaagtccaaaggccctagcacgccagatagctattggcgaaagattcatgaccttgagaatcttatgcattctaaggtatacacatgtgacagtgaagctgttttggcagagtatatcccgttctcaaatccgaagctgaagatatataaacatgtagatattccttccacattgtctaaaagtttagctcatgacatggaaaggttgaaagaaaagcatgaatgttcgatcacaaaatcaactctgtctgataagagtgctgcatctgcaaaaagacgtctatcaaaactttattccgctttcttattttgtttgagtgagatgggtgtttggctggctttcaaggcagcagagttcttgtctcaacaagaaactgacttcttctcgtggggagagttagatgtatgtgctcaaacaattgttcgagatttcagttcggatgcatctaaggttttctcggcttgcttaccttctgggccacattggtcaattggtggtgatattcaagcaaatacggatgctggatatttgtcatcgaaagttcattgtcttgtagagtctcttctcgagtacaggaatctgaaggatttgagatgtatcatatttgttgagagaattattacagccattgttcttcgatctttattgaatgagttgcttccgaaactaagtggttggagaactgagtgcacagcgggacatgcttccgtggttcagtcacagagtaggaaaatacagaataaaattgttgaagagtttcgaaagggtgtggtgaacattattgtcgcgacatctattcttgaagaaggcttggatgttcaaagttgcaaccttgtcattcgatttgatccctcagctactgtttgtagctatatacaatctcgtggaagagctcgaatgcagaactccgactttcttctgatggtcaaaaggtatattttgtgcaatatttggaaaagatttcattatatctatggactgatcatttctcaatttgactcaaatcgtagtggagatgaatcaacccttgctcgaatgcaaaactttatggccagtggggagatgatgcggcaagaatcattacgtcatgcttctgaaccatgttcacctctagttgatgaaatgtatgatgagccttgctacaaagtcgaaagcacaggagcaattattaccctcagttctagcgtatcgttgttatacttctattgctcgaggctaccatcagacgggtactttaaatcgtatcctagatgtgtgattgataaggaatcacgaacgtgcacactacaacttcccaaaagttgcccattgcaaagaattattactgttcaggggaatagtactaaaatattgaggcaacttgcatgcttggaagcttgtaaagagcttcatcgtgtgggtgcgttgactgacaatcttgttccagatatcgtcgaggaagaagcaatcaacaaagaattggaatgtcaaatccataccgttgaagaatcaaaatacttcccaccagaatttgttagtcatttcggaaatgagacagaagcagtgtactactgctacctagttgagttgcaacatgaaacttacgacgatttccagcttcatgggattatacttgctgttaggacaaagctcaagtgtgatgatgaaatattggcatttgacttggacgttgacaggaggcgacgtgtgcaagttcaacttaagtatagtaaagttgttacacttacttctgaagagattcgaaggtgtcagaggtttcaagttagtgtattcaaaattcttcttgaccgtgatctgagtaaactgcaggacgctttggctgcaggtcaatctcctattggttctgcagtttccgattatctcttgctcccatctgtgggtaaatcctctgaaataaactggaaatgcgtgaattctttgctgtttccgtcacaagttcttggggataagcatatggattggtgttctacacaagatcgtaaacgcagtgtgaacaccaaaactggggtggtatgtagctgcctgttggagaattcattggtctttacacctcataatggcaatatatactgcattaccggttttttagataatttggattgcaactcattgttgaatgtgagaactggagaatccattacttaccgagaatactacaaaaagcggcaaggaatcgaactatgctttgaagaaccacttcttagtggaaaacgtatttcgaaagtgcacaattaccttcagagaaacagaactcagaaggctaaagattcaactgattcatctgttcagttgcctcctgaactttgttttgttatcatgtcacctatctctatttctaccctttatacgtattcatatgttccttcaatcatgcatcggattgagtccttggttatggcctcacacttaaatagtatgcttttgaatgactgcaaactaaacgtcttcatcccaactgctatggttttggaagcagtgacaacaaggaaatgtctcgagaagtttcatttggaatcacttgaaacgcttggagacgctttcctcaaatatgctgtcagtacacagctgttcaagactcacgagaatcatcacgagggtcttctctgtgttaaaaaaagtaaaatcatttccaatgctgcactgtgcaagcttggatgtgctcgcaaaataccgggatttatccgtaacgaagcattcactcttcaagcatggatcattccaggtgatagttcacaagttcacagcttcaacgaagagttaatgacgtcttcagataagatgtatagtaggataaagcagaagattagaagtaagagggtagctgatgtggttgaggcactaataggtgcctacctcagctcaggcggggaagtagccgctttatcattgatgaaatggctagggatggacatcgattttgctgatgcaccgattcaaaggcacttcccattgaatgctgagaagctcgttaatgtcaagtacttggaatccctgctacattacaagttccatgatccatctctccttgttgaagcacttactcacggatcttacatgctgcctgagattccacgatgctatcagaggttagaatttctcggagatgcagtactggattatgtcgttacagcacatctgtacttcaaatatccgggactgtctccaggactaataacagatttgaggtctgcctcggtaaacaacgaatgctatgctcaatgtgcaataaaggctagcctgcacaagcacatccttcatgcctcaccggatctgcagaggcagatatgtaatactattgaggatttcaagaaccctgtgtccacgttcggatgggaggctgaaactactttccctaaggtacttgcagatgttatcgagtcccttgctggtgcgatctttgttgattctggcttcaatcaagacactacatttcagtgcatacgaccacttttagaaccgttagttacaccacagaccctaaagccccatccggtaagagagttaagtgaactctgtgaccagaaaggctacgtaaagaagaaggatgtcgtctctcgtgagaatggtgtagcctatattacagtggagattgatgcagatggtgttactcacaagagcacgtgctcgggacgagacaaaatcatggccaagaaagttgcttgcaaaaatgtgctcaagtctctcaaagaatgttcatacaatgcatagcataaatttgcaga

SEQ ID NO: 995 - DNA, 929 bp, Solanum phureja
tgattgggagttctgaaaaatcaacagttaaaaggacaatattgatttgtattcaggcactagaaatcaagaaaactacatcaagaaacaagaaatggcgttagatcttcatttccaagaacagataacagagagtacctttaacgaatgtcgtagtagcccctcacagaaatggaagacgttggatgatgagcgtgatgaagacaatcgtgctagtggttttgactgtaacatatgcttggatgttgttaaagatcccgtggttacattttgcggtcacctttattgttggccttgtatctataagtggattcaattccagagcgcctcggatcaccaaaagccacaatgtcctgtttgcaaagctaaagtttcacaaaaagagttgattccgctctatggtcctggccaagcaacaaaaccatctgaagacgacgttacaagtaaaggcatggtcataccacaaaggcctctgaggccaagatgtagtggggatcatacactgatagcaactacaaattcacttccatcgcaacaacttaaccatcgacaacagccacattcaggaggttacatcgcctcaccacccgtgattggtgaagtggtttatgcacgagtttttggaaatgcatgtccaaactcgtataaccttgtaggaaacacgagtttgagaatgagaaggcagctattacacgcggatagatcacttggcagattatatttcttcctcatctgttgtgtattggcatgccttctcttgttttgatcacttttcgcgctacattgcgtgtaatttgtatatatgtgtaccttattagatgctgaatatacgagcttcgctcaatgtaacatgtctttgaagctttttatgttcttgattctggctaataatacacaatttttttttaccataagatgtgtcattaaca

SEQ ID NO: 996 - DNA, 808 bp, Solanum tuberosum
aaaatcaacagttaaaaggacaatattgatttgtattcaggcactagaaatcaagaaaactacatcaaggaaacaagaaatggcgttagatcttcatttccaagaacagataacagagagtacctttaacgaatgtcgtagtagcccctcacagaaatggaagacgttggatgatgagcgtgatgaagacaatcgtgctagtggttttgactgtaacatatgcttggatgttgttaaagatcccgtggttacattttgcggtcacctttattgttggccttgtatctataagtggattcaattccagagcgcctcggatcaccaaaagccactatgtcctgtttgcaaagctaaagtttcacaaaaagagttgattccgctctatggtcctggccaagcaacaaaaccatctgaagacgacgttacaagtaaaggcatggtcataccacaaaggcctctgaggccaagatgtagtggggatcatacactgatggcaactacaaattcacttccatcgcaacaacttaaccatcgacaacaggcacattcaggaggttacatcggctcaccaaccgtgattggtgaagtggtttatgcacgagttttggaaatgcatgtccaaactcgtataaccttgcaggaaacacgagtttgagaatgagaaggcagctattacacgcggatagatcacttggcagattatatttcttcctcttctgttgtgtattggcatgccttctcttgttttgatcacttttcgcactacattgcgtgtaatttgtatatatgtgtaccttattagatgctg

SEQ ID NO: 997 - DNA, 808 bp, Solanum tuberosum
  misc_feature (333)..(333): n is a, c, g, or t
  misc_feature (474)..(474): n is a, c, g, or t
  misc_feature (493)..(493): n is a, c, g, or t
  misc_feature (542)..(542): n is a, c, g, or t
  misc_feature (564)..(564): n is a, c, g, or t
  misc_feature (572)..(572): n is a, c, g, or t
  misc_feature (638)..(638): n is a, c, g, or t
  misc_feature (647)..(647): n is a, c, g, or t
  misc_feature (656)..(656): n is a, c, g, or t
aaaatcaacagttaaaaggacaatattgatttgtattcaggcactagaaatcaagaaaactacatcaaggaaacaagaaatggcgttagatcttcatttccaagaacagataacagagagtacctttaacgaatgtcgtagtagcccctcacagaaatggaagacgttggatgatgagcgtgatgaagacaatcgtgctagtggttttgactgtaacatatgcttggatgttgttaaagatcccgtggttacattttgcggtcacctttattgttggccttgtatctataagtggattcaattccagagcgcctcggatcaccaaaagccacnatgtcctgtttgcaaagctaaagtttcacaaaaagagttgattccgctctatggtcctggccaagcaacaaaaccatctgaagacgacgttacaagtaaaggcatggtcataccacaaaggcctctgaggccaagatgtantggggatcatacactgatngcaactacaaattcacttccatcgcaacaacttaaccatcgacaacagncacattcaggaggttacatcgnctcaccanccgtgattggtgaagtggtttatgcacgagttttggaaatgcatgtccaaactcgtataaccttgnaggaaacangagtttganaatgagaaggcagctattacacgcggatagatcacttggcagattatatttcttcctcttctgttgtgtattggcatgccttctcttgttttgatcacttttcgcactacattgcgtgtaatttgtatatatgtgtaccttattagatgctg

SEQ ID NO: 998 - DNA, 720 bp, Solanum phureja
tagttgagtgaccgtagttgtatctagttaaggtcatggatttctaatcgttttccctcttggcatttgttttctataggcactagaaatcaagaaaaaagaaatggcgttagatcttcatttccaagaacagataacagagagtacctttaacgaatgtcgtagtagcccctcacagaaatggaagacgttggatgatgagcgtgatgaagacaatcgtgctagtggttttgactgtaacatatgcttggatgttgttaaagatcccgtggttacattttgcggtcacctttattgttggccttgtatctataagtggattcaattccagagcgcctcggatcaccaaaagccacaatgtcctgtttgcaaagctaaagtttcacaaaaagagttgattccgctctatggtcctggccaagcaacaaaaccatctgaagacgacgttacaagtaaaggcatggtcataccacaaaggcctctgaggccaagatgtagtggggatcatacactgatagcaactacaaattcacttccatcgcaacaacttaaccatcgacaacagccacattcaggaggttacatcgcctcaccacccgtgattggtgaagtggtttatgcacgagtttttggaaatgcatgtccaaactcgtataaccttgtaggaaacacgagtttgagaatgagaaggcagctattacacgcggatagatcacttgg

SEQ ID NO: 999 - DNA, 1121 bp, Solanum tuberosum
ggttctacataatcatcgtctataaactattatatataattccaaaactacatctccatctaagacaaaatccactcaaaattcaattactcaagcaatttacaatcaatttcttcaatcatgacaggcacaggagaggaaaatcaacccaaatttcaacaatcagagcctcagataccttctgtttcttcatcttcttcagatcctcaagcaccagaaatggatcagcaaaaatggggaactcatattatgggtccgcctgcaattccaacttctcatccagacaatcagaaagccgccttatggagagctgaggaccaaagagaagagtttcagccactgccttacgttgtttattccccaattgacaagtctagcaataacccacttgaatcggttgttaatgtgttcaattcgtggagtaatagagctgagaacatcggccgcaacatttggtataatctgaaagctggaccatcagttagaggagcggcatggggaaaacttaatatgacagccaaggcgttgacagagggtggatttgagcctctttacaaacagattttcgaagcagatcctaatgaacagctgaaaaagacatttgcttgttgtctttccactgcaactggtcctgttgctggtacactctatctgtcaactacgaaagttgctttttgcagtgatcgcccattatcattcaaagctccatctggtcaggaggcctggagctactacaaggtagcaatacctttgggaaatattgggactataaatccaatagtgatgagagagtctccaccagagatgtacattcagattgttaccatcgatggtcatgatttctggttcatggggtttgtgaattttgagaaagcaaaacatcatctacttgaaactttgtcaatttttagagctcaacctcctcatgttggggaagtcaatgtgcaacaaccagctacttactagaagaattggcctgtcatagcttattggggtgcactctgttttagtttttttttttttttctgtttcttcctgcattagatatatctttgtatttttttattgtaacattacttgtatgtttatacttatttgggagtgacttggttgttttgatg

SEQ ID NO: 1000 - DNA, 1149 bp, Solanum phureja
aatcttactgacaaagcgaaaataaaaaatgaaaacgcgtacacgttctacataatcatcgtctataaattattataattccataactatatgtccatctaagacaaattccactcaaaattcaattactcaagcaatttcttcaatcatgacaggcacaggagaggaaaatcagcccaaatttcaacaatcagagcctcagataccttctgtttcttcatcttcttcagatcctcaagcaccagaaatggatcagcaaaaatggggaactcatattatgggtccgcctgcaattccaacttctcatccagacaatcagaaagccgccttatggagagctgaggaccaaagagaagagtttcagccactgccttacgttgtttattccccaattgacaaatctagcaataacccacttgaatcggttgttaatgtgttcaattcgtggagtaatagagctgagaacatcggccgcaacatttggtataatctgaaagctggaccatcagttagaggagcggcatggggaaaacttaatttgacagccaaggcgttgacagagggtggatttgagcctctttacaaacagattttcgaagcagatcctaatgaacagctgaaaaagacatttgcttgttgtctttccactgcaactggtcctgttgctggtacactctatctgtcaactacgaaagttgctttttgcagtgatcgcccattatcattcaaagctccatctggtcaggaggcctggagctactacaaggtagcaatacctttgggaaatattgggactataaatccaatagtgatgagagagtctccaccagagatgtacattcagattgttaccatcgatggtcatgatttctggttcatggggtttgtgaattttgagaaagcaaaacgtcatctacttgacactttgtcaatttttagagctcaacctcctcatgttggagaagtcaatgtgccacaaccagctacttactagaagaaattgcctgtcatagcttattgggctacactctgttttagtttgtttttctttttcagtttgttcctgcattagatatatctttgtatttttttattgtaacattacttgtatgtttatacttatttgggagtgacttggttgttttgatg

SEQ ID NO: 1001 - DNA, 1120 bp, Solanum melongena
taaaactctatacattccataactatttctctgcttaaattcattcacaaagcacaaaatattcaaacatctcagacactctacccaattccttttcttccacatcaatcatgacaggcacaggagaggaacatcaacccaaagttgaagaatcacatgcccaggtaccctctgcttctgcttcttcttcagatcctcaagcaccagaagtagatcagcaaaaatggggcacccatatcatgggtccgcctgcagttccaacttgtcatccagataatcagaaagccgccttatggagagctgaggaccagcgagaagagtttcacccacagccttatgttgtttattcacccatcgataagcctagcaacaacccacttgaatctgttgttaatatgttcaattcttggagtaatagagctgagactatagctcgcaacatctggcataatttgaaagctggaccatcggtgacagaagcggcatggggaaaacttaatttgacggcgaaagcgttgacagagggtggattcgatccactttacaagcagattttcgctgcggatcctcatgagcagctgaaaaagacgtttgcttgttatctttccacagcaactggccctgttgctggaaccctttatctgtcaaatactaaagttgctttttgcagtgatcgccccttatccttcaaagctccatctggtcaggaggcttggagttactacaaggtagcaataccgttgggaaacattgggactataaacccaatagtgatgagagagaatccaccagagaggtacattcagatagtcacaattgatggtcacgatttctggttcatgggacttgtcaattttgagaaagcaaaacatcatctccttgaaaccctgtcaaattttagagctcaacctcctcatgttggggaagtcaatgtgccacaaacagctactacctagggaacaagtggcctgtcacttgtcatagctagcttattataatgggatgtactctgttttgtagtcttttttctctgtttgttcccgcactcagttttttctctttgtgtgttatggttatacatgtatgtatataaaagttgggagagacttcgtttgttttg

SEQ ID NO: 1002 - DNA, 1000 bp, Solanum tuberosum
ggttctacataatcatcgtctataaactattatatataattccaaaactacatctccatctaagacaaaatccactcaaaattcaattactcaagcaatttacaatcaatttcttcaatcatgacaggcacaggagaggaaaatcaacccaaatttcaacaatcagagcctcagataccttctgtttcttcatcttcttcagatcctcaagcaccagaaatggatcagcaaaaatggggaactcatattatgggtccgcctgcaattccaacttctcatccagacaatcagaaagccgccttatggagagctgaggaccaaagagaagagtttcagccactgccttacgttgtttattccccaattgacaagtctagcaataacccacttgaatcggttgttaatgtgttcaattcgtggagtaatagagctgagaacatcggccgcaacatttggtataatctgaaagctggaccatcagttagaggagcggcatggggaaaacttaatatgacagccaaggcgttgacagagggtggatttgagcctctttacaaacagattttcgaagcagatcctaatgaacagctgaaaaagacatttgcttgttgtctttccactgcaactggtcctgttgctggtacactctatctgtcaactacgaaagttgctttttgcagtgatcgcccattatcattcaaagctccatctggtcaggaggcctggagctactacaaggtagcaatacctttgggaaatattgggactataaatccaatagtgatgagagagtctccagcagagatgtacattcagattgttaccatcgatggtcatgatttctggttcatggggtgtgtgaattttgagaaagcaaaacgtcatctacttgacactttgtcaaatttttagagctcaaactcctcaatttggggcagtcaatgtgccacaaccaggtaattactagaaggaaattgctgttcatagcctattggggcta

SEQ ID NO: 1003 - DNA, 1194 bp, Capsicum annuum
cttgaaaatagttttccgcacttaaatcagttaatcatgacaggcacaacagaagaaaatcaacccaaagttcaagaatcagagcctcaagcaccctctattcctacatcttcttcttctgatgagaaagagaaacaaccagaaatggatcaacaaaaatggggcacacacataatgggtccaccagcagttccaacaagtcatccagataatcagaaagctgctgcgttatggagagctgcagaccaaaaagaagagtttcacccacagccttacgttgtttatactccagttgatcataggcctactaataatccacttgaatctgttgttaatatgtttaattcttggagtaatcgagctgagaccatcgcccgcaacatctggcataatctgagaactggaccatcagtgacagaagcagcgtggggaaagcttaatttgacagccaaggccttaacagaaggcggattcgagccgctttacaagcagattttctctacggaccctaatgagcagctgaagaagacatttgcttgttatctttcaacaactactggtcctgttgctggaacactctatttgtcatctactaaggttgctttttgcagtgatcgacctttatccttcaaagctccatcaggtcaggaggcttggagctactacaaggtagcaataccattgacaaacattgggactatgaacccaatagtgatgagagagaatccaccagagaggtacattcagatagttacaatcgatggtcatgacttctggttcatggggtttgtcaattttgagaaagcaacacatcatctccttgatgccttgtctaattttaaggcccaacctcctcatgttggggaagtgccacaaccagctagtaactaggaaaaaatggctctgtcataacttattgggctgcacactgctttactttttctattttctttgtttgttcctgcattagatatatgtattctctgtatgtatttttattgcaacattatttgtattatacacactgctttagtttttattttctctgtttaggagattgacatatatactgtctgtatttttattgtaacatttttgtattagactctcgtgtgtatttttattgtaacattatttatattgtatgtgccacttatacatagttgggagtgagtttgttttggtccctcgtgc

SEQ ID NO: 1004 - DNA, 2592 bp, Solanum phureja
attcctgaaattttttcaaagctgtttgttctctttctctctctatccagaaactccgagatttgtctttccgagcatcaaattagggttctactgctgtccttgtgccgttcaagtatcgattttctggccaagttctaggttttgccggcgcttatcggttttgagataaaggaggatttgggatttgaatatgaaatctgatcagtgtgttgcatgtggcttgagtgctggttaaacaactcaaaaggaatgtcagatttgcagttatacgggcttgacgatatatcttgggatgagttctgccacaatgatgatcatatagtgccacatccaagtagcggacgcaccaatgaaccactctcccagaatgatagccgtaagaagcctcgccatgaagtaattggtttaacaggtaatgcaggtgatcaatctactggtaaatatgctaatcagcaaaaggagcaagtgttgagtaatagaagccccaaaatgctggaaaaggactcgtgggctgatgcacctgatggtgcattctcttctccacgtgaaaaagccatagtcggagaagtttcaagtttaccatctgaaaataccaggacatccaatcgttgcatcaaaagtaataatatagactccattgagaacgagtcctgtcctaatggtcgcactcttgatgacaagaatgctgctgtgggggaaaactcttatagctatccacttggtcccatatctcaggctgatgatgatctcagttttcttgacaatagttgtgatgataaagactctaatgatctcttatattatagctggcctgagatagagaactttgaggatgttgacaggatgttcaggagttgtgattcgacatttggatttggacctggtagtgaagatgacctaggttggctttcatcatcagatgttattgaaggatctggagatggattgacgtctggttttaagtttccatgtccagcatccaatgcacttggaagtacatccgccagtcatgaaacttcaaagccaaaggaaacaaacatttcaactgataattctggcattgagaatcaatcacttggctataatagcagttcgtggtcctccgagaaaaatgaatctgtaaatctgagtcatttgtcttttttaaatggatcaagtaatttacagtgcaagttagcacctgataagaaggctgaggtacatggtggtggagtccaggttgagattgtatctaataaccaaccaagaatcaacaataatgtagtggatagcatgcaaaagaaacactccaagcaccagaatctctccaagggtaaaataaaatgcggttatctagaaaatggagacgcactcaattacactgatagccatccagaggagcagaagctgccttctgggatcgcaagcactcaagtgaatttcacatctgcaggtgtcctgcagcaaaagcaagctcaagatcctgattttggctacttgggtggtagcttctcttacatgcattcagattacggtcattccaatgggagtgctctccatccaactctaccaattttaaaatatgaaagtaacggtctcgtgtctctttcccccaaggactcttatgcatcaaatcaggtacagtccatggagggttctcctgatccttcttttcaggtggctgctatgacaagaaatgagaaggtggagaagttattccatagatctggagttaaggttgaaaataaccgtgattttgaaggggttggcataagaattcccacagaattaggatcctcagttgtacaggagtgttcttctacaaattctgggttggatgaaatttcagaagaagcagctagttttcatcagcttcaacgtgtcatggaacagttggatatacagacaaagctatgtataagggatagcttgtaccggttggctcggagtgctgaacaaaggcatagacatgctaatctcaatattgtctctggagatgatggaggtaccagcgaaccactggttaccgaaggaacaaacaagtgcacaggatatgtagacatcgaaacagacacaaatcccatagaccgatctattgctcatttgctattccacaggccttcagattcagctgttacccctgcccgcgattcctcaactttgaagtcgccttccatgattcatgggtcattgtctagcgcaccagtgatgagtgacaacttgatctctcatggagaaattgcatttcaaacagatggagaagctgctgatcattgaccataactatttaagaagtcaatttcagtttgtggggggatttcacatgcagaaattatcaagctatcatacaaggaacctttatgttttgaatgttttctcagtgactggtttctggtccatgtgagaacatatccttgtatgagctttcgcaatcaagttatttttatttcactctaacccttcctcactcggaaggcatacacaaactacctttcctgtgtatacgtagatcaaaccaactgactcttttttgttgtttgtaagtagataatacctggaaattttccagaagatacttgcaagtcttgaagtagctcgtgacctgttccc

SEQ ID NO: 1005 - DNA, 2992 bp, Capsicum annuum
gcacgaggttcaaagcaaaaacaaagcttcttctactttctctctctatccagaacctccgagatttgtctttccgaccatcaaattagggttctattgctgtcttttcgccgttaagctaccgatttactgctgaagttgttgagttttccggtgacatcggttttcagataaagggaggatttgggatttgaatatgaaatccgatcagtgtgttgcatgtggattaagtgctggttaaatatctcaaaggaatgtcagatttgcagctatacgagcttgatgatatatcttgggatgaggtctgccccaatgatgatcatatagtgccacatccaagtagtcgacgcgccaatgaaccactctcccagaatgatagccgtaagaaacctcgccatgaagtaattgttttaacaggtaatggaggcgatcaatctactgttaaatatgctaatcagcaaaaggagcaagtactgagtaatagaagcccccaaatgctggaaaaggactcatgggctgatgcacctgatggtgcattctcttctccacgtgaaaaagccatagttggagatgtttcaagcttaccatctgagaataccaggacatccaatcgttgcatcaaaagtaataatctagaatccattgagagcgagtcctctcctaatggttgcactctagatgacaagaatgctgctgtgggggaaaactcttataactatccacttggtcccatttctcaggctgatgatgatctcagttttcttgacatagttgtgaggataaagactctaatgatctcttatattataactggcctgagatagagacctttgaggatgttgacaggatgttcaggagttgtgattcgacatttggatttggacctggtaatgaagatgacctaggttggctttcatcatcagatgttattgaaggatctggagatggattgacgtctggttttaagtttccatgtccagcatccagtgcacttggaattacatccgctagtcatgaaacatcaaatccaaaggaaacgaacatttcaactgataattctggaactgagaatcaatcacttggctataatggcagtccgtggtcctcggagaaaaatgaatccgtgaatctgagtcatttgtcttatttaaatggatcaagtaatttagagtgcaaattagtacctgacaagaaggctgaggtacatggtggtggagtccaggtcgagattgcatctaacaaccaatcaagaatcaacaataatatagtgaatagcatgcaaaagaaacactccaagcaccagaatcgctctgagggtaaaagaaaatccggttatctagaaagtggagacacactcaattacactgatagccttccagaagagaaaaagttgccttctggagccgtaagcactcaagcgaatttcgcatctgcaggtgtcctccagcaaaagcaagctcaagatcctgattttggctacttgggtggtagcttctcttacatgcattcagattacggtcattcagatgggagtgctctccatccaactctaccaattttaaaatatgaaagcaacggtctcgtgtctctttcccccaaggactcttatgcatcaaatcaggtacagtccatggagggttctcctgatccttcttttcaggtggttggtatgacaagaaatgaaaaggtggataagttattcaatcagtctggagttaaggttgaaaataaccgtgattttgaaggggttggcataagtattcccactgaattaggatcctcagttgtacaggagtgctcttctataaattctgggttggatgaaatttcagaagaagcagctagttttcatcagcttcaacgtgtcatggaacagttggatataaggacaaagctatgtataagggatagcttataccggttggcccggagtgctgaacaaaggcataggcatgctaatctcaatattggctctggagatgatactactggaccactggttagcgaaggaacacacaagtgcacgggatatatagacatcgaaacagacacaaatcctatagatcgatctattgcacatttgctcttccacaggccttcagattcagctgttacccctgcccgtgattcctcgactttgaagtcgccttcaatgattcatgggtcgttgtctagcacaccagtgatgagtgagaacttgatctctcatggagaaattgcacctcaaacagatggagaagttgctgatcattgaccaaaatcatttaagaagcaaatggtgtgcggtctattttcagtttgtgggaggtttcacgtgcagaaattatcaagatctcttgcaagggacctttgtgttttcaatgtattctcggggactggtttctggtccatgtgagaacacatccttgtatgagctttcacaatcaagttattgtagtttcactcttaacctttccacactcggaaggcatacacaaacaactttttcctgtgtatacgtagattgaaccaactgactctttttgctttttgtaagtagataatacctggaaattttccggaagatatttgcgagtcttgaagtagctctcatggtctgttcaaaaaaaaaaaaaaaaagaaaagagcaccctgcttttctttctccgcgcgaaacacaaacaaacgaagggcaatcgttgccgccgatattcgccggcgggaaagtgacgtcatggaagcaccaataaagggaacagtgacttcactatcatcactgtttccggtagaagaagcacaaaaagcatcaaagcgcgtggaagaaagtataacggagcggcagaaacagctggaccagctccgagagttcgccgccgataacaatactctaattaacctagttcaacgactccccgaccagctccatcatgaaattatggttccgtttggtaaagctgcgttttttcctggccatttggttcacaccaatgagtttctggttcttctgggagag

SEQ ID NO: 1006 - DNA, 805 bp, Solanum phureja
tttatcttaaaaatatatatatgaaaatgaagaacctttcactcttatttctcactcatctcacactatttttcatttgtgtttgttcacaaaatatagcacaaacacaatttgtttataaatggtcagaaacttattgtaataaggatactccagtgggatgtacacaaattcctcctctcaaattcactttgaatggtttttggggaattaattccttgtcaagctacatgaaactgatttccgaaaggtccacagaaaaattattgctaattgaccgattttgatactgcgatggtaaataaactcagcctattttggccctccctcactaaacaagatccaaaagacatgtggaaggaagcttggaatacatatggaacatgtacaatagaaaggttcaaaactccaacacaatatttcaatagggcttcaagattggatagtgaaattggagatttattacaaagtcatttaataaactcaaatggaatagtcccttgtgactctgctacatacaacaatgttgaaatcttgaactcattcaaacaagtttcaaacaataaagatgtgtctttcacttgcaaagacattaatgcaactcattcttatttgaatcaagttacattttgctacacaaatgatgcaaaaaatttgtggattgtccaacttctgttactaacaaacgttgtcgtgttcaaaacattattgttcctcgtccttcacctccaaagcctattcaaacaacaggagaaaagcttggacccaatagcttatggagatccttggacctatgtgaagcttt

SEQ ID NO: 1007 - DNA, 925 bp, Solanum phureja
tcttttatcttaaaaaatatatgaaaatgaagaacctttcactcttatttctcactcatctcacactatttttcatttgtgtttgttcacaaaatatagtacaaacacaatttgtttataaatggtcagaaacttattgtaataaggatactccagtgggatgtacacaaattcctcctctcaaattcactttgaatggtttttggggcacagattccaatggaaatattcaacaaggttgtagagatccagaaacacgtgattggaacaaagtgtttgataaggcgatggaaaatcaactcaagtcattttggccctccctcactaaacaagatccaaaagacatgtggaaggaagcttggaatacatatggaacatgtacaatagaaaacttcaaaactccaacaaaatatttcaatagggcttcaagattggctaatgaaattggagatttattacaaagtcatttaataaactcaaatggaatagtcccttgtgactctgctacatacaacaatgttgaaatcttgaactcaatcaaacaagtttcaaaaaataaggatgtgtcttttacttgcaaagacattaatacaactcatgcttatttgaatcaagttacattttgctacataaatgatgcaaagcattttgtgaattgtccaacttctgttactaacaaacgttgtcgtgttcaaaacattattgttcctcgtccttcacctccaaaggtacgtgctttcttcgacattacaacaaaagagatatttagtgataataaatattctaatgattaagcaatgataactcttattcttgcatatgttaatatcttccattgaaaaatcagtcttaataggtagatcctatttgaatttgagtataggaatagtcaatctcttataatagtgacctttaatttaaagcc

SEQ ID NO: 1008 - DNA, 1689 bp, Solanum phureja
ggagagttggagaaccacatcagcagtatacgacaaggaagattttcagtgtacagtgtgagtatgtaatttataatcaagaaaattagcagtggtagagttatctctgagtttttcaaaatacaagaacaagtgcagagagcagagaggagggagggaggaagaagcaatggcggagtctcagttggttcaccctcctttattcacctatatctcaatgctcgctctgctcactttagtacccccttttgttattcttatgtggtatacaaatgttcatgctgatggatctgtattgcaaacatttaattatctaaaggagaatggcctgcaaggactaattgacatttggccaagacccactgcaattgcgggaaaaataataatttgctatgctctatttgaggctacacttcagcttttgttgcctggtaaaagggttcaaggaccgatatctccaactggacacaggcctgtctataaggcaaatggcatggcagcatatacagtgacactaattacctatctcagcctttggtggtttggaatattcaatcctacagtcgtgtatgatcatctgggagagattctctctacactaaattttggaagcttaatcttctgtctctttttatacataaaaggtcatgttgcaccatcttccactgatcacggttcatcagggaacataatagttgactactattgggggatggagttatatcctcgcattggcaaacactttgatatcaaggtcttcacaaactgcagatttggcatgatatcttggggactcctccctattacctactgtataaagcagtatgaagaatatggaagtctctctgattccatgcttatacataccataataacgttggtgtatgtcacgaaattcttttggtgggaagcaggttactggaacaccatggatattgctcatgacagagccggtttttacatatgctggggttgcttggtatttcttccatgtatgtacacttctcctggcatgtaccttgtcaaacatcctgtaaatcttggacctcagcttgcaatttctattctagtagctggtattctctgcgtttacataaactatgattgtgacagacagaggcaagagtttcgcagaacaaatggcaaagcccttgtctggggaaaggctccttcgaagattgttgcctcatacactactaccactggcgagactaaatccagccttctcctgacatctggatggtggggcttatcgcgacatttccattatgttccagaaatactagcttcatttttctggagtgttccagctcttttcaaccatatcatgccctacttctatgttatctatctgacgggcctccttttggatcgagccaaaagggatgacgaacggtgcaagtcaaagtatggcaaatactggaaaaagtattgcgaaaaggtgccttaccgggtagtacctggaatttattagtgtttcttgagcttcaactgatgaactgtctttaattagtgctgctgctactatattttcagttgtagtagtatttagaccatgaaatttttttctttcaataaaagcacttttagttgaaccaacatctcatttctatggttgtaagttgtaacacgatgaaaaagttagcttgaaatagatatgtcagtggaattagttgaggtgcgtgaaaa

SEQ ID NO: 1009 - DNA, 1674 bp, Solanum tuberosum
gcgacaaggaagattttcagtgtacagtgtgagtacgtaatttataatcaagaaaattagcagtggttgagttatctctgagcttttcaaaatacaagaacaagttcagagagcagagaggagggagggaggaagaagcaatggcggagtctcagttggttcaccctcctttattcacctatatctcaatgctcgctctgctcactttagtacccccttttgttattcttatgtggtatacaaatgttcatgctgatggatctgtattgcaaacatttaattatctaaaggagaatggcctgcaaggactaattgacatttggccaagacccactgcaattgcgggaaaaataataatttgctatgctctatttgaggctacacttcagcttttgttgcctggtaaaagggttcaaggaccgatatctccaactggacacaggcctgtctataaggcaaatggcatggcagcatatacagtgacactaattacctatctcagcctttggtggtttggaatattcaatcctacagtcgtgtatgatcatctgggagagattctctctacactaaattttggaagcttaatcttctgtctctttttatacataaaaggtcatgttgcaccatcttccactgatcacggttcatcagggaacataatagttgactactattgggggatggagttatatcctcgcattggcaaacactttgatatcaaggtcttcacaaactgcagatttggcatgatatcttggggactcctccctattacctactgtataaagcagtatgaagaatatggaagtctctctgattccatgcttatacataccataataacgttggtgtatgtcacgaaattcttttggtgggaagcaggttactggaacaccatggatattgctcatgacagagccggtttttacatatgctggggttgcttggtatttcttccatgtatgtacacttctcctggcatgtaccttgtcaaacatcctgtaaatcttggacctcagcttgcaatttctattctagtagctggtattctctgcgtttacataaactatgattgtgacagacagaggcaagagtttcgcagaacaaatggcaaagcccttgtctggggaaaggctccttcgaagattgttgcctcatacactactaccactggcgagactaaatccagccttctcctgacatctggatggtggggcttatcgcgacatttccattatgttccagaaatactagcttcatttttctggagtgttccagctcttttcaaccatatcatgccctacttctatgttatctatctgacgggcctccttttggatcgagccaaaagggatgacgaacggtgcaagtcaaagtatggcaaatactggaaaaagtattgtgaaaaggtgccttaccgggtcataccaggaatttattagtgtttcttgagcttcaactgatgaactgtctttaattagtgctgctgctactatattttcagttgtagtagtatttagaccatgaaatttttttctttcaataaaagcacttttagttgaaccaacatctcatttctatggttgtaagttgtaacacgatgaaaaagttagcttgaaatagatatgtcgtggaattagttgaggtgcgtgaaaaaaaaaaaaaataaac

SEQ ID NO: 1010 - DNA, 1684 bp, Solanum tuberosum
  misc_feature (1670)..(1670): n is a, c, g, or t
gcgacaaggaagattttcagtgtacagtgtgagtacgtaatttataatcaagaaaattagcagtggttgagttatctctgagcttttcaaaatacaagaacaagttcagagagcagagaggagggagggaggaagaagcaatggcggagtctcagttggttcaccctcctttattcacctatatctcaatgctcgctctgctcactttagtacccccttttgttattcttatgtggtatacaaatgttcatgctgatggatctgtattgcaaacatttaattatctaaaggagaatggcctgcaaggactaattgacatttggccaagacccactgcaattgcgggaaaaataataatttgctatgctctatttgaggctacacttcagcttttgttgcctggtaaaagggttcaaggaccgatatctccaactggacacaggcctgtctataaggcaaatggcatggcagcatatacagtgacactaattacctatctcagcctttggtggtttggaatattcaatcctacagtcgtgtatgatcatctgggagagattctctctacactaaattttggaagcttaatcttctgtctctttttatacataaaaggtcatgttgcaccatcttccactgatcacggttcatcagggaacataatagttgactactattgggggatggagttatatcctcgcattggcaaacactttgatatcaaggtcttcacaaactgcagatttggcatgatatcttggggactcctccctattacctactgtataaagcagtatgaagaatatggaagtctctctgattccatgcttatacataccataataacgttggtgtatgtcacgaaattcttttggtgggaagcaggttactggaacaccatggatattgctcatgacagagccggtttttacatatgctggggttgcttggtatttcttccatgtatgtacacttctcctggcatgtaccttgtcaaacatcctgtaaatcttggacctcagcttgcaatttctattctagtagctggtattctctgcgtttacataaactatgattgtgacagacagaggcaagagtttcgcagaacaaatggcaaagcccttgtctggggaaaggctccttcgaagattgttgcctcatacactactaccactggcgagactaaatccagccttctcctgacatctggatggtggggcttatcgcgacatttccattatgttccagaaatactagcttcatttttctggagtgttccagctcttttcaaccatatcatgccctacttctatgttatctatctgacgggcctccttttggatcgagccaaaagggatgacgaacggtgcaagtcaaagtatggcaaatactggaaaaagtattgtgaaaaggtgccttaccgggtcataccaggaatttattagtgtttcttgagcttcaactgatgaactgtctttaattagtgctgctgctactatattttcagttgtagtagtatttagaccatgaaatttttttctttcaataaaagcacttttagttgaaccaacatctcatttctatggttgtaagttgtaacacgatgaaaaagttagcttgaaatagatatgtcgtggaattagttgaggtgcgtgagaaaaaaaaaaagngaattccgtccgga

SEQ ID NO: 1011 - DNA, 1471 bp, Solanum melongena
acagtatgggtagttatatatcaaggaatacacatttctcttcagttattcaaaaaactagaacaattgcagagagcaaggagggaggaagaagcaatggcggagtctcagttggttcaccctccttggttcacctatatctcaatgctcactcttctcactatagtacccccttttgttattctcatgtggtatacaaatgttcatgctgatggatctgtattgcaaacatataattatctaaaggataatggcctgcaaggactaattgacatttggccaagacccactgcgattgcagggaaaataataatttgctatgctctatttgaggctgcacttcagcttttgttgcctggtaaaagggtccaaggaccgatatctccgacaggacacatacctgtctataaggcaaatggcatgctagcatatacagtgacactagttacgtatctcagcctttggtggttcggaatattcaatcctacaattgtatacgatcatctgggagagattctctctacactaaattttggaagcttagtcttctgtctcttcttatacataaaaggtcatgttgcaccatcttccactgatcatggttcatcagggaacataatagtcgatttctattgggggatggagttatatcctcgcattggcaaacactttgatatcaaggtcttcacaaactgcagatttggcatgatatcttggggagtcctccctattacatactgtataaagcagtatgaagaatatggacatctctctgattcaatgcttgtacactccataataacattggtgtatgtcacgaaattcttttggtgggaagcaggttactggaacaccatggatattgcacatgacagagctggcttttacatatgctggggttgtttggtatttcttccatgtatatatacttctcctggcatgtaccttgtcaaacatcctgtaaatcttggacatgagcttgcaattgctattctagtggccggtattctctgcgtatacataaactatgattgtgacagacagaggcaagagtttcgcagaacaaatggcaaagcccttgtctggggaaaagctccatcaaagattgttgcctcatacactactaccactggcgagactaaaaccagccttctcctgacatctggatggtggggcttagcacggcacttccattatgttccagaaatattagcttcatttttctggagtgtgccagctcttttcaaccatttcattccttacttctatgtaatctatctgacggtcctcctttttgatcgagccaaaagggatgacgaaaggtgcaagtcaaagtatggcaaatactggaaaaagtattgcgaaaaggtgccttaccgggtcatacccggaatttactagtgctgctgctgctactatattttgagttgtagtatgaataattttttcaataaaatacttttagttataa

SEQ ID NO: 1012 - DNA, 1670 bp, Solanum lycopersicum
gtacaacagatttttataattgagagaatctgagaagaggacctataccactgtggagagagtggagtaaacacagagcactaaaaatcagtgaattaaagtctacatataagtcaagattccatattgggcggagacttctgtagttccagtttttttcttcaaaaccccaaaatcagcaaaagctgaattgattgaggaagaagaagaagaagaaaaaatggtggagaacaagttggtacactctccattaatcacttatggatcaatgctcagtcttctatctttcacaccaccttttgtaatcctcatgtggtatacaaatgtgcacgctgatgggtctatcttgaaaacgttcaatcatctaagggaaaatggtttgcaaggattaattgatatttggccaaaacctactgcaattgctgggaagctaatcatttgttatgctctatttgaggcggcactacagcttctattgcctggtaaaacagtcgaaggcccaatatctccaactggacataggcctgtctataaggctaatggcatggcagcatatgcagtgacactgatcacatatatcagtctctggtggtttggaatatttaatcctgcaattgtttatgaccatctgggcgagattttctctacacttatttttgggagtttagtcttctgtgttttattgtacattaaaggtcatgttgcaccatcttccactgattccggctcatcagggaacataatagttgacttctattggggtatggagctttatcctcgtatcgggaaacacttcgatattaaagtcttcacaaactgcagatttggtatgatgtcttgggcagttcttgctgtcacgtattgcataaaacagcatgaagaatatgggcgtgtatctgattccatgcttgtaaatacgatattgatgttggtgtatgtcacaaaattcttttggtgggaagctgggtactggaacacaatggatattgcacatgacagagctggcttttatatatgttggggatgcttggtgtgggttccaagcatatatacgtctcctggaatgtatcttgttaaacaacctgtgaatcttgggcttcagctttccctttacatactagtggctggtcttctctgcatatatatcaactatgattgtgacaggcagaggcaagagttccggagaacaaatggaaaatgcactgtctggggaaagactccatctaagatagtcgccgcatacactactacctctggtgagaaaaagaccagccttctgcttacatcaggatggtggggcttagctcgccatttccactatgttccagaaatattagcggcatttttctggagtgtaccagctcttttcaaccacttcattccctacttctacgtcatctttctaataatcctccttctcgatcgagctaaaagggacgatgaccgatgcaaggcaaagtatggcaagtactggaaattgtattgtgaaaaggttccttacagagttatcccaggaatttactagtgatttttggacttctaagaatgttttactataaagtttgatgtattttgtagcctcttcatgttgttgtttgtatgtacacttattagttccaacagttttgagaaacttgtttttatataaaaatagtgaagacgcgagttga

SEQ ID NO: 1013 - DNA, 1686 bp, Solanum lycopersicum
ggtacaacagatttttataattgagagaatctgagaagaggacctataccactgtggagagagtggagtaaacacagagcactaaaaatcagtgaattaaagtctacatataagtcaagattccatattgggcggagacttctgtagttccagtttttttcttcaaaaccccaaaatcagcaaaagctgaattgattgaggaagaagaagaagaagaaaaaatggtggagaacaagttggtacactctccattaatcacttatggatcaatgctcagtcttctatctttcacaccaccttttgtaatcctcatgtggtatacaaatgtgcacgctgatgggtctatcttgaaaacgttcaatcatctaagggaaaatggtttgcaaggattaattgatatttggccaaaacctactgcaattgctgggaagctaatcatttgttatgctctatttgaggcggcactacagcttctattgcctggtaaaacagtcgaaggcccaatatctccaactggacataggcctgtctataaggctaatggcatggcagcatatgcagtgacactgatcacatatatcagtctctggtggtttggaatatttaatcctgcaattgtttatgaccatctgggcgagattttctctacacttatttttgggagtttagtcttctgtgttttattgtacattaaaggtcatgttgcaccatcttccactgattccggctcatcagggaacataatagttgacttctattggggtatggagctttatcctcgtatcgggaaacacttcgatattaaagtcttcacaaactgcagatttggtatgatgtcttgggcagttcttgctgtcacgtattgcataaaacagcatgaagaatatgggcgtgtatctgattccatgcttgtaaatacgatattgatgttggtgtatgtcacaaaattcttttggtgggaagctgggtactggaacacaatggatattgcacatgacagagctggcttttatatatgttggggatgcttggtgtgggttccaagcatatatacgtctcctggaatgtatcttgttaaacaacctgtgaatcttgggcttcagctttccctttacatactagtggctggtcttctctgcatatatatcaactatgattgtgacaggcagaggcaagagttccggagaacaaatggaaaatgcactgtctggggaaagactccatctaagatagtcgccgcatacactactacctctggtgagaaaaagaccagccttctgcttacatcaggatggtggggcttagctcgccatttccactatgttccagaaatattagcggcatttttctggagtgtaccagctcttttcaaccacttcattccctacttctacgtcatctttctaataatcctccttctcgatcgagctaaaagggacgatgaccgatgcaaggcaaagtatggcaagtactggaaattgtattgtgaaaaggttccttacagagttatcccaggaatttactagtgatttttggacttctaagaatgttttactataaagtttgatgtattttgtagcctcttcatgttgttgtttgtatgtacacttattagttccaacagttttgagaaacttgtttttatataaaaatagtgaagacgcgagttgagcaccatgaggtcac

SEQ ID NO: 1014 - DNA, 1593 bp, Vitis vinifera
ctgtaacagaggcactacagagagaggagagatggcggaggcgaagacggtgcactcaccggcgttgacgtacttttccatgatatcgcttctcactctctgccctcccttcgtcattctactatggtatacaatggttcactctgatggctctgtattgcaaacttgggactacctaaagcagcatggggtgcaaggattcatagacatctggccaaggccaactgcaattgcatggaaactaattgcttgttatgctgcatttgaagctgcacttcagctttttctacctggtaaaacagttgagggcccgatatctccttgtgggaatcggcctgtttacaaggcaaatggcatgcaagcatatgcagtaacattgattacttatctgagtctgtggtggtttggcatattcaaccctgcaattgtttatgatcatctgggagaaatatattcagcacttatttttggaagtttgatcttttgtattttcttatacataaaaggtcatgtggcaccatcttcgactgattctggttcatctggcaacataataatcgatttctattggggtatggagctgtatccccgaattggtaagaactttgacatcaaggttttcacaaactgccgatttgggatgatgtcttgggcagttcttgctgtgacctattgtataaagcagtatgaagagaatgggaaagtggcagattccatgcttgtaaatactatattgatgctggtatatgtaacaaagttcttttggtgggaagctggatactggaacacaatggatattgcacatgatcgagctggcttttatatttgttggggatgcttggtatgggttccatccatttacacttctcctggaatgtacctggtcaaccatcctgtgaaccttggaactcagcttgcgatttatattcttgcagccggaatcacatgcatatatataaactatgattgtgataggcaaaggcaagaattccgtagaacaaatggcaagtgcttggtttgggggaaagctccatcaaagattgtggcctcctacaccaccacttctggagaaacaaagtccagtcttcttttgacctcgggctggtggggtttgtcccgtcacttccattatgtacctgaaattttggctgcatttttctggacggtccctgctctttttggccattttctgccttatttctacgtgctgttccttactatccttctttttgaccgagccaaaagggatgatgatcgatgtcggtccaagtacgggaaatactggaaaaaatactgtgaaaaggttcgatacaggattatccctggaatctactgagatccatgacggattgagacccaacataggatcctgttttccctggttgccttggtcctcccagtgtcgtagcagcttgtctttgttgtattatgtcctttgagaattttgttgtttaaagctcatgtctccactctctctagttttattattatctgtgtcttcacctctgcaggagtcagggaggggtggatttatttcagaacgtggcctttttctgtgaatggaatcaaattcagatgaactgagttgcttca

SEQ ID NO: 1015 - DNA, 1545 bp, Mimulus guttatus
atattgagttgagaaacaactggcatctggttcactcagacgaagaagaagaaaggaagaaaggaagaaggaataatggggtcggagtcgaagatggtgcactcaccaatgatcacatacgcatcaatgctatcccttctctctctctgccccccttttgttattctcctatggtatactatggtacatgccgatggatctgtactgcaaacctgggattacctaaggcagcacggagttcagggattcatcaatttctggcctaaacccactgcaactgcatggaagatcattgcttgttatggggcttttgaggctgctcttcagcttttgctacccggtaaaagggttgaaggcccaatttcgcctactggaaataggcccgtctacaaggctaatggtgttttagcatatgcagtaacgctgattacatatcttggcctctggtggtttggaattttcaaccctacaatagtttacgaccatttgggagagatattttcagccctcatctttggaagccttgtcttttgtgttttcttgtatattaaaggtctggtggctccatcttcaactgattctggttcatcgggaaatataattattgatttctattggggaatggagctgtatccccgtattggcaagaactttgatatcaaagtttttacaaactgcagatttggaatgatgtcgtgggctgttcttgctgtgacgtattgcataaagcagtatgaaacatatggaactgtgtctgattctatgctggttaacacgatactaatgttggtgtacgtaacaaaattcttctggtgggaagctggatattggagcacaatggatattgctcatgatagagccggcttttacatatgctggggatgcttggtgtgggtcccatctgtgtatacttctcctggcatgtaccttgtcaatcacccagtaactcttggagttcagcttgctctgtatattcttgtagctggggttctgtgcatatatataaactacgactgtgacaggcaaaggcaagaatttcgcaggacaaacggcaaaggcttggtctggggaaaagcaccatctaagattgttgcctcatacaccaccactacgggtgagacaaaatccagcatcttacttacatcaggatggtgggggttagctcgtcacttccattatgtgccggaaatcttggcagccttcttttggaccctgccagctctctttaaccattttctgccttacttttatgtggtgttccttacaattcttctacttgatcgagctaaaagggatgatgatcgatgcaaatcaaagtacggcaaatactggaagttgtattgcgagaaggtcccttacagagtagtacctggaatttactgagaacaagggagggagggtgtgttgtaatttcgagattgtaacaaatggatctttccaatgtaacattagcttcacgtgttttgcaattaaactgccatttttaagttaagagcttcatttgaataaaattgctaattaattaaattaaatttgtagagagac

SEQ ID NO: 1016 - DNA, 1678 bp, Prunus persica
attcacattatctttttggtcgaacagggttggattcagattgaactgcccaaattaaaaaaaaccttaaaaagccatagttcttcagaggcagagagaaaatcagtctacactctcagactcatagagagatctgagagaatgggggagacgaataccgtacattcaccattggtgacatatgcttccatgttatcactgctttgtctttgccctccatttgtaattctactatggtatacgatggtacatgcagatggctctatttcccaaacttgggattacttaaagcatcatggtgtgcagggtttcattgaaatatggcccagacctactgccactgcctggaaaattattgcctgttatggtgcttttgaagctgcactccagctgcttttacctggaaaaagggttgagggcccaatttctccaacagggaatcgacctgtctacaaggcaaatggtatggcagcatattttgtaacattggctacccacctcggcctttggtggtttgggatattcaaccctacaattgtttatgaccatttgggagaaattttttcagcactcattttcggaagcttcattttctgtattctcctgtacataaaaggtcacctggcaccatcatccaccgattctgggtcttctgggaatgcaataattgatttctactggggaatggagctgtatcctcgaattggtaaaaactttgatatcaaagttttcacaaactgcagatttgggatgatgtcttgggcagttcttgctgtgacctattgcataaagcagtatgaagttaatgggacagtagctgattcaatgcttgtaaatactatattgatgctggtttatgtgacgaagttcttttggtgggaggctggatactggaatacaatggatattgctcatgatcgagcgggcttttatatttgctggggttgcttggtctgggttccatctatttatacttctcctggcatgtacctggtcaaccatcctgtaaatcttggaactcagctagcactttttattttggtggccgggattctttgcatatacatcaactatgattgcgacaggcaaaggcaagaatttcgcagaacaaatggcaaatgcttggtttgggggaaagctccatcaaagattgtcgcttcatacactaccacatctggggaaacaaagacaagccttcttttaacctcaggatggtggggtttatctcgtcatttccattatgtgccagaaatatcagctgcctttttctggactgttccagctcttttcaatcattttctaccttacttctacgtggtgtttcttaccatccttctacttgaccgagccaaaagggatgacgatcgatgtcggtccaagtacgggaaatattggaaactatattgtcagaaggtgtcctacagggtcattcctggcatctattgaagagtccaagtcctttatgcatcaagcgacgcctctcgttgagcttagtctttctactcgcagcccatctggtgaattggcaatgctatttatatcgtttcccttcaacttactttctcttgatttttaatgtaagtttggatgagttgtggtattagccaaggaaacgttagttatttatgatatagaatttcaggcttattttattggctctccaacttggatctaccag

SEQ ID NO: 1017 - DNA, 1744 bp, Castanea mollissima
ctctcatcagccaaaagagtttgagattcagagagaagttaaagagagagagagagagagagagagacagacagatagagagaatggcagagtccaagaccgtacactcaccgttgttgacattatttttccatgctatctctactcacactgtgtccaccctttgttatcttactatggtatacaatggtacatgctgacgggtctgtgtcccaaacttttgattacttgaagcagcatgggcttcagggactcatagatatatggccaagacccactgccactgcttggaaaattattgcttgttatgctgcctttgaggctgcacttcaacttcttctacctgggaaaagggttgagggcccaatatctccaatgggaaatcgacctgtttataaggcaaatggtgttgcggcatatgtagtgactttggttacctaccttggactttggtggtttgggatattcaaccccacagttgtgtatgatcatttgggagaaatattttcggcgcttatttttggaagctttgtcttttgtattttcttgtacataaaaggtcgtgtcgcaccatcttccactgattctggttcatgtggaaatgtaataatcgatttctactggggtatggagctgtatcctcgaattgggaaacattttgatataaaagttttcacaaactgcagatttgggatgatgtcatgggcagttcttgctgtgacatattgcataaagcagtatgaagttaatgggagagtggctgattctatgcttgtgaatactgtattgatgctagtctatgtttcgaagtttttttggtgggaagctggatactggagtaccatggatattgcacatgatcgagctggcttttatatttgctggggatgcttggtatgggttccatctatctatacttctccaggcatgtacttagtcaaccatcctgttaaccttggaactcagctagcactttatattctagtggcaggcattctttgcatatatatcaactatgattgcgacaggcaaaggcaagaatttcgcagaacaaatggaaaatgcttagtttggggaaaagctcctacaaagatagttgcctcatatactaccacatcgggggaaacaaaaaacagccttcttttaacctcaggatggtggggattatctcgtcatttccattatgtaccagaaatattatctgctttcttctggaccgtcccagctctctttaatcatttcctacctttcttctatgtgatatttcttactatccttctttttgaccgagcaaaaagggatgatgatcgatgtcggtccaagtacggaaaatattggaaagtattttgtgagaaagttccatacaggatcatccccgggatctactgatcatactaaaccattcttggaatctacggaataacattgtctctattgataataccaaaccctctatttgctttggcattcagtaccttatgatgatattgtatattgcttaactcatgctaggcttactttgcgaaagttgcttttggtgtgtactggtgatagtcttctagtacaatgtatgacgtgtattagtttctccaagtcttttctatgatctagggaggattagcttttactcgatgttaaagagacacttatgtggaattttgtctagatatcttatttggatcatttttctaatgtgtagtgatcaaattttagcaataaatcttcctcagttttattggtttgg

SEQ ID NO: 1018 - DNA, 1655 bp, Populus trichocarpa
agggaagcaaaattaggcaaatagtcaccctcctctctttcatcacaagtcacaagtatccttgtattcggagacccactagtttcagttcagtcgagtgcagacagaatggcagaaacgaagactgtgcattcgccgctggttacttatttttcaatgctttcacttctcactctctgccctccttttgttattctactatggtatacaatggtacatgctgatgggtcagtttgtcaaacttgggattacttgaagcaacatggcttgcaaggatttataaacatttggccaaggcctactgcaattgcctggaaaattattgcttgttatgcagcatttgaggctgcactgcagcttcttttacctggaaaaaaggtcgagggtccaatctctcctgaaggaaaccgacctgtttacaaggcaaatggtgtggcagcatatgtggtgactttagttacctatcttagcctttggtggtttggtatattcaacccctcgattgtttatgataatttgggagaaatattttctgctctcatttttggaagcttagtcttctgtgttttcttatacataaagggtcatttggctccatcatctactgattctggatcatctgggaacatgataattgacttctattggggtttggagctgtatcctcgaataggaaagaacttcgacatcaaagttttcacaaactgcagatttgggatgatgtcttgggctgttctggcattaacctattgcattaagcagtatgagcagaatgggaaagtagctgactccatgcttgtaaatacaatattgatgctggtgtacgtcacaaagtttttttggtgggaagctggttactggaacacaatggacattgcacatgatcgagctggattttatatttgctggggatgcttggtatgggttccatctgtgtatacttctcccggcatgtaccttgtaaaccatcctgtgaaccttggacttcagcttgcactctatatactagcagcaggcattctctccatatatgtcaattatgattgtgacaggcaaaggcaagaatttcgcagaacaaatggcaaatgtttggtctggggaagggctccatcaaagattgtggcctcatacactacaacatctgggcaaacaaagataagcctccttttgacatcgggatggtggggcttatctcgtcatttccattatgtacctgaaatactggctgcttttttctggactgtcccggctctttttaatcatttcttaccctatttctatgtgatatttctgaccatccttctgtttgaccgagctaaaagggatgatgatcgatgtcggtccaagtatgggaagtactggaagttgtactgtgagaaggttcgctacaggattgttcctggaatctactaagacatcacacattgaatggactggtttacctgtttatatctgctggtgaactcaagagtgcaatgtgcttattagcaccccttgaattgtataactcttgttaagtgcttttcaggtgcttcgatgtttggacaggatgtaaattttgctggtcaatgcacaatgtattttcagttcccattttccattgctcctctttctgggagttaaaaatagaggatcgcattccgaggggacctctt

SEQ ID NO: 1019 - DNA, 1608 bp, Solanum phureja
ccaaaaacaaaaaggaggtaaaacaccgaaaggagttgggggagaggaagatgaacttcctccgtagagtaatttccccaggctctcgttctcaagtttctcaatttgcgaataggtccttcaaaattacacaaaatcattatgggtccattgctcaacccacctcaagctccttggttcatggcattcatcaatttcattgcccagatgtggttggaatccttgcaaaactatcggattgcatagcatcaagggaaggaaatattctcagtgctgatatttttgttccagatgacaatcatgttttttactccagaagtgagtttctctttgaccctgctaaatggccacgagagcaaatggatgcagacttctctaatctagctaaaaagttcaatgcaatgaagtctgtcgttcgggtgcctgatagtgatcccaaatataatatttcaattctagcttcaaagcaggagcactgtcttgtggacttgttgcatggttggcaggatgggcggtttcctattcacataacttctgtaataagcaaccatgaacgaggtccaaacactcatgtgatccggtttcttgagaggcatgggattccatactattatttgccaacgactaaggagaataaaagagaagaagaaatcttggatatagttggggatactgactttttggttcttgctagatacatgcaggtattatctggagacttcttaaaaagctataagaaagatatcattaatattcaccatggcttgttgccgtcgttcaagggtagtaatccatctaagcaggcttttgatgctggcgttaagttgattggggcgacaactcacttcgttagtgaagaactagattcaggtccaatcattgagcaactggttgaaagagtttctcatagagataatttgcggacttttatacaaaagtctgaggatgttgagaaaaggtgtctagcaaaagcaatcaaatcatactgtgagctgcgtatttttccatatgaggcgaacaagactgttgtttttaggtcctgattagaaaggaagctgtgatagctgcatcaatctctttctattctgtccatcattcggtgataatggatatcatcgttatcactcaattatccaagtaaaacttccacacaggccactctgagaagtaaagacagagaaggtgacttgttcttagtaaaactaccagacaaaggaaattgtggaaaaaatgaaagagaaataaagaggtttcatctgatttcatgttgtaaattcgaagatttaaggcactgtcttgatatctttttccctcttatcacatgcagcagatatttgtacaagttccaaattctgttctttaatatcaaaagtgcctcaaagctgctttcaatggttatagaacttttaaaccttttgtcatttgaataatgtttttgggtactaatcatctggtggtatcagatgcccactggctcgattaatccaaatttccgtgctattaggatttctccatttccagggctcgaactatattagtgtatgccatttgaattatgttagtgtatgactctaagatgatgaatttcgaactccttttaaggtcaaa

SEQ ID NO: 1020 - DNA, 1601 bp, Solanum tuberosum
gaaggaggtaaaacaccgaaaggagttgggggagaggaagatgaacttcctccgtagagtaatttccccaggctctcgttctcaagtttctcaatttgcgaataggtccttcaaaattacacaaaatcattatgggtccattgctcaacccacctcaagctccttgattcatggcattcatcaatttcattgcccagatgtggttggaatccttgcaaaactatcggattgcatagcatcaagggaaggaaatattctcagtgctgatatttttgttccagatgacaatcatgttttttactccagaagcgagtttctctttgaccctgctaaatggccacgagagcaaatggatgcagacttctctaatctatctaaaaagttcaatgcaatgaagtctgtcgttcgggtgcctgatattgatcccaaatataagatttcaattctagcttcaaagcaggagcactgtcttgtggacttgttgcatggttggcaggatgggcggtttcctattcacataacttctgtaataagcaaccatgaacgaggtccaaacactcatgtgatccggtttcttgagaggcatgggattccatactattatttgccaacgactaaggagaataaaagagaagaagaaatcttggatatagttggggatactgactttttggttcttgctagatacatgcaggtattatctggagacttcttaaaaagctataagaaagatatcattaatattcaccatggcttgttgccatcgttcaagggtagtaatccatctaagcaggcttttgatgctggcgttaagttgattggggcgacaactcacttcgttagtgaagaactagattcaggtccaatcattgagcaactggttgaaagagtttctcatagagataatttgcggacttttatacaaaagtcggaggatgttgagaaaaggtgtctagcaaaagcaatcaaatcatactgtgagctgcgtatttttccatatgaggcgaacaagactgttgtttttaggtcctgattagaaaggaagctgtgatagctgcatcaatctctttctattctgtccattattcggtgataatggatatcatcgttatcactcaattatccaagtaaaacttccacacaggccactctgagaagtaaagacagagaaggtgacttgttcttagtaaaactaccagacaaaggaaattgtggaaaaaatgaaagagaaataaagaggtttcatctgaattcgtgttgtaaaattcgaagatttaagacactgtcttgatatctttttccctcttatcacatgcagcagatatttgtacaagttccaaattctgttctttaatatcaaaagtgcctcaaagctgctttcaatggttatagaacttttaaaccttttgtcatttgaataatgtttttgggtactaatcatctggtggtatctgatgcccactggctcgattaatccaaattcctgtgctattaggatttctccatttccagggctcgaactatattagtgtttgccatttgaattatgttagtgtatgactctaagatgatgaatttcaaattccttttaaggtcaaaat

SEQ ID NO: 1021 - DNA, 1601 bp, Solanum tuberosum
gaaggaggtaaaacaccgaaaggagttgggggagaggaagatgaacttcctccgtagagtaatttccccaggctctcgttctcaagtttctcaatttgcgaataggtccttcaaaattacacaaaatcattatgggtccattgctcaacccacctcaagctccttgattcatggcattcatcaatttcattgcccagatgtggttggaatccttgcaaaactatcggattgcatagcatcaagggaaggaaatattctcagtgctgatatttttgttccagatgacaatcatgttttttactccagaagcgagtttctctttgaccctgctaaatggccacgagagcaaatggatgcagacttctctaatctatctaaaaagttcaatgcaatgaagtctgtcgttcgggtgcctgatattgatcccaaatataagatttcaattctagcttcaaagcaggagcactgtcttgtggacttgttgcatggttggcaggatgggcggtttcctattcacataacttctgtaataagcaaccatgaacgaggtccaaacactcatgtgatccggtttcttgagaggcatgggattccatactattatttgccaacgactaaggagaataaaagagaagaagaaatcttggatatagttggggatactgactttttggttcttgctagatacatgcaggtattatctggagacttcttaaaaagctataagaaagatatcattaatattcaccatggcttgttgccatcgttcaagggtagtaatccatctaagcaggcttttgatgctggcgttaagttgattggggcgacaactcacttcgttagtgaagaactaaattcaggtccaatcattgagcaactggttgaaagagtttctcatagagataatttgcggacttttatacaaaagtcggaggatgttgagaaaaggtgtctagcaaaagcaatcaaatcatactgtgagctgcgtatttttccatatgaggcgaacaagactgttgtttttaggtcctgattagaaaggaagctgtgatagctgcatcaatctctttctattctgtccattattcggtgataatggatatcatcgttatcactcaattatccaagtaaaacttccacacaggccactctgagaagtaaagacagagaaggtgacttgttcttagtaaaactaccagacaaaggaaattgtggaaaaaatgaaagagaaataaagaggtttcatctgaattcgtgttgtaaaattcgaagatttaagacactgtcttgatatctttttccctcttatcacatgcagcagatatttgtacaagttccaaattctgttctttaatatcaaaagtgcctcaaagctgctttcaatggttatagaacttttaaaccttttgtcatttgaataatgtttttgggtactaatcatctggtggtatctgatgcccactggctcgattaatccaaattcctgtgctattaggatttctccatttccagggctcgaactatattagtgtttgccatttgaattatgttagtgtatgactctaagatgatgaatttcaaattccttttaaggtcaaaat

SEQ ID NO: 1022 - DNA, 1355 bp, Solanum melongena
aagaagaagatgaacttcctccgtagagtaatatccccaagctctcgttcccaaatttctgaatttgccaataggtccttcaaaacttcacaaaatcattatgggtccattgctcaatcaacctcaagctccttggttcatggcattcatcaatttcattgcccagatgtggttggaatccttgcaagactatcggattgcatagcatcaagggaaggaaatattctcagtgcggatatttttgttccagatgacaagcatgttttttactccagaagcgagtttctctttgaccctgctaaatggccacgagagcaaatggatgcggacttctctatgatagctaaaaagttcaacgcaatgaagtctgtcgttcgggtgcctgatattgatcccaaatataagattgcaattctagcttcaaagcaggaacactgtcttgtggacttgttgcatggttggcaggacgggcggcttcctattgacataacttctgtaataagcaaccatgaacgaggtccaaacactcatgtgatccggtttcttgagaggcatggaattccatactattatttgccaacgaccaaggagaataaaagagaaggagaaatcttggaaatagttaaggatactgattttttggtacttgctagatacatgcaggtattatctggagacttcttaaatagctataagaaagatatcattaatattcaccatggcttgttgccatcgttcaagggtagtaatccatctaagcaggcttttgatgctggtgttaagttgattggggcgacaactcacttcgttagtgaagaactagattcaggtccaatcattgagcaactggttgaaagagtttctcatagagataatttgcggacttttatacaaaagtctgaggatgttgagaaaagatgtcttgcaaaagcaatcaaatcttactgtgagctgcgtatttttccatatgaggcgaacaagactgttgtctttaggtcctgattgaaaaggaagtcacgatagctgcatcaatctctttcaattctttccatcattcagtgatcatggatatcatctttatcactcaggtatttaagttaaacttccacagaggcttctccgagaagtaaagacagagaaaggtgacttgttcttaatgaaactaccagaaaaaggaaattgtgggaaaaggaaagataaataaagaggtttcatctgaattcatgttgtaaaattcgaatgtttaagatattgtcttaaattactttccccttaatcagatgcagcaaatatttgtacaggttccaaattctgttctttctattaaaagtgcctcaaaactgatttcactggtt

SEQ ID NO: 1023 - DNA, 629 bp, Solanum phureja
ctaacttttaaaattatcaaaaaatgaaaactttcaagtgcaatttttacattctttttcttcttattcttcctcttatttttggatcacgttgtttagcaagagttcaagttcatattataaataggcttccagatggaatgccaatgactctccattgtcaatctcatgacaatgatttaggacaattaagattgacaggaggtgacgaagctaattggacttttagtgttaatttttggggtactactatgttttattgcgacgctcaatgggataatagttccatgacatatcgttttattacctatgatgctagtcgggatgcccgacgatgtcaaacggaatgctggtggatgatctctgaagaagaaacattgtatggttataatcaagagagtgaatactgggaattgtttcccttcacaagtgcatgaattctcctaatgatgcctattgtctccgcttgtttttaaaaaattatcaattttttgtgttcaagattaacaagatccaattatcattacttcgtgtcatgtaaggttgtttggtgattggcacatgtaacatgtacaaggcaatatgtaatgatatatagttacttttaattaaaatttcatcattgttgc

SEQ ID NO: 1024 - DNA, 613 bp, Solanum tuberosum
gcaaaaaatgaaaactttcaagtgcaatttttacactctttttcttcttattcttcctcttatttttggatcacgttgtttagcaagagttcaagttcatattataaataggcttccagatggaatgccaatgactctccattgtcaatctcatgacaatgatttaggacaattaagattaacaggaggtgacgaagctaattggacttttagtgttaatttttggggtactactatgttttattgcgacgctcaatgggataatagttccatgacatatcgttttattacctatgatgctagtcgggatgcccgacgatgtcaaacggaatgctggtggatgatctctgaagaagaaacattgtatggttataatcaagagagtgaatactgggaattgtttcccttcacaagtgcatgaattctcctaatgatgcctattgtctccgcttgtttttaaaaaattatcaatttttcgtgttcaagattaacaagatccaattatcattacttcgtgtcatgtaaggttgtttggtgattggcacatgtaacatgtacaaggcaatatgtaatgatatatagttacttttaattaaaatttcatcattgttgc

SEQ ID NO: 1025 - DNA, 1366 bp, Solanum tuberosum
aatagaaatctcattttcctaaaactccataaatggatgggaggggagggtgctgtattgctaggtacgcaggaggtgcgtacgatatgtcaaaagtggataggataatgcttaaattcagacctatcgcacctaaaccagcagcagccggtagttctgtttccggcactactactccaccacaaaagactgaggttccggttcgtactggacggtggaagagaaggtatgttaaggagaataataaaaatagtaataatagcaagagatctaatagcgggagtagtcctagtggtaggaaaaggaaagctccgtcgcctgaagaaaatgaatccagtgggaaaacggtgtctggtggagaaacggtagtaactcttccgttgttatcggagagccctgaaaggaaggatcgttcggttgacgtagtgaaaaaaaatgctccgatctggttgagttttggtgggaaccaagggaataataatggtcagttgcaggggtacggaggagtgatgtttcctcagccagtacaagtagtggggtcatgggtaaaggtggaaagcgtgacagacgcgtgggtggaagggtatgggctaggacgtacggatgaggaaaaactgataaatctggagcgggacagctgtccaggttttatatcagacggtttaaacagagtaaggtgggccaacaaggcgtataaggcgatggtgggtgaagggacaggggaagtggtggtttggctggtgatgaaagatgatgtacggctgccggataacaaatccacggcggcgttcacttgccgggttcgggttgtcaggtgcgggaaggagaagaactcattgattcttccgtgtgatgtgtggagaatggacggcggaggatttgcatggaggttggatacagaagcagctctttccttagggcggtacgtaattaaagtaatatcaactccacctgaagggtaaagaagtaaatctatatgccgaaccactaataatacttgccaccttgtgcttgtctacgtatagagaacatgcacacttgcatgtgcttttatcagaagaaaaattgtgaatatctttatgggtttagaactgttcttttttattttatttttcttggtttcttcaaggtggggtttggttggtggcggatttacttatgcctagttgtgtggtttatggagatcgatgtttgttagggatacttgttgaaatacagttactactagtagtcgtagttgaaccatggaaacagatcatgatcttgtaatctgactttgggcttttgttttcctgttttctaatttaacatctcacatattttgttcaactatttcactcaatcaatttatcattctccttaaaaa

SEQ ID NO: 1026 - DNA, 1366 bp, Solanum tuberosum
aatagaaatctcattttcctaaaactccataaatggatgggaggggagggtgctgtattgctaggtacgcaggaggtgcgtacgatatgtcaaaagtggataggataatgcttaaattcagacctatcgcacctaaaccagcagcagccggtagttctgtttccggcactactactccaccacaaaagactgaggttccggttcgtactggacggtggaagagaaggtatgttaaggagaataataaaaatagtaataatagcaagagatctaatagcgggagtagtcctagtggtaggaaaaggaaagctccgtcgcctgaagaaaatgaatccagtgggaaaacggtgtctggtggagaaacggtagtaactcttccgttgttatcggagagccctgaaaggaaggatcgttcggttgacgtagtgaaaaaaaatgctccgatctggttgagttttggtgggaaccaagggaataataatggtcagttgcaggggtacggaggagtgatgtttcctcagccagtacaagtagtggggtcatgggtaaaggtggaaagcgtgacagacgcgtgggtggaagggtatgggctaggacgtacggatgaggaaaaactgataaatctggagcgggacagctgtccaggttttatatcagacggtttaaacagagtaaggtgggccaacaaggcgtataaggcgatggtgggtgaagggacaggggaagtggtggtttggctggtgatgaaagatgatgtacggctgccggataacaaatccacggcggcgttcacttgccgggttcgggttgtcaggtgcgggaaggagaagaactcattgattcttccgtgtgatgtgtggagaatggacggcggaggatttgcatggaggttggatacagaagcagctctttccttagggcggtacgtaattaaagtaatatcaactccacctgaagggtaaagaagtaaatctatatgccgaaccactaataatacttgccaccttgtgcttgtctacgtatagagaacatgcacacttgcatgtgcttttatcagaagaaaaattgtgaatatctttatgggtttagaactgttcttttttattttatttttcttggtttcttcaaggtggggtttggttggtggcggatttacttatgcctagttgtgtggtttatggagatcgatgtttgttagggatacttgttgaaatacagttactactagtagtcgtagttgaaccatggaaacagatcatgatcttgtaatctgactttgggcttttgttttcctgttttctaatttaacatctcacatattttgttcaactatttcactctaacaacttatgattctcctttaaaa

SEQ ID NO: 1027 - DNA, 1333 bp, Solanum phureja
tcaaaagtttattactcttacaatagaaatagaaatctcattttcctaaaactccataaatggatgggaggggagggtgctgtattgctaggtacgcaggaggtgcgtacgatatgtcaaaagtggataggataatgcttaaattcagacctatcgcacctaaaccagcagcagccggtagttctgtttccggcactactactccaccacaaaagactgaggttccggttcgtactggacggtggaagcgaaggtatgttaaggagaataataaaaatagtaataatagcaagagatctaatagcgggagtagtcctagtggtaggaaaaggaaagctccgtcgcctgaagaaaatgaatccagtgggaaaacggtgtctggtggagaaacggtagtaactcttcccttgttatcggagagccctgaaaggaaggatcgttcggttgacgtagtgaaaaaaaattctccgatctggttgagttttggtggtaaccaagagaataataatggtcagtcccaggggtatggaggagtgatgtttcctcagccagtacgagtagtggggtcatgggtaaaggtggaaagcgtgacagacgcgtgggtggaagggtatgggctaggacgtacggatgaggaaaaactgataaatctggagcgggacagctgtccaggttttatatcagacggtttaaacagagtaaggtgggccaacaaggcgtataaggcgatggtgggtgaaggggcaggggaagtggtggtttggctcgtgatgaaagatgatgtacggctgccggataacaaatccacggcggcgttcacttgccgggttcgggttgtcagatgcgggaaggagaagaactcattgattcttccgtgtgatgtgtggagaatggacggcggaggatttgcatggaggttggatacagaagcagctctttccttggggcggtacgtaattaaagtaatatcaactccacctgaagggtaaagaagtaaatctatatgccgaaccactaataatacttgccaccttgtgcttgtctacgtatagagaacatgcacacttgcatgtgcttttatcagaagaaaaattgtgaatatctttatgggtttagaactgttcttttttatttagttttcttggtttcttcaaggtggggtttgagcggtgttgtgtggtttatggagatcgatgtttgttagggatacttgttgaaatacagttactactagtagtcgtagttgaaccatggaaacagatcatgatcttgtaatctgactttggggttttgttttcctgttttctaatttaacatctcacatattttgttc

SEQ ID NO: 1028 - DNA, 391 bp, Solanum phureja
aaggaatttaatcaaaatgagttcaagcaggagagcgtggatagtagcagccagtgttggagcagtggaagccttaaaagatcaagttggattgtgtagatgggattatccattgaagtgtttggcacaacacacaaagaataacataagatcttactctcaagctaagaaactttcttcttctctgattgcaaagagtgaaaagacagagcaatctgaagaatctctgagaaaagttatgtatttgagctgttggggtccaaattgaagattttaatagtgatgataggagacagtataaaatgtaaaattaggctatgattgtaaataggacatactgtactagttaagggcatgccatttcaaagataagcatgtatgtcgaaatctt

SEQ ID NO: 1029 - DNA, 460 bp, Solanum lycopersicum
aattcatcataaaaaaaactacaaaagaggggaaaaaaataaatcagaatgagttcaagcaggagagcctggattgtagcagccagtgttggagcagtggaagctttaaaagatcaagttggattgtgcagatgggattatccattgaagtgtttggcacaacacacaaagaataacatgagatcttactctcaagctaaaaaactttcatcttcactaattgcaaagagtgaaaatgcagagcaatctgaagagtctttgaggaaagttatgtacttgagctgttggggtccaaattaactaatctttgttagatagaaacttctatgtcatttttgcagacatgaagattttctagagcatagaaagaactgaaagggaaaaaaagttgtatgatattttagtactgttgatattttgatgaaatgataacatgacatgacagatagattagtatttc

SEQ ID NO: 1030 - DNA, 337 bp, Solanum phureja
gaaaaaaacaatcaaaatgagttcaagcaggagagcctggattgtagcagccagtgttggagcagtggaggctttaaaagatcaagttggattgtgtagatgggattacccattgaggtgtttggcacaacacacaaagaataacatgagatcttactctcaagctaagaaactttcttcttcacttattgcaaagagtgaaaaggcagagcaatctgaagagtctttgaggaaagttatgtacttgagctgttggggtccaaattaactaatctttgctatagagaaacttctatgtcatttttgcagacatgaagatttcctagagaatataaag

SEQ ID NO: 1031 - DNA, 297 bp, Solanum tuberosum
gggaagaaatttaatcaaaatgagtctaagcaggagagcgtggatagtagcagctagtgttggagcaggggaaggcttaaaagatcaagttggattgtgtaaatgggattatccattgaagtgtttggcacaacacacaaagaataacatgagatcttactctcaagctaagaaactttcttcttctctgattgcaaagagtgaaaagacagagcaatctgaagaatctctgagaaaagtaatgtatttgagctgttggggtccaaattgaagattttaatagtgatgataggagac

SEQ ID NO: 1032 - DNA, 492 bp, Solanum phureja
agtggctcatcactttctaggtactctctttatccaatttactcttcagctcactgcctatatattcagggcccttagccccaacttgtaaacatcatctcctaaatcatcaaatctactagcaaaagcagaaaaacagagttaaattttagaagaaattgaatcaaaatgagtctaagcaggagagcgtggatagtagcagccagtgttggagcagtggaagccttaaaagatcaagttggattgtgtagatggaattacccattgaagtcattggctcaacacacaaagaataacatgagatcttattctcaagccaagaaactttcttcttcattaattgcgaagaatgaaaaggcagagcaatctgaagaatcattgagaaaagttatgtatttgagctgttggggtccaaattgattgtaattaaataggactactgtctattttgaaaattatatgagaaaactccaatacggtgttgatatattt

SEQ ID NO: 1033 - DNA, 465 bp, Solanum phureja
caaaacaaaaacaaaaaaacagagaaccaaagcagaaaaacagagttaaattttagaagaaataaaatcaaaatgagtctaagcaggagagcgtggatagtagcagccagtgttggagcagtggaagccttaaaagatcaagttggattgtgtagatggaattacccattgaagtctttggctcaacacacaaagaataacatgagatcttatgctcaagccaagaaactttcttcttcattaattgcgaagaatgaaaaggcagagcaatctgaagaatcattgagaaaagttatgtatttgagctgttggggtccaaattgattgtaattaaataggactactgtctatttcgaaaattatatgagaaaacgtgttgatatatttgttgctttgatgacaaatcagctattccaatatttttgtatcacttcaatgaaatactatagtatatagtttttaaaa

SEQ ID NO: 1034 - DNA, 271 bp, Solanum phureja
aaaaaaaataatcaaaatgagttcaagcaggagagcttggattgtagcagccagtgttggagcaatggaggctttaaaagatcaagttggattgtgtagatgggattacccattgaggtgtttggcaaaacacacaaagaataacatgagatcttactctcaagctaagaaactttcttcattaattgcaaagaaagaaaaggcagagcaatatgaagagtctttgaggaaagttatgtacttgagctgttggggtccaaattaactaatc

SEQ ID NO: 1035 - DNA, 644 bp, Capsicum annuum
cgacttcagcctttatagcagatgcatcatcgtccttttgacgcttccaggagagaaattgagtttgtgttatgcgatttggatttgggtttgggtttgggtttgggttttgaattgattcttgtcctcgtgccgaattcggcacgaggaacaaagccaggaaaaagtagtaacattttagaagacatttaaaatcaaaatgagttcaagcaggagagcgtggatagtagcagcaagtattggagctgttgaagccttaaaagatcaagttggtttgtgcagatggaattacccattaaggtgtgtggcacaacacacaaagaataacataaggtcttactctcaagccaagaaactttcttcatcactaattgcaaacaaggcagaacaatctgaagaatctttgaggaaagttatgtacttgagctgttggggtcccaactaatcattttcaagatatatatatatatatatatatatatatcttcatggtcattttgcagacctgaagatttcaagccggaatagcatatagaaaaatatagtgctatgattgtaaataaataggactgtattttgaaactttcgcaagttaaatgaaaaactgcaatatatatgtggtgttgatgtttcgataaaaaaaa

SEQ ID NO: 1036 - DNA, 494 bp, Solanum lycopersicum
aaaccagcggcttattactttctagctaatctctttatccaatttactctttcactgcctatatattcagcccttattttagctctgaatttcaatcatcaccacaatcagagaagcaaagaagaaaaacagagataaattttagaaggaaaataaatcagaatgagttcaagcagaagagcgtggatagtagcagccagtgttggagcagtagaggccttaaaagatcaagttggattgtgtagatggaattacccattgaggtctttggcacaacacacaaagaataacgtgagatcttattctcaagctaagaaactttcttcttcaataactacaaagagtgagaagatggagaaatctgaagaatcattgagaaaagttatgtatttgagctgttggggtccaaattgattgtaattaaataggattactctgtatttcgaaaattatatcagaaaactgcaatacattgtgttgatatatttcgatga

SEQ ID NO: 1037 - DNA, 364 bp, Capsicum annuum
caaaattaaaacagaaaaaacagagctttttagaagaaaattaaaatgagtttaagcagaagagcatggatagtggcagccagtgttggagcagttgaagccttaaaagatcaagttggtttgtgcagatggaattacccattaaggtgtgtggcacaacacacaaagaataacataaggtcttactctcaagccaagaaactttcttcatcactaattgcaaacaaggcagagcaatctgaagaatctttgaggacagtcatgtacttgagctgttggggtcccaattgatcttccttttcatttttttttctagaaatttattgtaatttttgtagggctacgattgtaaatagaatggatt

SEQ ID NO: 1038 - DNA, 934 bp, Solanum lycopersicum
caagaaggcaacgtgggagggttgcaaaacacttcgggaatttggatttgaatgtggagttcagtaatgaggttgaggagcctataattcaaatgagccgagaaaatgaagcaggagagggagaagatgacactgttgaagtaattgggttttttgaaggtcttgatgaattccttagcagtcttcctatactcaatgctgtggatggtgataaagtagaggctgcctagctaagtaagacacttcttttgttgtagttgtagctataatttttgtcttctggatgctgtagttaagaatggtgtagaattactcgggcagtggtgttgatgtttctgttgtaatgctaatttcttacttttctcttccgaagtagctgcagtaatcagtttactgcttctatctccatgctccacgagcttcttattattagtcatcatagttttctttaaaaaaaaccacaatcagagaagcaaagaagaaaaacagagataaattttagaaggaaaataaatcagaatgagttcaagcagaagagcgtggatagtagcagccagtgttggagcagtagaggccttaaaagatcaagttggattgtgtagatggaattacccattgaggtctttggcacaacacacaaagaataacgtgagatcttattctcaagctaagaaactttcttcttcaataactacaaagagtgagaagatggagaaatctgaagaatcattgagaaaagttatgtatttgagctgttggggtccaaattgattgtaattaaataggattactctgtatttcgaaaattatatcagaaaactgcaatacattgtgttgatatatttcgatgaacttgttcctcttatgacaaattacatcacatccaccatgcttttaggaaataaatctaaatctgaaaatattatattccatg

SEQ ID NO: 1039 - DNA, 435 bp, Solanum melongena
atctcatcaaaaaccttcaaatctacaagcaatcaaaagatcatagaatcaatgagttcaagcaggagagcctggatagtagcagccagtgttggagcagtggaggccttaaaagatcgagttggattgtgtagatgggattacccattgaggcgtttggcacaacacacaaagaacaacataagatctttccctcaagctaagagactttcttcttcactaattgtagcaaagagggacaaggcagagcaatctgaagaatctttgagaaaagttatgtacttgagctgttggggtccaaattaaagacttttgtagtgaaaatatgtgttaggctatgattgtatataggaccatactacttaaggcatgccatttaaagataagcatgtatacttgtatgtgaaactctatatatgttgttgatttttcact

SEQ ID NO: 1040 - DNA, 562 bp, Petunia hybrida
gcatcaatctactaacatcaaaagatcagagaaacaaaagcaggatttagatatcaaacacaacacaaaacagaaacgaaaggtaccatttatttagaaggaaaacatcatgagttcaagcaggagagcatggatagtagcagcaagtgttggagcagtggaagccttaaaagatcaaggttttgcaagatggaattacccattgaagtgcttggctcagcacacaaagaataacatgagatcttattctcaagctaagaagctttcttcttcttcttcctcactcatttcaaggagtgacaaggcaaaacaatcagaagaatctttgaggaacgttatgtatttaagctgttggggtcccaactgatcctttttctagatacttcattgtcatttttgtagacctgaagatctttccagcgcaaaaaagagaaaaaaaaaaattgtatagggctatattagctatctatgattgtaaatagatgtttatggcattccacttcaaaagaagcttgtatttcgaaatgtttggtggaatacaattattataatttatagtctg

SEQ ID NO: 1041 - DNA, 540 bp, Petunia hybrida
tgagaaccaaaagcaacatttcatataccaaaaccaaagcaaaagagtttaagaagaaacacaacatgagttctagcagaagagcatggatagtagcagcaagtgttggagcagtggaagccttaaaagatcaaggttttgcaagatggaattacccattgaggtgcttggctcagcacacaaagaataacatgagatcttattctcaagctaagaagctttcttcttcttcttcctcactcatttcaaggagtgacaaggcaaaacaatcagaagaatctttgaggaacgttatgtatttaagctgttggggtcccaactgatcttcttttcagaaactcaatttcacatttttgcagggccaaaagaaagaaaaagtaaaatgtatggctatgattgtaaataaaatttcaagtcatgccacatcaagagaagcatgtattccgaaatcattcgaagaatatgacaagcaaactatgtaatatcgtcgatagcttgatgaaatgatgatctgattagttcaaccacatcccccacaaa

SEQ ID NO: 1042 - DNA, 656 bp, Nicotiana tabacum
tcttcagtactatcaaatctactactaggcactagcaatccaaaatttcagaaaagcaaaagcaagatttcatatatcaaaactcaagtagaaaaaagagtttttagaaagaaaaccatatatcatgagttcaagcaggagagcatggatagtagcagcgagtgttggagcagtggaagctttaaaagaccaaggtttttgtagatggaattaccctttgacgtcctttgctcagcacgctaagaataatatgagatcttactctcaagttaagaagctttcttctacttcttcctcctcactgattgcaaggagtgagaaggcaaagcaatctgaagagtctttgaggaaagttatgtacttgagctgttggggtcccaactgatcttattttcttcttcattagattccttcatcgtcatttttacagagacttgaagattttcaagttgaaaaagggggaaaaaaggaatatgatgtagaaaatgactgtaaatagaatataaaggcatgcgaccttacgattatatgtaaattatctatgagttactgcggaaattttgatgtcttaatgttttgatggatcaactatagtagtagtaatattttgcattacttcagcatgcttgcaataatgaagatggttttaaaatttg

SEQ ID NO: 1043 - DNA, 1426 bp, Solanum phureja
gtgaccgtgtcaaatgcgttgctcgtaaccctattttctctctcattttgccggactttcgatggatttcgtaaactccatttcaacagttacaagaccataccgccattctcgtttcttataaaactctatttctcaacaatttcaactcttattcccaatttcaactataatttgtcaaagatgtggagaaattcctgtaatctattgaaacggacagtttcatcggttgcgaggacaaatacgattaactatggggtgaacccgtttttgggtgtggattataagttcgggtgctattgtggcccgacccgaatggtgggtgggtactattttagctctgggtcaaatgggggtggggaaaacaagaatggggatagtattactcatgaggaagctaagaggttgatgagattggtgaatgttgaggagctgaagtggaaattggggatgaagaatacggaggttattgggtatatggatctgttaaaggcgtgtcagaatatgggtgtcgctaaaacccatgatgaagctgttggttttgctagagttcttgatgaggctggtgttatattgttattcagagataaagtttatcttcatcctgataaggtagtggatgaaattagaaaggcagttcccttagcacttctacctgaagatgaccccacaatagaggaactaaagattctgcaggagaagaaggataaaatagatgagcttgcccataggtatgtgcgccgcgttttgtgggctggtttaggggctggccttttgcaggtcgggctcttcttccgtcttacgttctgggaattctcttgggatgtgatggagccaattgctttttttacaacttctgctggaatagtaataggttatgcttacttccttgttacttctagagacccatcataccaagatgtgctgaagaggcttttcatctcaaggcagaggaagctgatcaagaagcatgattttgatattcagaggtttgtcgaattacaaaagaaaatcaaattaccagtgaatagtcaatcttccattaaacatcggttaggaatggagctggaacccgaggatcttttacatcgtcactaaatcatgttggcctctgatcctcttcctcccagcttctcacataattaaatccttactaaactcataccttttagccaatgtaagccctacattttgtcacggagggtgaatatctcagttgttaacaatcatccctgattttaccttgtaatttgaaggttatatttcttaaatcttctttacaagataggcttagatagtagttctgtccatcacaatatccttcaagccttttactctgctgttgttgtcctgttatatatacttgaaagttgtaacaagatactgatgttatattaatgacttttgaatgttcaatcttctggat

SEQ ID NO: 1044 - DNA, 1117 bp, Solanum tuberosum
gggtgtggattataagttcgggtgctattgtggcccgacccgaatggtgggtgggtactattttagctctgggtcaaatggcggtggggaaaacaagaatgggaatgggaatggggatagtattactcatgaggaagctaagaggttgatgagattggtgaatgttgaggagctgaagtggaaattggggatgaagaatacggaggttattgggtatatggatctgttaaaggcgtgtcagaatatgggtgtggctaaaacccatgatgaagctgttggttttgctagagttcttgatgaggctggtgttatattgttattcagagataaagtttatcttcatcctgataaggtagtggatgaaattagaaaggcagttcccttagcacttctacctgaagatgaccccacaatagaggaactaaagattctgcaggagaagaaggataaaatagatgagcttgcccataggtacgtgcgccgtgttttgtgggctggtttaggagctggccttttgcaggtcgggctcttcttccgtcttacgttctgggaattctcttgggatgtgatggagccaattgctttttttacaacttctgctggaatagtaataggttatgcttacttccttgttacttctagagacccatcataccaagatgtgctgaagaggcttttcctctcaaggcagaggaagctgatcaagaagcatgattttgatattcagaggtttgtcgaattacaaaagaaaatcaaattaccagtgaatagtcaatcttccattaaacatcggttaggaatggagctggaacccgaggatcttttacatcgtcactaaatcatgttggcctctgatcctcttcctcccagcttctcacataattaaatccttactaaactcataccttttagccaatgtaagccctacattttgtcacggagggtgaatatctcagttgttaacaatcatccctgattttaccttgtaatttgaaggttatatttcttaaatcttctttacaagataggcttagatagtagttctgtccatcacaatatccttcaagccttttactctgctgttgttgtcctgttatatatacttgaaagttgtaac

SEQ ID NO: 1045 - DNA, 1118 bp, Solanum tuberosum
gggtgtggattataagttcgggtgctattgtggcccgacccgaatggtgggtgggtactattttagctctgggtcaaatggcggtggggaaaacaagaatgggaatgggaatggggatagtattactcatgaggaagctaagaggttgatgagattggtgaatgttgaggagctgaagtggaaattggggatgaagaatacggaggttattgggtatatggatctgttaaaggcgtgtcagaatatgggtgtggctaaaacccatgatgaagctgttggttttgctagagttcttgatgaggctggtgttatattgttattcagagataaagtttatcttcatcctgataaggtagtggatgaaattagaaaggcagttcccttagcacttctacctgaagatgaccccacaatagaggaactaaagattctgcaggagaagaaggataaaatagatgagcttgcccataggtacgtgcgccgtgttttgtgggctggtttaggagctggccttttgcaggtcgggctcttcttccgtcttacgttctgggaattctcttgggatgtgatggagccaattgctttttttacaacttctgctggaatagtaataggttatgcttacttccttgttacttctagagacccatcataccaagatgtgctgaagaggcttttcctctcaaggcagaggaagctgatcaagaagcatgattttgatattcagaggtttgtcgaattacaaaagaaaatcaaattaccagtgaatagtcaatcttccattaaacatcggttaggaatggagctggaacccgaggatcttttacatcgtcactaaatcatgttggcctctgatcctcttcctcccagcttctcacataattaaatccttactaaactcataccttttagccaatgtaagccctacattttgtcacggagggtgaatatctcagttgttaacaatcatccctgattttaccttgtaatttgaaggttatatttcttaaatcttctttacaagataggcttagatagtagttctgtccatcacaatatccttcaagccttttactctgctgttgttgtcctgttatatatacttgaaagttgtaaca

SEQ ID NO: 1046 - DNA, 1654 bp, Arabidopsis lyrata
ccatatctccttctatccatctctccctctctcattcttcggcacaaagcataagacttgaaggaagcaaaatgagtttgtggtatatcattgttgccttcgtcttcttttcttctataatcattgtaaggaacacgagaacgacaaagacgaatctacctcctggaccaccaagacttcctataattggtaacttacaccaattgggatccaaacctcatcgctcgatgttcaaattatccgaaaagtatggatcgttaatgtctttgaagtttgggaatgtgtctactgttgtggcatctacaccagagacagtgaaggaagtcttaaaaacatttgacgtagaatgttgttcgcgaccatatatgacttatcctgcaagatttacatacaatttaaaagatctcggcttttctccctatagcacatattggagggaggtacgaaagatgactgttgttgaactctacaccgcaaaaagagtgaaatcatttcaacacacaagaaaagaagaagttgcttccctcgttgatttcatcaaacaagctgcgtcattggagaaatcggttaacttgaacaataagttaatgaaactagcaggaagtgtgatttgtagagttgcatttggtatcaatcttaaaggaagtaaacttgagaatacttatgaggaagtaattcaaggaacaatggaggttgtggggagtttcgcagcagcagattacttcccggtcattggtacaatcatcgataggatcacagggttacatagcaaatgtgagaagatttttaaggcaatggatgcattttttgatcaatctataaagcatcacctagaagatgagagtattaaagatgatatcactgccttgctcctcaagatggaaaggggggagactgggcttggggagtttcaacttactcgagaccacaccaaaggaattcttttcaatattctcaatgctggaatagacacttctgcacaagttatgacatgggtgatgacctatttgattgcaaacccaagagttttgaagaaagtgcaagccgaggtgagagaagtgataaaaaacaaagacgaaatcatagaagaagttatagaacgactcgaatatctaaaaatggtaattagagaaacgtttagggtattaccgctcgtgccacttctaattccaagagaggcttcaaaaaatttaaagatcggaggttatgacattcccaagaaaacatggatccatgtcaacatatgggctattcataggaatccaaacgtttggaaagatccagaagctttcatccccgaaaggtttatggatagcgagattgactacaaaggtttgaactttgagctgttgccgtttggtagtggaaggagaatgtgccctggtataggaatgggtatggctttggtacatttgactcttatcaatcttctctaccgatttgattggaagcttccagaaggaatgaaggtagaagatgttgatcttgaagaatcatatggacttgtatgtcctaagaaagtcccacttcagcttatcccggtccttacccaatggacttgattttatattatcatagttcaaaatgtaatcctttggaattatcttaaaggtcttatcattatcgtttatcaataaggaaattgttttatgaa

SEQ ID NO: 1047 - DNA, 1708 bp, Arabidopsis thaliana
acaacacaaagccacaaaacaatctctatcttatccatctaattttctttggtcatcactatcttatccatctctccctctctaattcatcaggacagagcataagaattgaaggtagcaaaatgagtttgtggtatatcattgttgcattcgtcttcttttcatctatgatcattgtaaggatcattagaaagacaaagaagaatctaccacccggacccccaagacttcctataattggaaacttgcaccaactaggatcaaaacctcatcgttcgatgttcaaattatccgaaacatatggacctctaatgtccctaaagtttggaagcgtgtctactgtggtggcatctacaccagagacagtgaaggaagtcttaaaaacatttgacgtagaatgttgttcgcgaccaaatatgacctatcccgcaagagttacgtacaatttaaaagatctatgcttttctccttatagcaaatattggagggaggtacgaaagatgacagttgttgaactctacaccgcaaaaagggtgcaatcatttcaacatacaagaaaagaagaagttgcagccctcgttgatttcatcaaacaagctgcttcattggagaaaccagttaacttgaacaagaagttaatgaaactatcaggaagtgtgatttgtagagttgcatttggtatcaatcttcaaggaagtaaacttgagaatacttatgaggaagtcattcaaggaactgtggagttggtggggagttttgcagcagcagattactttccggttgttggtagaatcatcgataggatcacagggttacatagcaaatgtgagaagcttttcaaggcaatggatgcattttttgatcaatctataaagcatcacctagaagatgagattattaaagatgatataattgacttgcttctcaagatggaaaggggagagactacacttggggagtttcaacttactcgcgaccacaccaaaggaattcttgccaatattctcaacgctggaatagacacttctgcacaagttatgacatgggtgatgacatatttgatttcaaacccaagagttttgaagaaagcgcaggccgaggtgagagaagtgataaaacacaaagatgatatcatagaagaagatatagaacgactccaatatctgaaaatggtaattaaagaaacgtttaggataaacccacttgtgccacttctaattccaagagaggcttcaaaagatgtaaagatcggaggttataatattccaaagaaaacatggatccatgttaatatatgggctattcataggaatccaaacgtttggaaagatccagaagctttcattcccgagaggtttatggatagccagattgactataaagggttgaactttgagttgttgccgtttggtagcggaaggagaatatgccctggtattggaatgggtatggccttggttcacttgactcttatcaatcttctttatcgattcgattggaagcttccagaaggaatgaaggtagcagatgttgatcttgaagaatcatatggacttgtttgtcctaagaaaatcccacttcagcttatcccggtccttacccaatggacttgatgttattttttcatatttcaaaatgtaacccttaggaagtatcttaaagttcttatcattattatatatgaataaagaaattatttgatgaataa

SEQ ID NO: 1048 - DNA, 1654 bp, Arabidopsis thaliana
atcactatcttatccatctctccctctctaattcatcaggacagagcataagaattgaaggtagcaaaatgagtttgtggtatatcattgttgcattcgtcttcttttcatctatgatcattgtaaggatcattagaaagacaaagaagaatctaccacccggacccccaagacttcctataattggaaacttgcaccaactaggatcaaaacctcatcgttcgatgttcaaattatccgaaacatatggacctctaatgtccctaaagtttggaagcgtgtctactgtggtggcatctacaccagagacagtgaaggaagtcttaaaaacatttgacgtagaatgttgttcgcgaccaaatatgacctatcccgcaagagttacgtacaatttaaaagatctatgcttttctccttatagcaaatattggagggaggtacgaaagatgacagttgttgaactctacaccgcaaaaagggtgcaatcatttcaacatacaagaaaagaagaagttgcagccctcgttgatttcatcaaacaagctgcttcattggagaaaccagttaacttgaacaagaagttaatgaaactatcaggaagtgtgatttgtagagttgcatttggtatcaatcttcaaggaagtaaacttgagaatacttatgaggaagtcattcaaggaactgtggagttggtggggagttttgcagcagcagattactttccggttgttggtagaatcatcgataggatcacagggttacatagcaaatgtgagaagcttttcaaggcaatggatgcattttttgatcaatctataaagcatcacctagaagatgagattattaaagatgatataattgacttgcttctcaagatggaaaggggagagactacacttggggagtttcaacttactcgcgaccacaccaaaggaattcttgccaatattctcaacgctggaatagacacttctgcacaagttatgacatgggtgatgacatatttgatttcaaacccaagagttttgaagaaagcgcaggccgaggtgagagaagtgataaaacacaaagatgatatcatagaagaagatatagaacgactccaatatctgaaaatggtaattaaagaaacgtttaggataaacccacttgtgccacttctaattccaagagaggcttcaaaagatgtaaagatcggaggttataatattccaaagaaaacatggatccatgttaatatatgggctattcataggaatccaaacgtttggaaagatccagaagctttcattcccgagaggtttatggatagccagattgactataaagggttgaactttgagttgttgccgtttggtagcggaaggagaatatgccctggtattggaatgggtatggccttggttcacttgactcttatcaatcttctttatcgattcgattggaagcttccagaaggaatgaaggtagcagatgttgatcttgaagaatcatatggacttgtttgtcctaagaaaatcccacttcagcttatcccggtccttacccaatggacttgatgttattttttcatatttcaaaatgtaacccttaggaagtatcttaaagttcttatcattattatatatgaataaagaaattatttgatgaataa

SEQ ID NO: 1049 - DNA, 1687 bp, Arabidopsis thaliana
aaaatgtgatgttttctagtggacgcttatataaatgtgcgattgtcacacagtgtcatctctccctctccgtctccctctttctaaaatctgcggcacaaagtatatgaattaagaaagcaacatgagtttgtggtatatcatagttgtgttcgtcttctttgcatctatattcattgcaaagaacacaagaaagacaaagaagaatctacctcccggaccaccaagacttcctataattggtaacttgcaccaattgggatcaaaacctcaccgttcgatgttcaaattatctgaaaaatatggacctctagtgtacctaaagcttggaaaggtaccgtctgttgtggcctcaactccagagacagtgaaggatgtcttgaaaacgtttgacaaagattgttgttcgcgagcttttttgacatatcctgcaagaatttcatacaatttgaaagatcttgcgtttgctccctatagcaaatattggaaggcggtacgaaagatgacggttgtcgaactctacaccgcgaaaagggtaaaatcgtttcgaaatataagagaagaagaagttgcctccttcgtcgagttcatcaaacattccgcttcgttggaggaaatagttaacttgaaccaaacgttagtgaaactctctgggagtgtaatttgtagagttggttttggaatcaatcttgaagggagcaaacttgagaatacttatgaggaagtcattcatggaaccatggaggtgctagggagttttgcagcatcagattacttcccggttattggtggaataatcgataggatcacggggttacataacaaatgtgagaaggtttttaagggaacagattcatttttcgaccattgtataaagcatcacctagaagatggtggtagtaaagatgatatagttgacttgctgctcaaggtagaaaggggagagattggacttggagagtttcaatttactcgaaaccacaccaaaggaattcttctagacattcttcttgctggagtagacacttctggccacacaataacatgggtgatgacacatttgattaaaaacccaagagttatgaagaaagcacaagccgaggtgagagaagtgataaaaaacaaagacaatatcacagaagaagatatagaaggactcgagtatctgaaaatggtggttaaagaaacattaaggataaacccacttgtgccacttctaactccaagagaggcttcaaaagatgtaaagatcggaggttataatattccaaagaaaacatggatccatgttaatatatgggctattcataggaatccaaacgtttggaaagatccagaagctttcattcccgagaggtttatggataaccagattgactataaagggttgaactttgagttgttgccgtttggtagcggaaggagaatatgccctggtattggaatgggtatggccttgatacacttgactcttatcaatcttctttatcgatttgattggaagcttccagaaggaatggaggttgaagatgttgatcttgaagaatcatatggacttgtctgtcctaagaaagttccacttgagctgatcccggtcctcactcaatggacttgattttatattattatagttcaagatgtaataatttggaaatatcttaaagttaaataaacaatcacttgagct

SEQ ID NO: 1050 - DNA, 1565 bp, Arabidopsis thaliana
aattcacttctacaaaatataaagtctctcccacagtgtaaactcttcctccacaaattttaaaggaagacaaaatgatttggtggtttatcgttggtgcatcctttttctttgcatttatactcattgcaaaggacacgagaacaacaaaaaagaatctacctccaggaccaccaagacttcctataattggaaacttgcaccaattgggatcaaaacctcagcgttcactattcaaattatctgaaaagtatggatctctaatgtctctaaagtttggaaatgtgtctgctgttgtggcatcaactccagagacggtgaaggatgtcttaaaaacattcgacgcagagtgttgttcccgaccttatatgacttatcccgcaagagttacatacaattttaacgatctcgcattttcgccctatagcaaatattggagggaagtacgaaagatgacggtcattgagctatacaccgcgaaaagggtcaaatcgtttcaaaatgtaagacaagaagaagttgcctcattcgttgatttcatcaaacaacatgcttcattggagaaaacagttaatatgaaacagaagttagtgaaactctctgggagtgtgatttgtaaagttggatttggcataagtcttgaatggagcaaacttgcgaatacttatgaggaagtcattcaaggaaccatggaggtggtggggcgtttcgcagcagcggattacttcccgattattggtagaatcatcgataggatcacggggttacatagcaaatgtgagaaggtttttaaggaaatggattcgttttttgatcaatctataaagcatcacctagaagatactaatatcaaagacgatatcattggtttgctactaaagatggaaaagggagagacaggacttggagagtttcaacttacacgaaaccacactaaaggaattcttctaaacgttcttatcgctggagtggacacttctggccacactgtgacatgggtgatgacacatttgattaaaaacccaagagttatgaagaaagcgcaagccgaggtaagagaagtgatcaaaaacaaagatgatatcacagaagaagatatagaacgactcgaatatttgaaaatggtgattaaagaaacattaaggatcaacccacttgtgccacttctgattccaagagaggcttcaaaatatataaagattggaggttacgacattccaaagaaaacatggatttatgtcaacatatgggctgttcaaaggaatccaaatgtttggaaagatccagaagttttcatcccagagaggtttatgcatagcgagattgactataaaggtgtagactttgagttgctgccgtttggtagcggaaggagaatgtgccctggtatgggattaggtatggcattggtacacttgactcttatcaatcttctttaccgtttcgactggaagcttccggaaggaatgaacatagaagatgttgatcttgaagaatcatatggacttgtttgtcccaagaaagttccacttcaacttatcccagtccttacccaatggacttga

SEQ ID NO: 1051 - DNA, 1084 bp, Brassica rapa
tattttatgattcctcagtctttaatagagagagaaagggagaagaaacgttaatcaatggcgtcgagaccgtgcgattcgtgcagatccgcggccgcgactctgttctgccgcgcggacgcggcgtttctctgcggcgaatgcgacggaaaaatccacacagctaacaaactcgcctcgcgccacgagcgagtcttgctctgccaagtctgcgagcaatctcccgcgcacgtcacgtgcaaagccgacgcagccgcgctctgcgtcacgtgcgaccgtgacatccactccgctaatccactctcccgccgccacgagcgcgtccccgtcacgcctttctacgacgctccttcaaatgctgacgttagcatggaggctgcgtcttggctcttgcgcaacccgagcgtcaaggaaggaggtgtagagatccctaacttgtttgctgatcttgattactcgggggttgatccgaagatggaggcgtcggagaatagctccggcaacgacggagtcgttcctgttcagaccagagctctgtttctcagcgaagattacttcaacttcgacatctcagcttccaaaacaactttcccacacggattcagctgcattaatcaaactgtttcgtcaacatcgttagatgtaccgttggtgcccgaaggtggagctgtggcggagatgtcaagaacgacggcagcaccagctctgcagctatctcctgcggagagagaggctagggttttgaggtatagggagaagaggaagaatcggaagttcgagaagactattaggtatgcatcacgtaaagcatacgccgaggtgaggccgaggattaaaggacgttttgctaagcgaactgattcaagagttaatgatggaggagaggtcggagtctacggcgggtttggagtggtcccgagtttctgagtctttcttcagtgtcatgttgtaagaaacattgatgatggtagctaaagtaacggttattagagaaatgtttaatagttgaaatgtttttttattaacgtcgaacaactgatatgtgtcactccaaaccatatcaatcagcaaatataaattataa

SEQ ID NO: 1052 - DNA, 1066 bp, Brassica napus
atgattcctctgtctttaatagagagagagtgaaagtgaagagagagagagagagaaacgttaatcaatggcgtcgagaccgtgcgattcgtgcagatccgcggctgcgactctgttctgccgcgcggacgcggcgttcctatgcggcgaatgcgacggaaaaatccactcagctaacaaactcgcctcgcgtcacgagcgagtctggctctgccaagtctgcgagcaatctcccgcgcacgtcacgtgcaaagccgacgcagccgcgctctgcgtcacgtgcgaccgagacatccactccgctaacccactctcccgccgccacgagcgcgtccccgtcacgcctttctacgacgctccttctgctcagggaggatcgtcatcggccgccaaatccgcctcctcctccgccaatttccttaacactgaagatgctgacgtcagcatggaggctgcgtcttggctattgcctaactcgagtgtcaaggaaggagttgtagagatcccaaacttgtttgccgatcttgattactcggcggttgttgatccgaagatggaggcgtcggagaatagctccggcaacgacggagtcgttcctgttcagaccaaagctctgtttctcagcgaagattacttcagcttcgacatctcagcttccaaaacaacattcccacacggattcagctgcattaatcaaactgtttcgtcaacatccttagatgtaccgttggtgcctgaaggtggagctgtggcggagatttcgagaacggcggcaacaccagccgtgcagctgtcaccggcggagagggaggctagggttttgaggtatagagagaagaggaagaatcggaagttcgagaagacgattaggtatgcatcacgtaaagcatacgccgaggtgaggccgaggatcaaaggacgttttgctaagcgaactgattcaagagttaatgatggaggagacggaggagtctacggtgggttcggagtggtcccgagtttctgagtcttgttcagtgtgttcttataagaaacattgatgatggtagctaaagtaacggttatt

SEQ ID NO: 1053 - DNA, 1103 bp, Brassica napus
  misc_feature (31)..(31): n is a, c, g, or t
  misc_feature (1045)..(1045): n is a, c, g, or t
tgggaccgggcccccctcgagactagttctntctttatagagagagagtgaaagtgaagagagagagagagagaaacgttaatcaatggcgtcgagaccgtgcgattcgtgcagatccgcggctgcgactctgttctgccgcgcggacgcggcgttcctatgcggcgaatgcgacggaaaaatccactcagctaacaaactcgcctcgcgtcacgagcgagtctggctctgccaagtctgcgagcaatctcccgcgcacgtcacgtgcaaagccgacgcagccgcgctctgcgtcacgtgcgaccgagacatccactccgctaacccactctcccgccgccacgagcgcgtccccgtcacgcctttctacgacgctccttctgctcagggaggatcgtcatcggccgccaaatccgcctcctcctccgccaatttccttaacactgaagatgctgacgtcagcatggaggctgcgtcttggctattgcctaactcgagtgtcaaggaaggagttgtagagatcccaaacttgtttgccgatcttgattactcggcggttgttgatccgaagatggaggcgtcggagaatagctccggcaacgacggagtcgttcctgttcagaccaaagctctgtttctcagcgaagattacttcagcttcgacatctcagcttccaaaacaacattcccacacggattcagctgcattaatcaaactgtttcgtcaacatccttagatgtaccgttggtgcctgaaggtggagctgtggcggagatttcgagaacggcggcaacaccagccgtgcagctgtcaccggcggagagggaggctagggttttgaggtatagagagaagaggaagaatcggaagttcgagaagacgattaggtatgcatcacgtaaagcatacgccgaggtgaggccgaggatcaaaggacgttttgctaagcgaactgattcaagagttaatgatggaggagacggaggagtctacggtgggttcggagtggtcccgagtttctgagtcttgttcagtgtgttcttntaagaaacattgatgatggtagctaaagtaacggttattagagaaatatttaatagtt

SEQ ID NO: 1054 - DNA, 1105 bp, Brassica oleracea
gatgattcctctgactttaatagagagagagaaagggagaagaaacgttaatcaatggcgtcgagaccgtgcgattcgtgcagatccgcggctgcgactctgttatgccgcgcggacgcggcgttcctatgcggcgaatgcgacggaaaaatccactcagctaacaaactcgcctcgcgtcacgagcgagtctggctctgccaagtctgcgagcaatctcccgcgcacgtcacgtgcaaagccgacgcagccgcgctctgcgtcacgtgcgaccgagacatccactccgctaacccactctcccgccgccacgagcgcgtccccgtcacgcctttctacgacgctccttctgctcagggaggatcgtcatcggccgccaaatccgcctcctcctccgccaatttccttaacactgaagatgctgacgtcagcatggaggctgcgtcttggctattgcctaactcgagtgtcaaggaaggagttgtagagatcccaaacttgtttgccgatcttgatactcggcggttgttgatccgaagatggaggcgtcggagaatagctccggcaacgacggagtcgttcctgttcagaccaaagctctgtttctcagcgaagattacttcagcttcgacatctcagcttccaaaacaacattcccacacggattcagctgcattaatcaaactgtttcgtcaacatccttagatgtaccgttggtgcctgaaggtggagctgtggcggagatttcgagaacggcggcaacaccagccgtgcagctgtcaccggcggagagggaggctagggttttgaggtatagagagaagaggaagaatcggaagttcgagaagacgattaggtatgcatcacgtaaagcatacgccgaggtgaggccgaggatcaaaggacgttttgctaagcgaactgattcaagagttaatgatggaggagacggaggagtctacggtgggttcggagtggtcccgagtttctgagtcttgttcagtgtgttcttgtaagaaacattgatgatggtagctaaagtaacggttattagagaaatatttaatagttaaaatgttttttattaacgtcgaacaactgatat

SEQ ID NO: 1055 - DNA, 1225 bp, Raphanus sativus
aaacaataaagatttagagagagaaagggagaagaaacatcaatcaatggcgtcgagactgtgcgactcgtgcagatccgcggccgcgactctgtactgccgcgcggacgctgcgtttctctgcggcgagtgcgacggaaaaatccacacggctaacaaactcgcctcgcgccacgagcgagtcttgctctgccaaatctgcgaacaagcccccgctcacgtcacgtgcgaagccgacgcagcagcgctctgcgtcacgtgcgacagagacatccactccgccaatccactctcccgccgccacgaacgcgtctccgtcacgcctttctacgacgctcctgctcagggaggatcaccggccaccaccaaatccgccgcctcctccaatttatttggcgaagatgctgacgtgagcatggaggctgtgtcttggctcttgcctaacccgagtgtcaaggaaggagtcgttgtggagatccctaacttgtttgccgatcttgattactcggcggttgatccgaagatggaggcgtcggagaatagctccgggaacgacggagtcgttcctgttcagacaaaagctctgtttctcaacgaagattacttcaacttcgatgtctcagcttccaaaacaacgtttccacacggatacagctgcattaatcaaactgtttcttcaacatcattagaggtgccgttggtgcctgaaggtggagctgtgacgacgacgacgactgcaacaccagccgtgcagctgtcaccggcggagagggaggctagggttttgaggtatagagagaagaggaagaatcggaagttcgagaagacgattaggtatgcatcacgtaaagcatacgccgaggttaggccgaggatcaaaggacgttttgctaagcggactgattcaagagttaatgatggaggaggaggtgttggagtctacggtgggttcggagtggtcccgagtttctgagtctttcttcagtgtcaagttgtaagaaacactgatgatagtaataagtaacggttttgataaaaaaagtactaataagtaacggtaaaacaaaattaaaaaaatggccttattacaagtcttgtttttgctagaatatttactggaccatagggaatattaaaaataattaatatgaaaaatatttatttaatgtaatattgttaaactatatcataagtcatgatagtgcctgaataaatttaatttatt

SEQ ID NO: 1056 - DNA, 1165 bp, Thellungiella halophila
  misc_feature (1150)..(1151): n is a, c, g, or t
gaatctcattaataaaataattataaaaaaacaaaaattagagagagagaatcatgtcgtcgtcgagactgtgcgactcgtgcaaatcggcggccgcgactctgttctgccgcgcggacgcggcgtttctctgcggcgaatgcgacggaaagatccactcggcgaacaaactcgcctcgcgtcacgagcgagtctggctctgcgaagtctgcgagcaagctccggcacacgtcacgtgcaaggcggacgcagccgcgctctgcgtcacttgcgaccgagacatccactccgcgaatccactctctcgccgccacgagcgcgtccccgtcacgcctttctacgacgcagctcccggaggaggatcggcgaaatccgcctcgtcagtcaatttcgtcgacgaagacgctgatgtcagcgtggaggctgcgtcttggctttttcctaatccgagtattaagtacggaggaggagagatccctaatttgttttcggatctagattactcggcggtggatccgaagatggaggcgtcggagaatagctccggcaacgatggagtcgttcctgtgcagaacaagttgtttctcaacgaagattacttcaatttcgatatctctacttccaaaacattcacacagggacccagctgcattaatcaaactgtttcgtcggcatcactagatgtagcgctggtgcctgaaggcggaggtatgacggagatatcgaacaccacgacgacgacgacggcgacaccagccgtgcaactgtcaccggcggagagggaggctagggtattgaggtacagagagaagaggaagaatagaaaattcgagaagacgatacggtacgcatcgcgtaaagcatacgagggagaggccgaggatcaaaggacgttttgcgaagcgaacggattcgagaagcaacgacggaggagacgtcggaatctacggcggattcggcgtcgtcccaagtttttgagtcttcactttcgatagtaacggttattagaaagattacgaattataatttataagaacatagtcgtctgaaaatcatttttcacaactagaattttcgatttaccctcactatatgttgtaatcggttgacctaaaaaattcaataaaatgtaatactctcttcaatcaanngaaagaaaaaaaaa

SEQ ID NO: 1057 - DNA, 970 bp, Brassica oleracea
ccctctcgaaacccagcatcagaaaaaaagaaagaaagcaaacagagaaaatgtgtggcggtgctgtaatttccgattttgcccctaacgtcaccaaggctaagggtaggaaactcacggcggaggaactctggtcagagctcgatgcttccgccgccgacgatttctggggtttccattccacatccaagactcaatccaccaaccaacaagtgacgttgaaagaggaggcggcggagaaggagaaggaaaaggagccggtgacggagaaaaggaggaagaggaagaacgtttacagagggatacgtaagcgaccgtggggaaaatgggcgtcagagattcgagatccaagaaaaggcgccagagtctggctcgggacgttcaacacggcggaggaagctgccatggcttatgacgttgcggcgaagcggatccgcggcgataaagccaaactcaacttcccagatcttctccaccatcctactcgtagtcctgcgactcctctagcatcgtctccagtttcagaagttcagcctccggcgaagaagcactgcgttgtctctcagagcgagttgactcagccgagtttcccggtggagtacagtggagtggggagcggggacgagtttcaactggactacgatctgaaacagcagatatcgagcttggagtcattccttgagctggatggtgacacggtggagcaaccgagtcagctcgacgagtccgtctccgaggtggatatgtggatgattgatgatgtcttcgcgtcgtatcagtaataaacgtaatataagtagaaatattaaataaagtttgtaatataactgccgttacgttctaaggtttgtaatgtgatgacatgagcgactgatgttattatatgttgtcgtttgtaatgtgtgttcttgtgactcatttggagcgttacatctacggtttatggtattgcttattctcttcttttttt

SEQ ID NO: 1058 - DNA, 949 bp, Brassica napus
gccctctcgaaactcagcatcagaaaaaaaaaaaaaaaaaaaaaagcaaacagagaaaatgtgtggcggtgctataatttccgattttgcccctaacgtcaccaaggctaagggtaggaaactcacggcggaggaactctggtcagagctcgatgcttccgccgccgacgatttctggggtttccattccacatccaagactcaatccaccaaccaacaagtgacgttgaaagaggaggcggcggagaaggagaaggagccggtgacggagaaacggaggaagaggaagaacgtttacagagggatacgtaagcgaccgtggggaaaatgggcgtcagagattcgagatccaagaaaaggcgccagagtctggctcgggacgttcaacacggcggaggaagccgccatggcttacgacgttgcggcgaagcggatccgcggcgataaagccaaactcaacttcccagatcttctccaccatcctcctcgtagtcctgcgactcctctagcatcgtctccagtgtcagaagttcagcctccggcgaagaagcactgcgttgtctctcagagcgagttgactcagccgagtttcccggtggagtgcagtggattcgggagcggggacgagtttcaactggactacgatctgaaacagcagatatcgagcttggagtcgttccttgagctggatggtgacacggtggagcaaccgagtcagctcgacgagtccgtctccgaggtggatatgtggatgattgatgatgtcatcgcgtcgtatcagtaaaaaacgtaatataagtagaaatattaaataaagtttgtaatataactgccgttacgttttaaggtttgtaatgtgatgacatgagcgactgatgttattatatgttgtcgttgttaatgtgtggcgccttcttgtgactcatttggagcgttacatttacggttt

SEQ ID NO: 1059 - DNA, 926 bp, Brassica rapa
  misc_feature (23)..(23): n is a, c, g, or t
  misc_feature (292)..(292): n is a, c, g, or t
  misc_feature (309)..(309): n is a, c, g, or t
ggaaactcagcatcagaaaaaanaaaaaaagaaagaaagcaaacagagaaaatgtgtggcggtgctataatttccgattttgcccctaacgtcaccaaggctaagggtaggaaactcacggcggaggaactctggtcagagctcgatgcttccgccgccgacgatttctggggtttccattccacatccaagactcaatccaccaaccaacaagtgacgttgaaagaggaggcggcggagaaggagaaggagccggtgacggagaaacggaggaagaggaagaacgtttacngagggatacgtaagcgnccgtggggaaaatgggcgtcagagattcgagatccaagaaaaggcgccagagtctggctcgggacgttcaacacggcggaggaagccgccatggcttatgacgttgcggcgaagcggatccgcggcgataaagccaaactcaacttcccagatcttctccaccatcctcctcgtagtcctgcgactcctctagcatcgtctcctgtgtcagaagttcagcctccggcgaagaagcactgcgttgtctctcagagcgagttgactcagccgagtttcccggtggagtgcagtggattcgggagcggggacgagtttcaactggactacgatctgaaacagcagatatcgagcttggagtctttccttgagctggatggtgacacggtggagcagccgagtcgactcgatgagtccgtctccgaggtggatatgtggatgattgatgatgtcatcgcgtcgtatcagtaaaaaacgtaatataagtagaaatattaaataaagtttgtaatataactgccgttacgttttaaggtttgtaatgtgatgacatgagcgactgatgttattatatgttgtcgttgttaatgtgtggcgccttcttgtgactcatttggagc

SEQ ID NO: 1060 - DNA, 986 bp, Brassica juncea
aaaagaaaaaagcaaacggagaaaatgtgtggcggtgctataatttccgactttgctcctatcgtcaccaaggccaagggtaggaaactcacggcggaggaactctggtcagagctcgatgcttccgccgccgacgagttctggggtttccattccacctccaagactcagtccaccaaccaacaagaagaggcggcggagaaggagaaggagccggcgacggagaaacggaggaagaggaagaacgtttacagaggcatacgtaagcgaccgtggggaaaatgggcgtcagagattcgagatccgagaaaaggcgccagagtctggctcgggacgttcaacacggcggaggaagccgccatggcttatgacgttgcggcgaagcggatccgcggcgataaagccaaactcaacttcccagatcttctccaccatcctcctcgtagtcctgcgactcctctagcatcctctccagtttcagaagttcagcctccggcgaagaagcactgcgttgtctctcagagcgagttgactcagccgagtttcccggtggagtgcagtggattcgggagcggggacgagtttcaactggactacgatctgaaacagcagatatcgagcttggagtctttccttgagctggatggtgacacggtggagcaaccgagtcagctcgacgagtccgtctccgaggtggatatgtggatgattgatgatgtcatcgcgtcgtatcagtaaaaaacgtaatataagtagaaatattaaataaagtttgtaatataactgccgttacgttttaaggtttgtaatgtgatgacatgagcgactgatgttattatatgttgtcgtttgtaatgtgtggcgccttcttgtgactcatttggagcgtcacatttacggtttgtggtattgttattttgttttcttttatggaaaatatatcatgctgtaaatacaaaatattgtaatcaaattataatcaagta

SEQ ID NO: 1061 - DNA, 1603 bp, Brassica napus
attcaaggaaggcggagaaagagattcattcattcggtaatggcagcttcaggcaccgtggcttctttcagaacctccgtttcttcctctccccaattgacccatttgagatccccctccaaagctctcaaatttacgcctctgccatcgtctcgcgcaaggccatcgttctccgtctcctgcaccatcgccaaggacccgcctgttctcatgtccgccggatctgacccgtctctctggcaacgacccgattcgttcggtcggttcgggaagtttggtggcaagtatgtccctgagacgctcatgcacgctctctccgagctcgaaacggcgtttcattctctcgccaccgacgatgatttccagagagagttggcggggatcttgaaagactacgtgggtagagaaagccctctgtatttcgcagagaggcttactgagcattaccgccgcgagaatggggaagggccgcttatatacttgaagagagaagacctgaaccacacaggagctcacaagatcaacaacgccgtggctcaggctcttctcgccaagcgtttggggaagaagaggattatcgctgagaccggagctggtcagcacggtgtggctacagctacggtttgtgctcgttttggtctggagtgcattatctatatgggtgctcaagatatggagagacaagcacttaatgtgttcaggatgcgacttcttggtgccgaggtgagagcagttcattctggaacagcaacgttgaaggatgctacttcagaagcgataagggattgggtgacaaatgttgagactactcattacatattgggatctgtggcgggtcctcacccttaccctatgatggtcagagactttcacgcggtgattggtaaagaaacgaggagacaagcgttggagaaatggggagggaagccggatgtgttggtggcttgtgttggtgggggttcaaacgcgatgggactcttccatgagtttgtgaatgacacagaggtccggttgatcggtgtggaagctgcgggattcggagtggatagtggtaaacacgctgctacgttgacaaagggagatgtgggtgttctacatggagctatgagttacttgctgcaagatgatgatggccaaatcattgaacctcactccatcagtgcaggattggactaccctggagttggaccggagcacagtttcctgaaagacatgggacgggctgaatactttagcgtaacggacgaagaagcgttggaagcgttcaagagagtatcgcggttagagggaatcattccagcactggagacctctcacgcactagctcacctcgagaagctatgtcccacgttaccggacggaagcagagtcgtgttgaacttcagcggaagaggagataaagatgttcagacggtagctaagtatcttgaagtttgataaaaataaagacccttttgtttgtttgtttttcttttaagtttaagacagtgaaatcttttttgtacttgtaatgtatttgtacttctaaacggtcgggacgtttccaaaataattggaaacagaaaaggactaagaagagaacaaagtttgaataaactgttct

SEQ ID NO: 1062 - DNA, 1627 bp, Brassica napus
  misc_feature (552)..(552): n is a, c, g, or t
  misc_feature (870)..(870): n is a, c, g, or t
ggatattcaaggaaggcggagatatattgactgagaaagagattcattcattcggtaatggcagcttcaggcaccgtggcttctttcagaacctccgtttcttcctctccccaattgacccatttgagatccccctccaaagctctcaaatttacgcctctgccatcgtctcgcgcaaggccatcgttctccgtctcctgcaccatcgccaaggacccgcctgttctcatgtccgccggatctgacccgtctctctggcaacgacccgattcgttcggtcggttcgggaagtttggtggcaagtatgtccctgagacgctcatgcacgctctctccgagctcgaaacggcgtttcattctctcgccaccgacgatgatttccagagagagttggcggggatcttgaaagactacgtgggtagagaaagccctctgtatttcgcagagaggcttactgagcattaccgccgcgagaatggggaagggccgcttatatacttgaagagagaagacctgaaccacacaggagctcacaagatcaacaacgccgtngctcaggctcttctcgccaagcgtttggggaagaagaggattatcgctgagaccggagctggtcagcacggtgtggctacagctacggtttgtgctcgttttggtctggagtgcattatctatatgggtgctcaagatatggagagacaagcacttaatgtgttcaggatgcgacttcttggtgccgaggtgagagcagttcattctggaacagcaacgttgaaggatgctacttcagaagcgataagggattgggtgacaaatgttgagactactcattacatattgggatctgtggcgggtcctcacccttacccnatgatggtcagagactttcacgcggtgattggtaaagaaacgaggagacaagcgttggagaaatggggagggaagccggatgtgttggtggcttgtgttggtgggggttcaaacgcgatgggactcttccatgagtttgtggatgacacagagatccggttgatcggtgtggaagctgcgggattcggagtggatagtggcaaacacgctgctacgttgacaaagggagatgtgggtgttctacatggagctatgagttacttgctgcaagatgatgatggccaaatcattgaacctcactccatcagtgcaggattggactaccctggagttggaccggagcacagtttcctgaaagacatgggacgggctgaatactttagcgtaacggacgaagaagcattggaagcgttcaagagagtatcgcggttagagggaatcattccagcactggagacctctcacgcactagctcacctcgagaagctatgtcccacgttaccggacggaagcagagtcgtattgaacttcagcggaagaggagataaagatgttcagacggtagctaagtatcttgaagtttgataaaaattagacccttttgtttgtttgtttttcttttaagtttaagacagtgaaaatcttttttgttcttgtaatctatttgtacttctacacggtcgggacgtttccaaaataattagaaacagaaaaggactaagaagtgaacaaagtttgaataaactgttctttagtt

SEQ ID NO: 1063 - DNA, 1608 bp, Brassica napus
aggcggacatatattgactgagaaagagattcattcattcggtaatggcagcttcaggcaccgtcgcttctttcagaacctccgtttcttcctctccccaattgacccatttgagatccccctccaaagctctcaaatttacgcctctgccatcgtctcgctcaaggccatcgttctccgtctcctgcaccatcgccaaggacccgcctgttctcatgtccgccggatctgacccgactctctggcaacgacccgattcgttcggtcggttcgggaagtttggtggcaagtatgtccctgagacgctgatgcacgctctctccgagctcgaaacggcgtttcattctctcgccaccgacgatgatttccagagagagttggcggggatcttgaaagactacgtgggtagagaaagccctctgtatttcgcagagaggcttacggagcattaccgccgcgaaaatggagaagggccgcttatatacttgaagagagaagacctgaatcacacaggagctcacaagatcaacaacgccgtggctcaggctcttctcgccaagcgtttggggaagaagaggattatcgctgagacaggagctggtcaacacggtgtggctacagctaccgtgtgtgctcgttttggtctggagtgcattatctatatgggtgctcaagatatggagagacaagcactcaatgtgttcaggatgcgacttcttggtgccgaggtgagagcagttcactctggaacagcaacgttgaaggatgctacttcagaagcgataagagactgggtgacaaatgttgagactactcattacatattgggatctgtggcgggtcctcacccttacccgatgatggtcagagactttcacgcggtgataggtaaagaaacgaggagacaagcgttggagaaatggggagggaagccggatgtgttggtggcttgtgttggtgggggttcaaacgcgatgggactcttccatgagtttgtggatgacacagagatccggttgatcggtgtggaagctgcgggattcggagtggatagtggcaaacacgctgctacgttgacaaagggagatgtgggtgttctacatggagctatgagttacttgctgcaagatgatgatggccaaatcattgaacctcactccatcagtgcaggattggactaccctggagttggaccggagcacagtttcctgaaagacatgggacgggctgaatactttagcgtaacggacgaagaagcattggaagcgttcaagagagtatcgcggttagagggaatcattccagcactggagacctctcacgcactagctcacctcgagaagctatgtcccacgttaccggacggaagcagagtcgtattgaacttcagcggaagaggagataaagatgttcagacggtagctaagtatcttgaagtttgataaaaattagacccttttgtttgtttgtttttcttttaagtttaagacagtgaaaatcttttttgttcttgtaatctatttgtacttctacacggtcgggacgtttccaaaataattagaaacagaaaaggactaagaagtgaacaaagtttgaataaactgttct

SEQ ID NO: 1064 - DNA, 1456 bp, Cucumis sativus
atctctttttctctctaaaaatggttgcctctacggcgctcaactgcaaaatccccaccttttctccctcctcttcccattcaaataacaagatttcttcttctacctctcactttcctgtccgtttccgccgagtttcctccaacccatcgccggtttttcggtcaaacgccgtctcctgcactttgactcgggagccgtcgctggcaatggaggacaaagttcatgattcgagtctgcaacagaggccggattcatttggccgttttggccgttttgggggaaagtacgtccccgagaccctaatgcacgcccttaccgagctcgaaactgctttctattcccttgctggggaccaagactttcagaaagagctggatggaattttgagagactacgtggggagagagagccctttgtacttcgcagagaggctgactgagcactatagacgttccaatggtgaggggcctcatattttcctgaagagagaagaccttaaccacacaggggctcacaaaattaacaatgctgttgcccaagctttgcttgctaagcgtttgggaaagaaacggattatagctgaaacaggcgcaggtcagcatggagttgcaactgcaactgtttgtgctagatttggactagaatgtatcatctacatgggtgcccaagatatggaaaggcaagctctcaatgtgttcagaatgcagcttcttggggctgaggttaggccagttcattctggtactgccacgctaaaggatgctacttcagaagctataagggactgggtgactaatgtggagactacccattatatcttaggatctgttgctgggccccacccatatcccatgatggtgagagattttcatgctgtgattggtaaagaaactagaaaacaggccttggagaagtggggagggaagccagatgtcctagtagcatgtgttggaggcggttcaaatgctatgggactatttcatgagtttgtcaatgacaaagatgttaggttggttggtgtggaggctgcaggttttggcttggatagtggtaagcatgcagccactctaaccaaaggggaagttggggttctacacggagcgatgagttatttactacaggatgatgatggacaaataattgaacctcactcgatcagtgcaggtttggattaccctggggttggaccagagcatagttatttgaaagatctaggccgtgctgagtatcacagtgtaactgatgatgaagcactggaagccttcaagagattggcacgactggagggcataatcccagctctggagacatctcatgctctggcttatcttgagaagttgtgtccgaccctcccagacggaacaaaggtcgtgcttaactgcagcggcagaggagataaggatgttcagacagcgatcaagtatttgcaagtttgatacatcaccatggctac

SEQ ID NO: 1065 - DNA, 1642 bp, Helianthus annuus
tgcaccagtatggttcagatcttccctcttgagatagaattcatccccaaacagtaaaacccccttataaaaatggcattctcttcctccaacataacttacagagccaccattaccaaaccctcatcttcaccttatcccagatctaacccttcacaatcatccctcacattcactaaagcttccaccttttcacccaaatccttctcagtttcttgtgtcatgacccaacaatccaccaattcatcggctgcggcggctgaaccggcgcttctccgccctgattcgctcggccggttcggtaagtttggagggaagtatgtgccagaaactctaatgtatgctttatcggaacttgagtctgcttttcatgccctagcaaccgaccatgaatttcagaaagagttagatggcatactaaaggattatgttggtagggaaagccctctttattttgctgaacggcttacagaacactataaacgtccaaacggtgaagggccagaaatctatctcaagagggaagatctgaaccatactggtgcacataagatcaacaatgcagtggctcaagctttgctggctaagaagctgggtaaagaacgaattattgcggaaaccggggctggccagcatggagttgcgaccgccactgtttgcgctcggttcgggttgaaatgcattatttatatgggtgctcaagatatggaaagacaggcacttaacgtgttcagaatgaaactacttggtgcagaggttagagcggttcattctgggacagccacattgaaagatgcaacatcagaagccataagggactgggtgacgaacgttgaaacaacccattacatactgggttctgtcgcgggcccacacccctaccccatgatggtacgcgagttccatgctgtaatcggcaaagaaacaagaaaacaagccttagaaaaatggggtggaaagcccgacgtgctggttgcttgtgttggtggcgggtcaaatgccatgggcctgtttcacgagtttgttgacgataaagatgtgagactcattggtgttgaggctgcgggtttcgggctggatagcggaaaacatgcagccaccttgacgaaaggtgaagttggtgtgttgcatggtgcgatgagctatttgttgcaggatgatgatggacagataattgagcctcattctattagtgcggggttggattacccgggagttggacctgagcatagctttctgaaagatttaggtcgtgctgaatattatagcatcactgatgcagaagcattggaagcctttaagagactatctagactggagggcataatcccagctttggaaacatcgcacgcacttgcgtatttggagaaactatgcccaacgctaccaaacggaaccaaagttgttctcaactgcagtggaaggggcgacaaagatgttcataccgccatcaaacatttgcaggtttgaagtagtcgacctcgaagacagttggatataccagaaaaccttatgcttacattatgctttagcagttgtttttttctgttgtatcagagaataaagatttcgtaaacagtttacaatatgaaatcagaatttgccgccctttctaatttctgaatcttttctgaatcttaaa

SEQ ID NO: 1066 - DNA, 1489 bp, Cucumis melo
attcaaataacaagatctcttcttctatccctcactttcctgtccgtttccggcgagtttcctccaacccatcgccgcttcttcgctcaaacgccgtctcctgcactttgactcgggagccgtcgctggcaatggaggacaaactccatactttgagtctgcaacagagaccggattcatttggccgttttggccgttttgggggaaagtatgtccccgagaccctaatgcacgccctcaccgagctcgaagctgctttctattcccttgctggggaccaagactttcagaaagagctggatgggattttgagagactatgtggggagagagagccctttgtactttgcagagaggctgactgagcactatagacgttccaatggtgaagggcctcatattttcctgaagagagaagaccttaaccacacaggggctcacaaaattaacaatgctgttgcccaagctttgcttgctaagcgtttgggaaagaaacggattatagctgaaacaggcgcaggtcagcatggagttgcaactgcaactgtttgtgctaggtttggactagaatgtatcatctacatgggtgcccaagatatggaaagacaagctctcaatgtgttcagaatgcggcttcttggggccgaggttaggccagttcattctggtactgccacactaaaagatgctacttcagaagctataagggactgggtgactaatgtggagactacccattatatcttaggatctgttgctgggccccacccatatcccatgatggtgagagattttcatgctgtgattggtaaagaaactagaaaacaggccttggagaagtggggagggaagccagatgtcctagtagcatgtgttggaggaggttcaaatgctatgggactatttcatgagtttgtcaatgacgaagatgttaggttggttggtgtggaggctgcaggttttggcttggatagtggtaagcatgcagccactctaaccaaaggggaagttggtgttctacatggagcgatgagttatttactacaggatgacgatggacaaataattgaacctcactcgatcagtgcaggtttggattaccctggggttggaccagagcatagttatttgaaagatctaggccgtgctgagtaccacagtgtaactgatgatgaagcacttgaagccttcaagagattgtcacgactggagggcataatcccagctctggagacatctcatgctctggcttatcttgaaaagttgtgtccgaccctcccagatggaacaaaggtcgtgcttaactgcagcggcagaggagataaggatgtccagacagcaatcaagtatttgcaagtttgatacatcaccatggctaccagtactggtaaaactagaggtcatttctcttggtggaagcttcgtctaaattgagttgttttccaatatgatgagatccaagcttgaagacaataaagtatacattacaa

SEQ ID NO: 1067 - DNA, 1698 bp, Artemisia annua
caccaacagttgtgacatacaacaaaaaaaaacaacttataaaacgaccgaacaatgttgtctttcatctcatccacaacaccaacaccaaccttaacaaacagaaccgccgtcttttctcaaaccgtatcctatacatctcaccaaaaccgggttttgttcatataaaccggtttgtgtcatttctgacaaatcaatgtcggcggttcatgttaatgatgaaccggcggcggttcatgagcggcctgatttatttggccggtttgggaaatatggtgggaagtatgtacctgagacattaatgtttgctttaactcagcttgaagctgcttttaaggctcttgctactgaccaccagtttcagaaggaattggatgggatattgaaggattatgttggtagggaaagccctctttattttgcagaaagacttaccgaacactataaacgtcccaatggtgaaggaccagaaatataccttaagagggaagatttaaaccatactggtgcacataagatcaataatgcggttgcacaagcgttgttggccaagaagttagggaaagagcgtatcattgctgaaactggtgctggtcagcatggagttgcaaccgcaactgtatgtgcgcggtttgggttgcagtgtattatttatatgggtgctcaagatatggaaagacaagctcttaacgtgttcagaatgcggctccttggagcagaggtcagagcagttcattcggggacagccacactaaaggacgccacatcagaggctatacgtgactgggtgaccaacgtggaaacaacccattatatcttaggttctgttgctggcccacatccctaccccatgatggtacgcgagttccatgcagtaattggtaaagaaacaagaaagcaagcattggaaaaatggggtggaaaaccagatgtgttggttgcgtgtgtaggtggaggttcaaatgctatgggcctatttcatgagtttgttgatgacaaagaagttaggttaattggtgtagaggctgcgggtcatggtttagatagtggaaaacatgcagcaacgttaacactaggtgaggttggagtgttgcatggggctatgagctatttgttgcaagatgacgatggtcaaatcattgagcctcactctataagtgctgggctggactacccaggagtgggacccgagcatagctttttgaaagacataggccgagccgaatatcatagcgtcaccgacgaggaagcattggaagcttttaagagactgtctagactagagggtataatcccagcacttgagacatctcatgcactcgcatatctcgagaaactgtgtccaactttacctaatggaaccaaggtcgtgctcaactgtagtggtagaggagacaaagatgttcatactgccatcaagtatctgcagctttgaaggtgttgccacaagagctaaagcatcataagagtcataaatttatcggaaaaaggttatgttgtatgttcttacttctcatattgaagataaacgtttctttatgggatttataatcacaatgttttgggaacttaatgaacttgcaacattttcttgtgctttcatggtttttttgttttgttttaaaagatatgactttactatgcccaggtgagtatgatcaatgccctaatgttagttttcggttctactgattaacc

SEQ ID NO: 1068 - DNA, 1686 bp, Solanum lycopersicum
agatttgcttaattttcacaaatcatccaaacatggccttctcctcaccgagcaaaatagctccaccgctaccgaagcctcaccgtttctcctccttatctcaatcgcaaatacccttcaaattcatcaaaattacgtcattacccactaaaccacctgccatagcttgtgtcctcaccggaaaatcaatggatgccaccgccgttcaacgacccgattcgtttggtcggtttggaaagttcggcggtaagtatgtaccggaaactctaatgcacgctcttgatgagctggaaaccgccttcaattcgctcgctacagaccaggactttcagaaggaactagatgggatattaagagattatgttggcagagagagccctctttattttgctgagcgacttactgagcattataaacgtccagatggtgaagggccaatgatctacctgaagagagaagatttaaaccacacgggtgcccacaaaatcaataatgctgttgcgcaagctttgcttgccaagcgcttgggaaagaaacgcattattgccgagacaggggctggtcagcatggtgttgccactgcaactgtttgtgctcggtttggtttggactgtgttatttatatgggtgctcaagatatggagaggcaagcattgaatgtcttcagaatgcgactgcttggagctgaggttagagcagtccactctggaactgctactctcaaggatgctacttcagaagctataagggattgggttacaaatgttgaaacaactcactacatacttggatctgttgcaggaccacacccttaccccatgatggttagggagttccatgcagtgattggtaaagaaacaaggaagcaatcattggaaaagtggggcgggaaaccagacgtgcttgttgcatgtgttggtggaggttcaaatgctatgggactctttcatgagtttgttgatgacaaagatgtgaggttgattggggttgaagcagcaggttttggtctagatagtagtaaacatgccgccactttgacaaagggtgaggtaggagtactgcatggagctatgagttatctactgcaagacgaagatgggcagattgttgagcctcattctatcagtgccggattggattacccaggagttgggccagaacacagctttttgaaagatctcggtagagcagaatattatagcatcacagatgaggaggctttggaagccttcaaaaggttatctcggttagagggtatcatccccgctctggaaacatctcatgctctcgcctacttagagaagctgtgtccaactctagcaaatggaactaaggtcgtgctcaactgcagcggtagaggcgataaagatgttcagactgctattaaatatttgaaggtttgatggaaaagttcgtaacacttgtcccaaagagttatctgtactttaaaggtaacttttctgttttatagcagaaacgaattttgtaagttaaataaagatgtcttgttagagctgtagattcatgaacccagaacccagttctattgatcgttaatcggtccacaaaatttcactttaatcggtcctctgatcgatcaatgtcaaacatgtatcgctaatttaggcatgctgtttatttgagccaaattctgggaggtttattaaccaaatgtgtgtttaaatg

SEQ ID NO: 1069 - DNA, 1727 bp, Mimulus guttatus
ccaaacatggccttctctgcatcgtcgtcttcttccgccgtaatttgcagaacccaaaccgacctccccataaatctccgttcgcgttcgcgttcgctcctctccccgaaattgaacagagtcggagcaaccttctgccgtccaattgtttgcaaaatggcggcgacggcggtcgagaaggaactcgatccggcggcggcagcggcggcgcctctgcagcggcccgattcgttcgggagattcgggaaatacggcggcaaatacgtccccgaaacgctgatgcacgctctcacggagctcgaggccgcattcaagttgcttgccactgacgatgaatttcagaaagagctagatgggatattgaaagactacgtaggaagagaaaccccactgtacttcgccgaacgactcaccgagcactacaaacgccccgatggaaaagggcctcacatttacctcaaaagggaggacctcaatcacaccggggcccacaagatcaacaacgctgtcgcccaagcgttgctggcaaagcgtctcggtaagaagcgtatcatcgctgaaactggagctggtcaacatggtgttgccacagctactgtttgtgctcggtttggcttggaatgcattatctacatgggtgctcaagatatggagagacaagcacttaatgtctttcgaatgaggcttcttggtgctgaggttagagcagttcattctggaaccgccacactaaaggacgccacatcagaagccatacgagattgggtaaccaacgtggaatccactcattacatcctcggatctgttgcgggcccacatccatatcctatgatggtaagagaatttcacgcagtgatcggcaaagaaacccgaaaacaggccctggaaaaatggggcggcacacctgatgtgcttgtcgcctgtgtgggtggaggctcgaatgcaatgggcctgttccatgaatttgttgacgacaaagatgtgaggctgatcggtgtcgaggcggctggtttcggattggacagtggtaagcatgccgccactttgactaagggagaggttggagttttgcacggagctatgagttacttgctgcaagatgaagatgggcaaatagtcgagccacattctataagtgctgggctggactaccctggagttggaccagagcacagctttctgaaagatattggaagggctgagtattatagcatcaccgatgatgaggctttagaagctttcaagagattatcgaagctcgagggaattattccagcactcgagacatcccacgcgttagcttatctagagaagctatgtccgactcttgcagacgggactaaagttgttttgaactgcagtggcagaggagataaagacgttcacacagccatcaaatatttaaagctttgaaagggtaccgttctgcaaaacagtgcttatcaactttatttgaatttgatttctttttttaaggtgaataattagtcgagtattgttccctggttgagaagatcctttttagttgtatgataggtgtcgtcatcgtaattttataactaaaaataaattccccaggaaagctaataagggggttttggttagcttcttgttaaagattgttttttttttatttaattttctttgaaactacagctgcgtttgaattgaacggttcgaaatcgacgattccgaattaatagtaacgaatttgttatgtttgtgtg

SEQ ID NO: 1070 - DNA, 1742 bp, Mimulus guttatus
acaaaaactcgtaatccaaacatggccttctctgcatcgtcgtcttcttccgccgtaatttgcagaacccaaaccgacctccccataaatctccgttcgcgttcgcgttcgctcctctccccgaaattgaacagagtcggagcaaccttctgccgtccaattgtttgcaaaatggcggcgacggcggtcgagaaggaactcgatccggcggcggcagcggcggcgcctctgcagcggcccgattcgttcgggagattcgggaaatacggcggcaaatacgtccccgaaacgctgatgcacgctctcacggagctcgaggccgcattcaagttgcttgccactgacgatgaatttcagaaagagctagatgggatattgaaagactacgtaggaagagaaaccccactgtacttcgccgaacgactcaccgagcactacaaacgccccgatggaaaagggcctcacatttacctcaaaagggaggacctcaatcacaccggggcccacaagatcaacaacgctgtcgcccaagcgttgctggcaaagcgtctcggtaagaagcgtatcatcgctgaaactggagctggtcaacatggtgttgccacagctactgtttgtgctcggtttggcttggaatgcattatctacatgggtgctcaagatatggagagacaagcacttaatgtctttcgaatgaggcttcttggtgctgaggttagagcagttcattctggaaccgccacactaaaggacgccacatccgaagccatacgagattgggtaaccaacgtggaatccactcattacatcctcggatctgttgcgggcccacatccatatcctatgatggtaagagaatttcacgcagtgatcggcaaagaaacccgaaaacaggccctggaaaaatggggcggcacacctgatgtgcttgtcgcctgtgtgggtggaggctcgaatgcaatgggcctgttccatgaatttgttgacgacaaagatgtgaggctgatcggtgtcgaggcggctggtttcggattggacagtggtaagcatgccgccactttgactaagggagaggttggagttttgcacggagctatgagttacttgctgcaagatgaagatgggcaaatagtcgagccacattctataagtgctgggctggactaccctggagttggaccagagcacagctttctgaaagatattggaagggctgagtattatagcatcaccgatgatgaggctttagaagctttcaagagattatcgaagctcgagggaattattccagcactcgagacatcccacgcgttagcttatctagagaagctatgtccgactcttgcagacgggactaaagttgttttgaactgcagtggcagaggagataaagacgttcacacagccatcaaatatttaaagctttgaaagggtaccgttctgcaaaacagtgcttatcaactttatttgaatttgatttctttttttaaggtgaataattagtcgagtattgttccctggttgagaagatcctttttagttgtatgataggtgtcgtcatcgtaattttataactaaaaataaattccccaggaaagctaataagggggttttggttagcttcttgttaaagattgttttttttttatttaattttctttgaaactacagttgcgtttggattgaacggttcgaaatcgatgattccgaattaatagtaacgaatttgttaagtttgtgtg

SEQ ID NO: 1071 - DNA, 1628 bp, Raphanus sativus
ggattcaaggaggaagggacatatatcgactgagaaagaaagagattcggtaatggcagcctcaagcaccgtcgcttctttccgaacctccgtttcttcagctccttccccatcctcttcccgaataacccatttgagatccccctccaaagctctcaaattcacacctctgccatcgtctcgctcaaggccatccttctccgtctcctgcaccatcgccaaggacccgcctgtcctcatgtccgacccgtctctctggcaacgacccgattcgttcggtcggttcgggaagtttggtggcaagtatgtccccgagacgctaatgcacgctctctctgagctcgaatctgcttttcattccctcgccgccgacgatgatttccagagagagttggctgggatcttgaaagactacgtgggtagagaaagccctctgtattttgcggagaggcttacggagcattaccgccgcgagaatggagaaggtcctcttatatacttgaagagagaagacctgaaccacacaggagcgcacaagatcaacaacgccgtggctcaggctcttctcgccaagcgtttggggaagaagaggattatcgctgagacgggagctggtcagcacggtgtggctacagctaccgtgtgtgctcgttttggtctggactgcattatctatatgggtgctcaagatatggagagacaagcgctcaatgtgttcaggatgcgacttcttggtgccgaggtgagaggagttcactctggaacagcaacgttgaaggatgctacatcagaagccataagagattgggtgacgaacgttgagactacacattacatattgggatccgtggcgggtcctcatccttaccctatgatggtcagagactttcacgcggtgataggtaaagaaacgaggagacaagcgatggagaaatggggagggaagccggatgtcttggttgcttgtgttggtgggggttcgaacgcgatgggactgttccatgagtttgtggatgatacagaggtcaggttgatcggtgtggaagctgcgggatttggagtggatagtggtaaacacgctgctacgttgacaaagggagatgttggtgttctacatggtgctatgagttacttgctgcaagatgatgatggtcaaatcattgaacctcactccatcagtgcaggattggactaccctggagttggaccggagcacagtttccttaaagacatgggacgagctgaatactttagcgtaaccgatgaagaagcgttggaagcgttcaagagagtttcgcggttagagggaatcatcccggcactggagacctctcacgcactagctcacctcgagaagctgtgtcccacgttaccggacggagctagagtggtcttgaacttcagcggaagaggagataaagatgttcagacggtggctaaatatcttgaagtttgaaaccttttgtttgtttgtttttaaaaaaaaaaatttaagacagtgaaatctttttgtatttgtaatctgtttgtacttctacatggtgggggacgtttccaaaataactggaaacagaaaaggactaagaagagagcaaaaatttgaataaactgttctttatttcctgcca

SEQ ID NO: 1072 - DNA, 1521 bp, Taraxacum officinale
atggccttctcactgacaaccccagctcccggaaccaccgccaccgccactgctactgccaccgtctccagctcatcctcttcactgtttctcaatccatatccctcacaactatccctccgattaaacaaatttggctccctttcaccgaagtcgttttcagtttcctgtgtccttgctaaacagtcaaccggtcaaatggagctcgggaagtcggcggtgattcaggatgggctgtctgttctccagcgccccgattcactcggccggtttgggaagtatggtgggaagtatgttccagaaaccctaatgttcgctctctccgagcttgaatcggcttttaaagccctcgctacggacgatgaattccagaaggaactagctggaatactaaaggactatgttggtagagaaagcccattatattttgcagaaagacttacagagcattataagcgtgataatggtgaagggcctgagatttatctgaaaagggaagatcttaaccacacaggtgcacataagataaataatgcagttgctcaagctttgttggctaagaaattagggaaaaaaagaataattgctgaaactggagctggacaacatggagtggcaactgcaactgtgtgtgcaagattttgggttggagtgtattatttatatgggtgctcaagatatggaaagacaagctcttaatgtgttcagaatgaagttacttggagcagaggtaagaccggtccactcaggaaccgcgaccctaaaagatgcgacatcagaagccatccgcgactgggtaacaaacgtggaaaccacccactacatcctgggctcagtcgcgggcccacacccgtaccccatgatggtccgcgagttccacgcggtcatcgggaaagaaacccgcaaacaagccatggagaaatggggcggaaagccggatgttttagtcgcgtgtgtaggtggcgggtcgaacgcgatgggtctgttccatgagtttgtggaggatacggaggtgagaatgattggagtggaggcggcggggttcgggatcgagagcgggaaacatgcggctactttgacgaaaggggaagttggggtgttgcatggggccatgagttatttgttgcaggatgatgatggccaaattatcgagcctcattccattagtgccgggcttgactacccgggagtgggacccgagcacagcttcttaaaagatttagggcgggctgaatactatagcatcactgacgaagaagcactcgaagcttttaagagactatcaagattagagggcataattccggctctagagacctcccatgcattggcatatttagagaaactgtgccctactttacctaatggcacaaaagttgttcttaattgcagtggtagaggtgacaaagatgttcatactgccattaagcatttgaagctttaaagatgtttggtagtttgtttgttttgttttagagataatcaccataagagtgatatataatatcggaaacattatgt

SEQ ID NO: 1073 - DNA, 1854 bp, Arabidopsis thaliana
gccctattctcaccaacctcttctgactcttctctcattttctgttgttcacaaataagttaacgtggtaccgaactaccgatttcctccactattttattgaatttctggtcaaaaaacttaagtgttacataacgaatctataaaaagaaccctcactttcaaggtttttgtcagcaaaacatttgtcttcgtgtttgaaagctagataaaagattcactaaatggccaccgcaagcaccgctgctactttcagaccctcctccgtttcagcttcttccgaattaacccatctgagatcaccctccaaactccccaaatttacgcctctgccatcggctcgctcacggtcctcttcttcgttctccgtctcctgcaccatcgctaaggacccagctgttgtcatggcggactcggagaagattaaggccgctggatctgatccgactatgtggcaacgacctgattcattcggtcgtttcgggaagtttggcggcaagtacgtccccgaaactctaatgcacgccctctctgaactcgaaacggctttctattcgctcgccaccgacgaagatttccagagagaattagcagagatcttgaaagactacgttggtcgggaaagtcctctttactttgcagagaggctcacggagcattaccgccgtgaaaacggtgaagggccgctcatatacctcaaaagggaagacttgaaccacaccggtgctcacaagatcaacaacgctgtggctcaggctcttctcgccaagcgtctaggaaagaaacgaattattgctgagacaggggctggtcaacatggtgtagccacagctactgtgtgtgcacgtttcggtttgcagtgcattatctacatgggtgctcaagacatggagagacaagctcttaatgtgttcagaatgcgtcttctcggtgctgaggtaaggggagtccactctggaacagccactttaaaggacgcaacttctgaagctataagggattgggtgaccaatgtggagactacacattacatattgggatccgttgcgggtcctcatccttatcctatgatggtcagagactttcacgcggtgattggtaaagaaacaaggaaacaagcgatggagaaatggggcgggaagcctgatgttctggttgcttgtgtcggtggtggttcaaatgctatgggactcttccatgaatttgtcgatgacacagaggttcgaatgattggtgtggaagccgctggatttggattggacagcggcaaacatgctgccacattgacaaaaggagatgtcggtgtactccacggagctatgagttacttgctgcaagatgatgatggccaaatcattgaaccacactccatcagtgccggattggactaccctggagtcggacctgagcatagtttccttaaagacgtgggaagggctgaatactttagcgttactgatgaagaagcattagaagctttcaagagagtgtctcggttggagggaataatcccggcattggagacatcgcacgcattggcccatctggagaagctttgtccgacgttacctgatggagccagagtggtattaaacttcagtgggagaggcgacaaggatgttcagactgcaatcaagtatctcgaagtttaaagagtgtagattactttcattttcacacagtgctatttcttttatgtagtttgttagttctccttgcttatggtcgggaatccaaaagtttggatcaaagggttaagaagagaataagtgttatgaatgtatcatataaataaaaatgttctatggaacgtttgatgttcttataagcaattcgaactgttttgttcttgac

SEQ ID NO: 1074 - DNA, 1667 bp, Arabidopsis lyrata
ttactttgaaaggatatttgaaggagaagaataatatatttgactcagagagattcattcagtaatggcagcctcaggcaccgctgctactttcagagcctccgtttcttctgctccttcttcttcttcttcccaattgacccatttgagatcatcacccttcaaagctctcaaatttacgcctctgccatcgtctcgctccaagtcatccttctccgtcacctgcactatcgccaaagacccgcctgttctcatgaccgccggatctgacccgaccctgtggcaacgacccgattcgttcggtcggtttgggaagtttggtgggaagtatgtacctgagactcttatgcacgcgctctctgagctcgaatcggctttctatgctctcgccaccgacgatgatttccagagggagttggcagggatcttgaaagactatgtgggtagggaaagtcctctgtattttgcagagaggcttacggagcattaccggcgcgagaatggcgaagggccgcttatatatttgaagagggaagacctgaaccacacaggtgctcacaagattaacaacgctgtggctcaggctcttctcgccaagcggttggggaagaagagaattattgctgagacaggagcgggtcaacatggtgtggctacagccactgtgtgtgcccgttttggtcttgagtgtattatctatatgggtgctcaagatatggagagacaagcactcaatgtgttcagaatgcgacttcttggtgccgaggtgagaggagttcactctggaacagcaacattgaaagatgcaacatctgaagcgataagagattgggtgacaaatgtggagactacccattacatattgggatctgtggcgggtcctcatccttaccccatgatggtcagagactttcacgctgtgattggtaaagaaacaaggagacaagcgttggagaaatggggcgggaagccagatgtcttggtggcttgtgtcggtggtggttcaaacgctatgggactcttccatgaatttgtaaatgacacagaggtccggatgatcggtgtggaagcagcgggattcggattggacagtggcaaacacgctgctacattgacaaagggagatgtcggtgttctccatggagctatgagttacttgctgcaagatgatgatggacaaatcattgaaccacactcaattagtgcaggattggactaccctggagtcggacccgagcatagtttttttaaagacatgggacgggctgaatactatagcataaccgacgaagaagcgttggaagcgttcaagagagtgtcgcggttagaaggaatcattccagcgctggagacctcacacgcactagcttacctcgagaagctgtgtcccacattatcggacggaacgagagtagtattgaacttcagcggaagaggagataaagatgttcagacagtggctaaatatcttgatgtttgaaagagaaacacttatgtttgttttttcagttattcaagacaatgaaatcctttttgtacttgtaatctgttaagtactttgcttctctctggtcacgacgtttccaacaaaattggaaatagaaaaagattacgaagagagcaaaacttgaataaatgtatcatgaataaaaaaaacatttcatatt

SEQ ID NO: 1075 - DNA, 1559 bp, Tropaeolum majus
attgacgagttgaaccaaaatctttgattcaatggccgcctctacctgcaatccacatgcttcttccttgcaaaagcccatttcttcttcatctagtctaattccttccagattgcccttcaattccaatacccttagctgtaagaaaccctccaaaaccccattttcggtctcttgtacactcacccgggatccaatggaagacaccaatggggtaattgacccgatccagtggcagagacctgattccttcggtcgatttggtaaatatggcgggaaatacgttcctgaaactctgatgtatgccctcacagagctcgaaaccgcctttaaggccctcgctagtgatgaagaatttcagacggagcttgcgggtattttgaaggactatgtgggtagggagaatcctctttatttcgcagagaggctaacagagcattacaagcgtcccaatggtgaagggccgcacgtgtatcttaagagggaagatcttaaccacacgggtgctcacaagatcaacaatgccgtcgcccaggctctacttgccaagcgtttgggtaagaagcggatcattgctgagaccggtgctggtcagcatggagttgcaacagctactgtctgtgcgcggtttggtttgccgtgcattatctacatgggcgctcaagatatggagagacaggcgctaaatgtgttcaggatgcgacttcttggggctgaggtcagaggggtccactctggtacagctaccctaaaggatgccacatccgaagctataagggactgggtgactaatgtggagacaacccattatatcttaggatccgttgctggccctcatccataccccatgatggtcagagatttccatgctattattggaaaggaaacaagaaaacaggcactggaaaaatggggtggtaaaccagatgtgttggttgcgtgtgttggtggaggatcaaacgccatgggtctgttccatgaatttgtcaacgacactgatgttaggatagttggagtggaggctgcaggttttggtttggatagtggaaaacatgctgccactttgactaagggggaaattggtgttctgcacggagctatgagctacttgttacaagacgaagatgggcagatagttgagccccattctattagtgcaggcttggattaccctggagttgggccagagcacagttttcttaaagatgcgggacgtgttgaataccacagtgttactgatgctgaagcattggaagcgtttaaaagattatcacgcttagagggcatcattccagctttggagacatctcatgcattggcacatcttgaaaagctttgcccaactctcccagatggaactaaagttgttctgtgctgcagtggaagaggtgacaaggatgtgcatacagcaatcaagcatttagatgtttagtgtttgtaataaagggtagtctcatccttccaccattgttgtagaggaagcaagagttgaagtgccttaactattatgctgttgtacgtttgaaattatctttttggtctaataaaattatccactg

SEQ ID NO: 1076 - DNA, 1589 bp, Solanum phureja
aattttcgatcacgttttaaattagcgcccctccagtagctctgcatattaggcggacatctccacctttaacatatactgatactgaactgaaccttcaatatctgctaatggatctcaattatctcttcatttctctcactccatcatggacttcggttgctatgttgatcggttattttctctatttagctaccgttggatctattctacccggaaaacttgttcctggggcgactttatctgatggaactcgactacattatcgttgcaatggtttgttatcacttctgttgttggttttgcttcttggagttgggtcgcagatgaatcttgtttcacctactgctatagcagatagaggacttgagcttttgtccacaacatttatctttagtgttcttgtgacattgatgctttatttggttggcctgaactcacgtgcaaagagttcatcactgaaacctcatgtctcaggaaatctaatccatgactggtggtttgggatacaactgaatcctgaattcatgggcattgatctcaaatttttctttgttagagctggtatgatgggatggttattaatcaatctttcagttcttgcaaaatgtgttatagaggctaaattaagccaatcaatgattctctaccagctattttgtgggctctacatccttgactacttcttctatgaagagttcatgacctccacatgggatataatagcagagaggttgggcttcatgctggtttttggtgatctagtctttataccgttcaccttcagtattcaggcatggttggtggcttttgagtaacaacgtggagctaacaacagcggcaataattgccaattgcctcgtctttcttattgggtactcggtgttcagaggagccaataagcagaagcatgtatttaaaaaggatcccaaggcaccaatatggggtagtcctccaaaagttattggggggaagttgcttgcttctggctattggggcattgcacggcactgtaattacctcggggacttgttactggcatcgtcttttagtttaccttgtggtataagctctgtggttccatacttttaccccatatatcttctcattctactcatatggagggagagaagggacgaagctagatgtgcggagaagtacaaagacgtgtgggctgaataccgtaaacttgttccttacaggatcttaccttatgtttactagctcaatcgtttgtccacgttgctgtgcattagagtcagaattagcctcaccgtaccgtactaccctagcaggagaagggacaagcacatgaatattaaatcaaatccgagcttttgccctatctatgcagctttctcatctcctctacggaagtaatcttttaatctatttcagttaggatcgacactgaatcgagttgtaagtgattgcttagtttttgaaagtttttcccgaaccaacttgtacactagatgtactttatcatggcaggatttaaattaaaacttatgtgcttcttgtattgaatgccaactatggaattacttcatatggttggttattaatgtgtcctgaattttaatgat

SEQ ID NO: 1077 - DNA, 1492 bp, Mimulus guttatus
aaaggcggaggctgtttgataaactggatcagcgaagctaggcggcacttgaaatcagtcgccgggaagtaaaaagaaggaagccggagagattggcgatggatctcaacgctcttctccacgccttcactccgtcatggacttcggtcgctatgctgatggcgtttttcacttacttggcgatcgccggatctattttaccgggaagagttgttcccggagcgactttatccgacggcactcgcctccattaccgctgcaacggttcgctattgcttatcttgttgatttctctacttggagtgggcggttggatggatcttgtatcacccactgcaattgctgacagaggatttgagcttttatcgactactcttatattcagtctatttgtgacgttacttctttacatcgctggctgcagatcccgcgatcagagttcttctctgaaacctcacattactggaaacttaatccatgactggtggttcggaatacagctgaatcctcagttcatcggaatcgacctgaagttcttctttgttagagctggtatgatgggatggcttcttataaatctttctgttcttgcgaaatgcattcaacaggtcaacttaagcgtatcaatgattctttaccagatattttgtgtgctatacattctggattacttcttttatgaagagtacatgacctccacatgggatataattgctgagagattggggttcatgctggtgtttggagatctcgtctggattcctttcacattcagtatccagggttggtggcttctaaacaacaacgtggagctaacaactgctgctattattgcaaactgtcttgcattcctaattggctatctagtctttagaggagctaacaagcagaagcatattttcaaaaagaaccccaaagcactaatatggggtagccctccaaaggtcatcgggggaaaattgcttgcttcgggttattggggaattgctaggcatagtaactatcttggagacttgttggttgctctatccttcagtttaccttgtgggataagttctccagttccgtatttttatcctatataccttttcattctgctaatatggagagagagaagagacgaagcccgatgtgcgcaaaagtacaaagaaatatgggcagagtacaggaaattggttccttggaggatacttccttatgtttattaacaagataacaatatttggtgttgtgcatcggtttttttttttctgtttttttggttctttttttccgggagtggaatgtagtagcagttcgatagatgaacatacgataggcggcttttggtggaatcttgaaccccaatcgaaattgcactaatttatccgaattgttctttcgaaattttcattgtttgcatctataattgtagacttgtctactcttgttacttgttgtaattttgttgaaaacatttttgaatcttgaattcttatgaaaagtcaaagta

SEQ ID NO: 1078 - DNA, 1364 bp, Triphysaria pusilla
ggcgcttcggcctgaaaaacccaactggcctcgttatttccgatatattccttttttctctattcagcacaagtcacaactcgctcactcacagtagttggtgacagtgtaactgaatctataattggccatggacctcaacgctcttcttcacgcctccactccttcatggacttcggtcgccatactgctgggattttttacttatttggcgattgttggatctattttaccggggaaaattgttcccggggcgactttatcagacggcactcggctccattaccggtgcaacggttttttattgcttgtcttattggtatgtttacttggagttggcggttggatggatcttgtatcactcactgcgattgctgatagagggctcgagctgttttcaacaacattaatattcagtgtaattgtgacattggttctttacgtggctggttgcagatctcgtgctcagagttcttctttgaaacctcacatcagtgggaacttaatccatgatgggtggtttgggatacagctgaatcctgagttcatgggaatcgatctcaagttctactttgttagagctggtatgatggggtggcttcttataaacctttccgttcttgcgaaatgcattcaagagaccaacttaagccaatcaatgactctttaccagatattttgccttatatatgtgctggattactttttatatgaagagtatatgacctccacatgggatataattgctgagaggttggggtttatgctggtgtttggagatctagtctggatcccgttcacattcagtatccagagctggtggcttctaaataatgaagtggagcttacaactgctgggattattgcaaactgcctcgtctttctgattggctatatggtctttagaggatctaacaagcagaagcatgatttcaaaaagaatccaaaagcactaatatggggtagacctcctaaggtcattggtgggaagttgcttgcttctggttattggggcattgccaggcatagcaactaccttggtgacttgttgctagctctttcctttagtttgccttgtgggataagttctccggtcccatatttttatccaatataccttttcattctactattatggagagaaagaagagacgatgctcggtgtgcacagaagtataaagaaatatgggcagagtacaccaaattggttccttggaggatacttccatatgtttattaagagccaacctctggatgttgtataacttgtattgtctaacactggttgagtgttatttttaattttatattttttcgaattggaatatatattgcggggaaaaagtttggatggtgagtggaaa

SEQ ID NO: 1079 - DNA, 1383 bp, Mimulus guttatus
aaaggcggaggctgtttgataaactggatcagcgaagctaggcggcacttgaaatcagtcgccgggaagtaaaaagaaggaagccggagagattggcgatggatctcaacgctcttctccacgccttcactccgtcatggacttcggtcgctatgctgatggcgtttttcacttacttggcgatcgccggatctattttaccgggaagagttgttcccggagcgactttatccgacggcactcgcctccattaccgctgcaacggttcgctattgcttatcttgttgatttctctacttggagtgggcggttggatggatcttgtatcacccactgcaattgctgacagaggatttgagcttttatcgactactcttatattcagtctatttgtgacgttacttctttacatcgctggctgcagatcccgcgatcagagttcttctctgaaacctcacattactggaaacttaatccatgactggtggttcggaatacagctgaatcctcagttcatcggaatcgacctgaagttcttctttgttagagctggtatgatgggatggcttcttataaatctttctgttcttgcgaaatgcattcaacaggtcaacttaagcgtatcaatgattctttaccagatattttgtgtgctatacattctggattacttcttttatgaagagtacatgacctccacatgggatataattgctgagagattggggttcatgctggtgtttggagatctcgtctggattcctttcacattcagtatccagggttggtggcttctaaacaacaacgtgagctaacaactgctgctattattgcaaactgtcttgcattcctaattggccatctagtctttagaggagctaacaagcagaagcatattttcaaaaagaaccccaaagcactaatatggggtagccctccaaaggtcatcgggggaaaattgcttgcttcgggttattggggaattgctaggcatagtaactatctaggagacttgttggttgctctatccttcagtttaccttgtgggataagttctccagttccgtatttttatcctatataccttttcattctgctaatatggagagagagaagagacgaagcccgatgtgcgcaaaagtacaaagaaatatgggcagagtacaggaaattggttccttggaggatacttccttatgtttattaacaagataacaatatttggtgttgtgcatcggtttttttttttcctgtttttttggttctttttttccgggagtggaatgtagtagcagttcgatagatgaacatacgataggcggcttttggtggaatcttgaaccccaatcgaaattgcactaatttatccgaattgttctttcg

SEQ ID NO: 1080 - DNA, 1286 bp, Triphysaria pusilla
  misc_feature (1269)..(1269): n is a, c, g, or t
acagctcagactcacagtagttggtgacagtgtaactgaatctataattggccatggacctcaacgctcttcttcacgcctccactccttcatggacttcggtcgccatactgctgggattttttacttatttggcgattgttggatctattttaccggggaaaattgttcccggggcgactttatcagacggcactcggctccattaccggtgcaacggttttttattgcttgtcttattggtatgtttacttggagttggcggttggatggatcttgtatcactcactgcgattgctgatagagggctcgagctgttttcaacaacattaatattcagtgtaattgtgacattggttctttacgtggctggttgcagatctcgtgctcagagttcttctttgaaacctcacatcagtgggaacttaatccatgatgggtggtttgggatacagctgaatcctgagttcatgggaatcgatctcaagttctactttgttagagctggtatgatggggtggcttcttataaacctttccgttcttgcgaaatgcattcaagagaccaacttaagccaatcaatgactctttaccagatattttgccttatatatgtgctggattactttttatatgaagagtatatgacctccacatgggatataattgctgagaggttggggtttatgctggtgtttggagatctagtctggatcccgttcacattcagtatccagagctggtggcttctaataatgaagtggagcttacaactgctgggattatgcaaactgccccgtctttctgattggctatatggtctttagaggatctaacaagcagaagcatgatttcaaaaagaatccaaaagcactaatatggggtagacctcctaaggtcattggtgggaagttacttgcttctggttattggggcattgccaggcatagcaactaccttggtgacttgttgctagctctttcctttagtttgccttgtgggataagttctccggtcccatatttttatccaatataccttttcattctactattatggagagaaagaagagacgatgctcggtgtgcacagaagtacaaagaaatatgggcagagtacaccaaattagttccttggaggatacttccatatgtttattaagagccaacctctggatgttgtataacttgtattgtctaacactggttgagtgttatttttaattttatattttttcggatattggaatatatattgcggggaaaaagntttggatggtgagtaga

SEQ ID NO: 1081 - DNA, 1584 bp, Cajanus cajan
ggggaccgttcagtctgtagtttggagatcccatcgcataattctgtcacttctcggctgcggctgagagtgttaactaagtagcaacatagtagcatcgcatcatctaaaccttaatcttctattcaagtctcaattttgaactcactcgaagtgatgatggatctgggtattctccttcacgctctcattccatcttggaactccgttcctttgcttctgggcttcttcacttacttggccattgccggatccattctccctggaaaacttgttcctggggttgctctacccgatgcaactcgtcttcactatcgctgcaatggtttgctctcgcttcttctattggttgcacttcttgggatcagtggcaagatgggttttgtgactcccactgccatatcagacagaggacttgagctgctttccacaacttttgtcttcagttttcttgtgaccctggtactgtatttttccggttgcaagtcacaaagtaagggttcatcactaaaacctcatatcagtggaaacctgatacacgattggtggtttggaatacaactaaatcctcagttcatgggtattgacctcaaatttttctttgttagagctggaatgatggggtggctacttatcaacttatctattcttatgaagagtattcaagatggcactttgagccagtcaatgattctctaccagctattctgtgcactatacatcctggactattttgttcatgaagagtacatgacatccacctgggacataattgcagagagactgggcttcatgttggtctttggagatttagtgtggattcctttcacttttagcatacaggggtggtggctcttgaggaacaatgtagagttaacaacggctgcaactgttgctaattgttttgtcttcctgattggatacatggtatttcgaggagcaaacaagcaaaagcatatgttcaaaaagaatccaaaggctcctatttggggtaaacctccaaaagtcgttggtggcaagctacttgcttcaggctattggggtattgctagacattgtaattaccttggggatttgctgcttgctctctcctttagcttaccatgtgggataagttcaccaattccatacttttatccaatttatcttcttattctgttaatctggagagagagaagggatgaagctcgttgtgctgagaaatatagagaaatatgggccgagtatcgtaaacttgttccatggagaatattgccttatgtttattagaaggttaaaaaagggtttcatggcgaatccttcatcttgccattgcattttgatgtaaattggatcttgtggtcacaatcttggataggagagagacttgaggactttatcttaccatctctatttgtgtatctactagtctgggttacccgtgcaatgtgggttaagtagttgaagaagttatgattaatatttaagtagttcagttacatgaagacaaaaaatgattttgtaagataagaaaaacttcaataaattgttacttaggtaggaagacattgtaaaaaatcatattgaaattattataacaataga

SEQ ID NO: 1082 - DNA, 1333 bp, Malus domestica
aagaagtgaggcgagctccgataagcaaaaggagtgtcattgctgtcaaacagtaaggagcagagctacttgagcagctctcattctcttcaatcatggatctggatcatcttctacacctcctaattccctcatggacctctgttgctatcctggcattgttcttcacttacttggccattgctggatctttactgcccggaaaacttgtccccggagccaccctaccggatggctctcggcttcattatcgatgcaatggtctgctatcacttctgtggctggttgggcttcttggggtcggcgctaagatggatatcgtatcgcttactgcaatatcagatagaggactcgagctgttgtcaacaacttttctgtttagtgttctggtcacaatggtactttacgctgcgggctgcaagtcgaccaaccggggttcttccctgaagcctcatgtcacagggaaccttcttgaggactggtggtttggaatacagcttaatcctcagtttatgggcattgacctcaaatttttctttgttagagctggaatgatgggctggctatttatcaacctttcggttctcgccagaagtgttcaagatggtaccttgagtcaatcaatgatcctctaccagttgttctgtacgttatacatcttggactactttgttcatgaggagtacatgacctccacatgggacataatcgcagagagactgggcttcatgctggtatttggagatctagtctggattccgttcactttcagcatccagggatggtggcttctgagcaataaggtggagttaggaacagtggctgtcgtagcaaattgcttgacatttctgattgggtaccttgtattcagaggagccaacaagcaaaagcacgtctttaagaagaatcccaaagcacccatatggggtaagccctgtagggtcattgggggaaagttgcttgcttctggttattggggaattgcaagacactgtaattacctcggggacttgttacttgcactgtctttcagcttaccttgcgggataagttccccagttccatacttctatccaatttatcttcttattctgctcatatggagagaaagacgagacgaagctcgttgtgctgagaagtacagagagatctgggccgaatactgccggcttgttccatggagaatattaccttatgtttattaagcttcctgactctgcacttgttaactctcatcaagtttaactttgcagtggagctcatactttcttgtttgtactataaaaatgcacttcatcgtgtctgttgagttatttcagaaaaatcatcgtga

SEQ ID NO: 1083 - DNA, 1303 bp, Prunus persica
cttattctctgcaactatggatctgggtcatgttctccacctcctaattccctcatggaactctgttgctatactcgcattgttctttgcttacttgtccattgccggatctatattgcccggcaaagttgttcccggagccaccttaccagatggctctcgtctttattatcgctgcaatggtctgctatcgcttctgttgctggttgggcttcttgggtttggtgctaagatggatttcgtatcacttactgcaatatcagacagaggatttgagctgttatcaacaacttttctgtttagtgttctggtcacactggtactttacgctgctggctgcaagtcgagcaaccgaggttcttccctaaagcctcatgtgacagggaaccttctacatgactggtggtttggaatacagcttaatcctcagtttatgggcatcgacctcaaatttttctttgttagagctggaatgatgggctggctttttatcaacctttcggttcttgcgagaagtatccaagatggcaccttgagtcaatccatgatcctcttccagttgttctgtgcgttatacatcctggactacttttttcatgaggagtacatgacctccacatgggacataattgcagagagactgggtttcatgcttgtatttggagatctagtgtggattcctttcacttttagcatccagggatggtggcttctgagtaacaaggtggagttaggaacagctgctgttgtagcaaattgtttgacttttctgatcgggtacatggtattcagaggagccaacaagcaaaagcatgtctttaagaagaatcctaaagcacctatatggggtaggcctgcaagggtcattgggggaaagttgcttgcttctggttattggggaattgcaaggcactgtaattaccttggggatttgttacttgcactgtctttcagcttgccgtgtgggataagttccccagttccgtacttctatccaatttatcttctcattctgcttgtatggagagaaagaagagatgaagctcgttgtgcagagaagtacaaagaaatctgggcagaataccgcaaacttgtcccatggagaatattgccttatgtttattaagctaccagactctgggctttgtaaacgcatcatcaagtttagctgcagtggacctcatgctttcttgtttatactatgaaatcactttattcctgactgttgagttatttcaggaaaaaaaaaagaagagagtagtgcatctttttgacaaaatgctgcacatttaactactaaaaa

SEQ ID NO: 1084 - DNA, 1640 bp, Glycine max
acgttggaatttgcccatctaaaacctcaatcttttactgaaaagtctcaactttgaactcactcgaagtgatgatggagtcacacgtggatctaggttttctccttcaagctctcactccatcttggaactccgttcctttgcttgtggggttcttcacttacttggccgttgctggatccattctccctggaaaacttgttcctggcgttgcactactcgatggaactcgtctacactattgctgcaatggtctgctctcgcttcttctgttggttgcacttctcgggatcggtgccaagatgggttttgtgtctcccactgccatatcagacagaggacttgagctgctgtccacaacttttgccttcagttttcttgtaaccctgatattgcatttttccggttgcaagtcacaaagtaaaggttcatcactaaagcctcatctcagtggaaacctgatacacgattggtggtttggtatacaactaaatccacagttcatgggtatcgacctcaaatttttctttgttagagctggaatgatgggatggctacttatcaatttatctattcttatgaagagcattcaagatggtactttgagccagtcaatgattctctaccagctattctgtgcactatacatcctggactattttgtacatgaagagtacatgacatccacctgggacataattgcagagagactgggcttcatgttggtctttggagatttagtgtggattcctttctctttcagcatacagggatggtggctcttgatgaacagtgtggagttaacaccagctgccattgtagctaattgctttgtgttcctgattggatacatggtatttcgaggagcaaacaagcaaaagcatgtgttcaaaaagaatccaaaggctcctatctggggtaagcctccaaaagtcattggtggaaagctacttgcttctggttattggggtattgctagacactgtaattacctaggggatttgatgcttgctctctcctttagcttaccatgtgggataagttcaccaattccatacttctatccaatttatcttcttattctgttaatctggagagagagaagggatgaagctcgttgcgccgagaagtatagagagatatgggccgagtatcgtaaacttgttccatggagaatattgccttacgtttattaggatgaaaaaaaaaagggcttcaccatgaattcttcatcttgccgatgttattaagcacttcgatgtaaattggttcttgttcttgtggtttcaatcttggatcttttcttattgagccatgtagctgcaggagagtgtttcgagggatttatcttaccatctatatttgtgtatcattatgctgcagcctgcaggccttcatttttcaatggccaactctttttgacttgttctatttgtttttagatgagaatttcatggtcaaagctcctaggcttaaaaaaacagtgtcatgttctatgggaagtgcaggaagcaattcggggactgcaggaagcaattgcctttacattgatatgctcaatggtactttaggccctttaatgttcttgcttttcatttgtgagttattattggccccatttcatttgctattggctccta

SEQ ID NO: 1085 - DNA, 1388 bp, Prunus persica
aggcaacaagagaatcatttctgtcaaacagtcgcgtcgtataagaaagaagcagagtatatcaagtgcctacttgagtagctcttattctctgcaactatggatctgggtcatgttctccacctcctaattccctcatggaactctgttgctatactcgcattgttctttgcttacttgtccattgccggatctatattgcccggcaaagttgttcccggagccaccttaccagatggctctcgtctttattatcgctgcaatggtctgctatcgcttctgttgctggttgggcttcttgggtttggtgctaagatggatttcgtatcacttactgcaatatcagacagaggatttgagctgttatcaacaacttttctgtttagtgttctggtcacactggtactttacgctgctggctgcaagtcgagcaaccgaggttcttccctaaagcctcatgtgacagggaaccttctacatgactggtggtttggaatacagcttaatcctcagtttatgggcatcgacctcaaatttttctttgttagagctggaatgatgggctggctttttatcaacctttcggttcttgcgagaagtatccaagatggcaccttgagtcaatccatgatcctcttccagttgttctgtgcgttatacatcctggactacttttttcatgaggagtacatgacctccacatgggacataattgcagagagactgggtttcatgcttgtatttggagatctagtgtggattcctttcacttttagcatccaggcatggatggtggcttctgagtaacaaggtggagttaggaacagctgctgttgtagcaaattgtttgacttttctgatcgggtacatggtattcagaggagccaacaagcaaaagcatgtctttaagaagaatcctaaagcacctatatggggtaggcctgcaagggtcattgggggaaagttgcttgcttctggttattggggaattgcaaggcactgtaattaccttggggatttgttacttgcactgtctttcagcttgccgtgtgggataagttccccagttccgtacttctatccaatttatcttctcattctgcttgtatggagagaaagaagagatgaagctcgttgtgcagagaagtacaaagaaatctgggcagaataccgcaaacttgtcccatggagaatattgccttatgtttattaagctaccagactctgggctttgtaaacgcatcatcaagtttagctgcagtggacctcatgctttcttgtttatactatgaaatcactttattcctgactgttgagttatttcaggaaaaaaaaaagaagagagtagtgcatcttttttgacaaaatgcttgcacatttaactacta

SEQ ID NO: 1086 - DNA, 1475 bp, Vigna unguiculata
  misc_feature (690)..(690): n is a, c, g, or t
  misc_feature (1045)..(1045): n is a, c, g, or t
ggaaacagataatggttggactcaggagtagtgtgtagatcgcaatgttctgccatttttcatctgcggctgagagtgttttaaagtagcaacatagcacaatctaaaacctcaaacttttattgaaaagtctcaattttgaactcactcggaagtgatggagtcgcacgtggatctgggttttctcctacacgctctcatgccatcttggaactccgttcctttgctttcggggttcttcacttacttggccattgctggatccgttctccctgggaaagttgttcctggggttgctctacctgatgcaactcgtcttcactatcgatgcaatggtctgctctcgcttcttctgttggttgcgcttcttgggatcggtgccaatatgggttttgtgtctcccactgccatatcagacagaggacttgagttgctgtccacaacgtttctctttagttttcttgtgaccctggtactgtatttttctggttgcgagtcacaaagtaaaggttcatctctaaaacctcatatcagtgggaacctgatacatgattggtggtttggaatacaactaaatcctcacttcatgggtattgacctcaaatttttctttgttagagctggaatgatggggtggctacttatcaatttatctattcttatgaagagcattcaagatggtactttganccagtcaatgattctctaccagctattctgtgcactatacatcctggactattttgtacatgaagaatacatgacatccacctgggacataattgctgagagattgggcttcatgttggtctttggagatttagtgtggatacctttcactttcagcatacaggggtggtggctattgaagaacagtgtggagttaacaaccgctgccgtggtagctaattgctttgtcttcttgatcggatatatggtatttcgaggagcaaacaagcaaaaacacgtgttcaaaaagaatccaaaggctcctatttggggtaagcctccaaaagttgttggaggcaagctactagcgtctggntattggggtgttgctaggcactgtaattacctaggggatttgctgcttgctctctcctttagcttaccttgtgggataagttcaccaattccatacttctatccagtttatcttcttattctgttgatttggagagagagaagggatgaaactcgttgtgcagagaagtataaagagatatgggcagagtatcgtaaacttgtgccatggagaatattgccttatgtttattaggagcataataagggcttcattttgccaatgctactaaacactttgatgtaaattggttcttggatcttttcttgtttgtgtatggattatcatgctcatggctttcttttttatggccatctctttttgatatgatatttctctatttgttttgaaatgagaatggcatggtgcaagatccttggcttatcttata

SEQ ID NO: 1087 - DNA, 879 bp, Solanum tuberosum
ctctactcatctccaaattatttttttgaacatttgttaaattaaccaaaagaaaatggcttctaacacattgatgagttatggaattgcacctgtttgcccctctattctctctgcttccaagtctaaattcgtcaccgcgttgccggtatccgccggagttaccaacgacacgtcaaggttcaccatgtcggccgattggatgcccgggcagccccgtccatcctacctcgacggctcagcccccggagattttggatttgatccacttggttttggagaagtaccagaaaatttggaaagatacaaagaatctgaacttattcattgcagatgggctatgcttgctgttccaggaatcattgtaccagaggcattgggcttaggtaattgggttaaggcccaagaatgggcagctattcctggaggacaagctacatatttgggccagcctgttccatggggaacacttcctactattttggttattgaatttttagccatagcctttgtagagcatcaaaggagtatggaaaaagattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatattgtactcatagtcttgtaatgaaaatggact

SEQ ID NO: 1088 - DNA, 993 bp, Solanum phureja
attctcatatccattttctatttttctctactcatctccaaattatttttttgaacatttgttaaattaaccaaaagaaaatggcttctaacacattgatgagttatggaattgcacctgtttgcccctctattctctctgcttccaagtctaaattcgtcaccgcgttgccggtatccgccggagttaccaacgacacgtcaaggttcaccatgtcggccgattggatgcccgggcagccccgtccatcctacctcgacggctcagcccccggagattttggatttgatccacttggttttggagaagtaccagaaaatttggaaagatacaaagaatctgaacttattcattgcagatgggctatgcttgctgttccaggaatcattgtaccagaggcattgggcttaggtaattgggttaaggcccaagaatgggcagctattcctggaggacaagctacatatttgggccagcctgttccatggggaacacttcctactattttggttattgaatttttagccatagcctttgtagagcatcaaaggagtatggaaaaagattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatattgtactcatagtcttgtaatgaaaatggactttttgtgtatccttagtctatgcatgatatccctatctaatacccatattattcgaatgtgaattcaagatttaaacttaattaatttt

SEQ ID NO: 1089 - DNA, 923 bp, Solanum tuberosum
gttaaattaaccaaaagaaaatggcttctaacacattgatgagttatggaattgcacctgtttgcccctctattctctctgcttccaagtctaaattcgtcaccgcgttgccggtatccgccggagttaccaacgacacgtcaaggttcaccatgtcggccgattggatgcccgggcagccccgtccatcctacctcgacggctcagcccccggagattttggatttgatccacttggttttggagaagtaccagaaaatttggaaagatacaaagaatctgaacttattcattgcagatgggctatgcttgctgttccaggaatcattgtaccagaggcattgggcttaggtaattgggttaaggcccaagaatgggcagctattcctggaggacaagctacatatttgggccagcctgttccatggggaacacttcctactattttggttattgaatttttagccatagcctttgtagagcatcaaaggagtatggaaaaagattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatattgtactcatagtcttgtaatgaaaatggactttttgtgtatccttagtctatgcatgatatccctatctaatacccatattattcgaatgtgaattcaagatttaaactt

SEQ ID NO: 1090 - DNA, 881 bp, Solanum tuberosum
ctctactcatctccaaattatttttttgaacatttgttaaattaaccaaaataaaatgggcttctaacacattgatgagttatggaattgcacctgtttgcccctctattctctctgcttccaagtctaaattcgtcaccgcgttgccggtatccgccggagttaccaacgacacgtcaaggttcaccatgtcagctgattggatgcccgggcagccccgtccatcctacctcgacggctcagcccccggagattttggatttgatccacttggttttggagaagtaccagaaaatttggaaagatacaaagaatctgaacttattcattgcagatgggctatgcttgctgttccaggaatcattgtaccagaggcattgggcttaggtaattgggttaaggcccaagaatgggcagccattcctggaggacaagctacatatttgggccagcctgttccatggggaacacttcctactattttggttattgaatttttagccatagcctttgtagagcatcaaaggagtatggaaaaagattcagaaaagaagaagtaccctggtggggcttttgacccattgggttactctaaagaccctgctaaatttgaagaactcaaagtcaaggaaataaaaaatggtcgtcttgcattattggcatttgtgggattttgtgtacaacaatcagcatacccaggaacaggaccattggagaacttggcaactcacttggctgacccatggcacaacaacattggggatgttattatccctaaaggcattttccctaattgaattgtaccatcatatatactagccaaaaacaccttgtaaaactctcccatattgtactcatagtcttgtaatgaaaatggactt

SEQ ID NO: 1091 - DNA, 870 bp, Solanum tuberosum
gtacatcttttaattaccaaaaaaacaaaagaggaagaagagatggcttctaatacattgatgagttgtggaattccagctgtttgcccttcttttctctcttcttccaagtccaaattcgccgcggcgatgccggtgtccgtcggagctaccaactccatgtctcgattctccatgtccgccgattggatgcccgggcagccccgtccatcctacctcgatggctcagcccccggagattttggatttgatccacttggttttggagaagtaccagaaaatttggaaagatacaaagaatctgaacttattcattgcagatgggctatgcttgctgttcccggaatcctagtaccagaggcattgggcttaggcaattgggtcaaagcccaagaatgggcagcaattcctggaggacaagctacatatttgggccagcctgttccatggggaacacttcctactattttggttattgagtttctagccatagcctttgtagagcatcaaaggagtatggaaaaggattcagaaaagaagaagtaccctggtggggcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatgtactaatagatttctaatggaatggactttttgtgt

SEQ ID NO: 1092 - DNA, 952 bp, Solanum lycopersicum
tctcaaactccctccttatacattccacaattacaccaattttttttcattctcatatccaaacttttttttgtacatcttttaattaccaaaaaaaaaagaggaagaagatatggcttctaatacattgatgagttgtggaattccagctgtttgcccctctttcctctcttctaccaagtccaaattcgccgccgcgatgccggtgtccgttggagctaccaactccatgtctcggttctccatgtcagctgattggatgcccgggcagccccgtccatcttacctcgacggctcagcccccggagattttggatttgatccacttggtttaggagaagtacctgcaaatttggaaagatacaaagaatctgaacttattcattgcagatgggctatgcttgctgttcccggaatcatagtaccagaggcattgggcttaggtaattgggtcaaggcccaagaatgggcagccattcctggtggacaagctacatatttgggccagcctgttccatggggaacacttcctactattttggctattgaatttctagccatagcttttgtagaacaccaaaggagtatggaaaaagattcagaaaagaagaagtaccctggtggggcttttgacccattgggctactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttattatccctaaaggcattttccctaattaaattgtactatttatcatatagtatattagccaaaaacaccttgtaaaactctcccatgtactaatagatttctaatggaatggactttctgtgtatcct

SEQ ID NO: 1093 - DNA, 901 bp, Solanum lycopersicum
cattctcatatccaaacttttttttgtacatcttttaattaccaaaaaaaaaagaggaagaagatatggcttctaatacattgatgagttgtggaattccagctgtttgcccctctttcctctcttctaccaagtccaaattcgccgccgcgatgccggtgtccgttggagctaccaactccatgtctcggttctccatgtcagctgattggatgcccgggcagccccgtccatcttacctcgacggctcagcccccggagattttggatttgatccacttggtttaggagaagtacctgcaaatttggaaagatacaaagaatctgaacttattcattgcagatgggctatgcttgctgttcccggaatcatagtaccagaggcattgggcttaggtaattgggtcaaggcccaagaatgggcagccattcctggtggacaagctacatatttgggccagcctgttccatggggaacacttcctactattttggctattgaatttctagccatagcttttgtagaacaccaaaggagtatggaaaaagattcagaaaagaagaagtaccctggtggggcttttgacccattgggctactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttattatccctaaaggcattttccctaattaaattgtactatttatcatatagtatattagccaaaaacaccttgtaaaactctcccatgtactaatagatttctaatggaatggactttctgtgta

SEQ ID NO: 1094 - DNA, 912 bp, Solanum tuberosum
ctttcttctctactcatatccaactttttttgtacatcttttaattaccaaaaaaaaaaaagaggaagaagagatggcttctaatacattgatgagttgtggtattccagctgtttgcccctcttttctctcttcttccaagtccaaattcgccgcggcgatgccggtgtccgtcggagctaccaactccatgtctcgattctccatgtcctccgattggatgcccgggcagccccgtccatcctacctcgatggctcagcccccggagattttggatttgacccacttggttttggagaagttccagaaaatttggaaagatacaaagaatctgaacttattcattgcagatgggctatgcttgctgttcccggaatcctagtaccagaggcattgggcttaggcaattgggtcaaggcccaagaatgggcagccattcctggaggacaagctacatatttgggccagcctgttccatggggaacacttccaactattttggttattgaatttttagccatagcctttgtagagcaccaaaggagtatggaaaaagattcagaaaagaagaagtaccctggtggagcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatgtactaatagatttctaatggaatggactttttgtgtatccttagtct

SEQ ID NO: 1095 - DNA, 1238 bp, Solanum phureja
aacttaagatgtaaattccattgtcaatattaacttgtaagcttatatagcataatcatgttctaatcaatgattaacgaatttgattgatgtaaacttatcataacccccaaatatgatatttcctcccactaggacaaccttagccacaaaagcaacatcacatatccttcaaaaatatccacttcttcttccacgtggaccaatcacaaaacagaaaccagtctctttagccaataacaatcaaaattcagatttgcctatatctcaaactccctccttatacactccacaattacaccaattttttttcattctcatatccattttcttctttcttctctactcatatccaactttttttgtacatcttttaattaccaaaaaaaaaaaagaggaagaagagatggcttctaatacattgatgagttgtggtattccagctgtttgcccctcttttctctcttcttccaagtccaaattcgccgcggcgatgccggtgtccgtcggagctaccaactccatgtctcgattctccatgtcctccgattggatgcccgggcagccccgtccatcctacctcgatggctcagcccccggagattttggatttgacccacttggttttggagaagtaccagaaaatttggaaagatacaaagaatctgaacttattcattgcagatgggctatgcttgctgttcccggaatcctagtaccagaggcattgggcttaggcaattgggtcaaggcccaagaatgggcagccattcctggaggacaagctacatatttgggccagcctgttccatggggaacacttccaactattttggttattgaatttttagccatagcctttgtagagcaccaaaggagtatggaaaaagattcagaaaagaagaagtaccctggtggagcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatgtactaatagatttctaatggaatggactttttgtgtatcc

SEQ ID NO: 1096 - DNA, 1233 bp, Solanum tuberosum
aacttaagatgtaaattccattgtcaatattaacttgtaagcttatatagcataatcatgctctaatcaatgattaacgaatttgattgatgtaaacttatcataacccccaaatatgatatttcctcccactaggacaaccttagccacaaaagcaacatcacatatccttcaaaaatatccacttcttcttccacgtggaccaatcacaaaacaaaaaccagtctctttagccaataacaatcaaaattcaaatttgcctatatctcaaactccctccttatacactccacaattacaccaattttttttcattctcatatccattttcttctttcttctctactcatatccaactttttttgtacatcttttaattaccaaaaaaaaaaagaggaagaagagatggcttctaatacattgatgagttgtggtattccagctgtttgcccctcttttctctcttcttccaagtccaaattcgccgcggcgatgccggtgtccgtcggagctaccaactccatgtctcgattctccatgtcctccgattggatgcccgggcagccccgtccatcctacctcgatggctcagcccccggagattttggatttgacccacttggttttggagaagtaccagaaaatttggaaagatacaaagaatctgaacttattcattgcagatgggctatgcttgctgttcccggaatcctagtaccagaggcattgggcttaggcaattgggtcaaggcccaagaatgggcagccattcctggaggacaagctacatatttgggccagcctgttccatggggaacacttccaactattttggttattgaatttttagccatagcctttgtagagcaccaaaggagtatggaaaaagattcagaaaagaagaagtaccctggtggagcttttgacccattgggttactctaaagaccctgctaaatttgaagaactcaaagtcaaggaaatcaagaatggtcgtcttgcattgttggcatttgtgggattttgtgtacaacaatcagcatatccaggaacaggaccattggagaacttggcaactcacttggctgacccatggcacaacaacattggggatgttgttatccctaaaggcattttccctaattgaattgtaccatcatatatattagccaaaaacaccttgtaaaactctcccatgtactaatagatttctaatggaatggactttttgtgt

SEQ ID NO: 1097 - DNA, 910 bp, Capsicum annuum
attctcatatccatttcttctatttctttaaacgtctttcagttaccaaaacacaaaagaggaagaagagatggcttgtaatacattgatgagttgtggaattgcagctgtttgtccctctttcctctcttcttctaagtctaaattcgccgccgcgatgccggtttcagccggagctaacaacgccatgtctaggtttactatgtccgctgattggatgcccgggcagccccgtccatcttacctagatggctcagcccccggagattttggatttgatccacttggttttggagaagtgccagaaaatttggaaagatacaaagaatctgaacttattcattgcagatgggctatgcttgctgttccgggaatcctagtaccagaggcattgggcctagggaattgggtcaaggcccaagaatgggctgccattccaggaggacaggccacatatttgggccagccagttccatggggaacacttccaacaattttggttattgaatttctagccatagcctttgttgaacatcaaaggagcatggaaaaggacactgagaaaaagaagtaccctggtggagcttttgacccattgggttactctaaagacccaaagaaatttgaagaatacaaagtcaaagaaatcaaaaatggtcgtcttgcattgttggcatttgtgggattttgtgtacaacaatcagcatatccaggaacaggaccattggagaacttggcaactcacttggctgatccatggcacaacaacattggggatgttattatccctaaaggaattttccctaattaattcaattgtactaattaatcatatatattagccaaaacaacttgtaaaactctcccatgtactactaatagatttctaatgaaatggactctttgggta

SEQ ID NO: 1098 - DNA, 1106 bp, Solanum melongena
aacaccaaatatttttcattatcatatccattttgttctagtttctctactcatttccaaattcatttgatcatttgttaaatttcaaaaaaaaaaagaggaaggaagaagagatggcttctaagtcattgatgagttgtggaattgctcctgtttgcccctctttcctgtcttcttccaactctaaactcttcgcgggcgcgatgcggctgcctgcgggagttaccgactccatgtctcggttgtccatgtcagctgattggatgcccgggcagcctcgtccatcctacctcgatgggtcagcccccggagattttggatttgatccacttggttttggagaagtaccagaaaatttggagagatacaaagaatctgaacttattcattgcagatgggctatgcttgctgttcccggaatcctagtgccagaggcattgggcttaggcaattgggtgaaggcccaagaatgggctgctattcctggtggacaagcgacatatttgggccagcctgttccatggggaacacttcctactattttggttattgagtttctagccatagcctttgtagaacaccaaaggagtatggaaaaggacacagaaaaaaagaagtaccctggtggagcttttgacccattgggttactctaaagaccctgctaaatttgaagaactcaaagtcaaggaaatcaaaaatggtcgccttgcattgttggcatttgtgggattttgtgtacaacaatcagcatatccaggaacaggaccattggagaacttggcaactcacttggctgatccatggcacaacaacattggggatgttatcatccctaaaggcattttccctaattgaatatattacccaaacaactcatccactttttctgtatctttaatctactacttgtttcgttcaaaaattactatagctcatggatcatagatgtggtatgaaatggactttttgtgtatccttagtctgtatatgatatccctatctaatatccatttcattcgaacctgatataaacttaattttttattagagttatgaatgttttgaaaatatatagtagtagtatgtatactacttttcaagatt

SEQ ID NO: 1099 - DNA, 905 bp, Nicotiana tabacum
gcccattattccctctcttcatcaccacattcattttctattttcactactcattttggaaagaaaaaaaaaaaggaagaagagatggcttctaaagcattgatgagctgcggaatagcagctgtttgtccttctgtcctctcttcttccaagtctaaatttgcggtcgccgtgccggtgtccgccggagctaccaatggtacatctaggttcaccatgtccgccgagtggatgcccggccagccccgcccttcctaccttgatggttcagctcccggagactttggatttgatccacttggtctaggagaagtaccatcaaacttggagagatacaaagagtctgaactcattcactgcagatgggctatgcttgctgtcccaggaattctagttccagaggcattgggcttgggcaactgggtcaaggcccaagaatgggctgccattccaggaggacaagctacatatttgggccagcccgttccatggggcactcttcctacaattttagccattgaatttttagccattgcttttgtagagcaccaaagaagtatggagaaggaccctgagaagaagaaataccctggtggggcttttgacccattgggctactctaaagaccctaaaaagtttgaggaactcaaagtcaaggaaatcaaaaatggtcggcttgcgttgttggcattcgtgggattttgtgtacaacaatcagcatacccaggaacaggaccattggaaaatttggcaactcacttagctgatccatggcacaacaacattggcgatgttattatccctagaggcattttgccttgaactgtgatatacccaataccctactttccccgttgtaaaactaaactctaccatgtaacagatttgtaatgaaatggactttt

SEQ ID NO: 1100 - DNA, 1101 bp, Nicotiana benthamiana
ggggaccacattcatattcgattttctcaactcatttggaaaaagaaaaaaagaggaagaagagatggcttctaaagcattgatgagctgcggaattgcagctgtttgtccctctgtcctctcttcttccaagtctaaattcgccgccgccgtgccggtttccgccggagcctccaatactacttctaggttcaccatgtccgccgagtggatgcccggtcagccccgcccttcctacctcgacggttcagcccccggagactttggatttgatccacttggtctaggagaagtaccatcaaacttggagagatacaaagagtctgaactcattcactgcagatgggctatgcttgctgttccaggaatcctagttccagaggcattgggcttgggcaactgggtcaaggcccaagaatgggctgccattccaggaggacaagctacatatttgggccagcccgttccatggggcactcttcctacaattttagccattgaattcttagccattgcttttgtagagcaccaaagaagtatggagaaggaccctgagaagaagaaataccctggtggggcttttgacccattgggctactctaaagaccctaaaaagtttgaggaactcaaagtcaaggaaatcaaaaatggtcgcctcgccttgttggctttcgtgggattttgtgtacaacaatcagcatacccaggaacaggaccattggaaaatttggcaactcacttagctgatccatggcacaacaacattggggatgttattatccctagaggcattttaccttgaactctgatatactcgaatttcccccttgtaaaatggaactttcccatgtgacagatttgtaatcaaatggaacttttttgtgcatccttgatttatctactggtttaatttctatgataaaaagctctatttagaaaggaattagggtttgatgcaagagtcttggaacgaggatatatttccaactgggccaacaatttattccacgtcttcggaaagtggcacaatatataatgccagtgtattataactatatcaaaaagaaaagtctctcattttaaataaaaaagaatttaaaa

SEQ ID NO: 1101 - DNA, 927 bp, Nicotiana tabacum
atcaccacatacattttctattttctctactcatttagtcaaaaaaaggaagaagatatggcttctaaagcattgatgagctgcggaatagcagctgtttgcccctctgtcctctcttcttccaagtctaaattcgctgccgccgtgccgttttctgccggagccaccaatgctacatctaggttcaccatgtccgccgagtggatgcccggccaaccccgcccttcctacctcgacggttcagcccccggagactttggatttgatccacttggtctaggagaagtaccatcaaacttggagagatacaaagaatctgaactcattcactgcagatgggctatgcttgctgttccaggaatcctagttccagaggcattgggcttaggcaattgggtcaaggcccaagaatgggctgccattccaggaggacaagctacatatttgggccagcccgttccatggggcactcttcctacaattttagccattgaattcttagccattgcttttgtagagcaccaaagaagtatggaaaaggaccctgagaagaagaaataccctggtggggcttttgacccattgggctactctaaagaccctaaaaagtttgaggaactcaaagtcaaggaaatcaaaaatggtcggcttgcgttgttagcattcgtgggattttgtgtacaacaatcagcatacccaggaacaggaccattggaaaatttggcaactcacttagccgatccatggcacaacaacattggggatgttattatccctagaggcattttaccttgaactgtgatataccctaatttcccccttgtaaaattaaactctcccatgtgacagatttgtaatcaaatggaacttttttgtgcatccttgatttatctagtggtttaatttctatgatacaaagctctattt

SEQ ID NO: 1102 - DNA, 970 bp, Nicotiana tabacum
ttttaacattctttcaagtctaatagtagcttaatacaatggcttccaatacattgatgagctgcggaattgcagcagtttccccctctgtcctctcttcttccaagtctaaatttgccgccgcggtgccggtgtgtttaggagcagccaatgccaactcccggttcagcatgtctgccgagtggatgccgggccagccccgccctccttatcttgacggctctgcccccggagattttggattcgatccacttggtctaggagaagtaccagcgaacttggagagatacaaggagtctgaactcattcactgcagatgggctatgcttgctgtgcctggaatcctagtaccagaagcattgggcctgggcaactgggtaaaggcccaagaatgggctgccattcccggagggcaagctacatatttgggccaacccgtcccatggggtactcttcccacaattttggccattgaattcttagccattgcttttgtagagcaccaaagaagtatggagaaggaccctgagaagaagaagtaccctggtggtgcttttgacccattgggttactctaaggacccaaaaaagtttgaagaactcaaagtcaaggaagtcaaaaatggtcgccttgccttgttggctttcgtcgggttctgcgttcaacaatcagcataccctggaacaggaccattggagaacttagcaactcacttggctgatccatggcacaacaacattggagatgtcattatccctaaaggcattttgccttgaaataaatctaccatcccaaacatacattgtaaaactccccatgtaacacatttgtaatgaattggacgtttaccttttacctagaactagaaagttactatctcttccttccatgctactaccaaacagtactgtatatgttatgagacaaactctagttaggagcaaattaaatgatttttaaagctgttgca

SEQ ID NO: 1103 - DNA, 905 bp, Nicotiana benthamiana
ccatattctcatttttcttttcttcttttaaacattatttcaagtctaatagtagctcaattcaatggcttctaatgcattgatgagctgcggaattgcagcagtttctccctctgtcctctcttcttccaagtctaaatttgccgtcgcagtgcctgtgtgtgtaggagcagctaatggcaattcccggttcagcatgtctgccgagtggatgccgggccagccccgccctccttaccttgacggttctgcccccggagattttggattcgatccacttggtctaggagaagtaccagcgaacttggagagatacaaggagtctgaactcattcactgtagatgggctatgcttgctgtgcctggaatcctagtaccagaagcattgggcttgggcaactgggtaaaggcccaagaatgggctgccattcccggagggcaagctacatatttgggtcaacccgtcccatggggtactcttcccactattttggccattgaattcttagccattgcttttgtagagcaccaaagaagtatggagaaggaccctgagaagaagaaataccctggtggtgcttttgatccattgggttactctaaggacccaaaaaagtttgaagaactcaaagtcaaggaaataaaaaatggtcgccttgccttgttggctttcgtcgggttctgtgtacaacaatcagcataccctggaacaggtccattggagaacttagcaactcacttggctgatccatggcacaacaacattggagatgtcattatccctagaggcattttgccatgaaatcaatctaccatcccaaaatagacccccgttgtaaaactccccatgtaacaaatttctaatgaaatggacgtttacgtatgctcgaccttttacctagaaa

SEQ ID NO: 1104 - DNA, 790 bp, Nicotiana tabacum
ttttaacattctttcaagtctaatagtagcttaattcaatggcttccaatgcattgatgagctgcggaattgcagcagtttctccctctgtcctctcttcttccaagtctaaatttgccgtcgcagtgccggtgtgtgtaggagcagctaatggcaactcccggttcagcatgtctgccgagtggatgccgggccagccccgccctccttaccttgacggttctgcccccggagattttggattcgatccacttggtctaggagaagtaccagcgaacttggagagatacaaggagtctgaactcattcactgtagatgggctatgcttgctgtgcctggaatcctagtaccagaagcattgggcctgggcaactgggtaaaggcccaagaatgggctgccattcccggagggcaagctacatatttgggtcaacccgtcccatggggtactcttcccactattttggccattgaattcttagccattgcttttgtagagcaccaaagaagtatggagaaggatcctgagaagaagaaataccctggtggtgcttttgacccattgggttactctaaggacccaaaaaagtttgaagaactcaaagtcaaggaaataaaaaatggtcgccttgccctgttggctttcgtcgggttctgtgtacaacaatcagcataccctggaacaggaccattggagaacttagcaactcacttggctgatccatggcacaacaacattggagatgtcattatccccagaggcattttgccatgaaatcaatctaccat

SEQ ID NO: 1105 - DNA, 1091 bp, Nicotiana benthamiana
gcacgaggattttctcaactaatttagaaaaagaagacatggcttctaaagcattgatgagctgcggagtagcagctgtttgtccttctgtcctctcttcttccaagtctaaattcgccgccgccgtgcagatttccgccggacacaccaatgctacatctaggttcaccatgtccgccgagtggatgcccggtcaaccccgtccttcctacctcgacggctcagcccccggagactttgggtttgatccacttggtctaggagaagtaccatcaaacttggagagatacaaggagtctgaactcattcactgcagatgggctatgcttgctgttccaggaatcctagttccagaggcattgggcttgggcaactgggtcaaggcccaagaatgggctgccattccaggaggacaagctacatatttgggccagcccgttccatggggcactcttcctacaattttagccattgaattcttagccattgcttttgtagagcaccaaagaagtatggagaaggaccctgagaagaagaaataccctggtggggcttttgacccattgggctactcaaaagaccctaaaaagtttgaggaacttaaagtcaaggaaataaaaaatggtcggcttgcgttgttggcattcgtgggattttgtgttcaacaatcagcatacccaggaacaggaccattggaaaatttggcaactcacttagctgatccatggcacaacaacattggggatgtcattatccctagaggcattttaccttgaactgtgatataccccaatttcccccttgtaaaatgaagctctcccatgtgacagatttgtaatcaaatggaacttttttgtgcatccttgattatctagtggtttaatttctaagatacaaagctctattgataaaggaattagggtttgatgcaagagtcttggtacgaggataaattagggtttgatgcaagagtcttggtacgaggatatatttccaactgggccaacaatgtatgcgaagtcttacttcgaaaattgacataatatataattccagtgtattataactattcctaaaaaaagaaataaaaa

SEQ ID NO: 1106 - DNA, 887 bp, Petunia hybrida
cattcattgtctactcattttcctcaattcttttgtaccttagtttagcaaaaagaagaagagatggcttctaaagcattgatgagctgtggcattgctgcagtttgcccctctgtcctctcttcttctaagtctaaattcgccgtggcagtgcccgtgtccgctggagctaccaatggtacatctaggttcaccatgtcggccgagtggatgcccggccaaccccgtccttcttaccttgatggctcagcccccggagatttcggatttgatccacttggtctaggagaagtcccgtcaaacttggagagatacaaggagtctgaactcattcactgcagatgggctatgcttgctgttccaggaatcctagttccagaggcattgggcttgggtaactgggtcaaggctcaagaatgggccgctattccaggagggcaagccacctatttgggccagccagttccatggggaacacttcctaccattttggcaattgaattcttggccattgcttttgtagagcaccaaagaagtatggagaaagaccctgagaagaagaagtatcctggtggggcttttgacccctggggctattcaaaggaccctaaaaagtttgaggaactcaaagtcaaggaaatcaaaaatggtcgccttgcattgttggctttcgtgggattttgtgttcaacaatcagcttacccaggaacaggaccattggagaacttggcaactcacttggctgatccatggcacaaaaacattggggatatcattattcccccatcagtttttccttgaagtttgatataccaaaaccagaaatgatctccattgtaaaactctcccatggaatagatttgtaatgatatggacttttttgtaac

SEQ ID NO: 1107 - DNA, 975 bp, Nicotiana benthamiana
tacggccgggattcccccatattctcattttccttttcttctttgaacgttctttcaagtctaatagtaccttaattctatggcttctaatgcattgatgagctgcggaattgcagcagtttccccctctgtcctctcttcttccaagtctaaatttgccgtcgcagtgcctgtgtgtgtaggagcagccaatggcaactcccggttaagcatgtctgccgagtggatgccgggccagccccgccctccttaccttgacggttctgcccccggagattttggattcgatccacttggtttaggtgaagtaccagcgaacttggagagatataaggagtctgaacttattcactgcagatgggctatgcttgctgtgcctggaatcctagtaccagaagcattggacctgggcaactgggtaaaggcccaagaatgggctgccattcccggaggacaagctacatatttgggtcaacccgtcccatggggtactcttcccactattttggccattgaattcttagccattgcttttgtagagcaccaaagaagtatggagaaggatcccgagaagaaaaaataccctggtggtgcttttgacccattgggttactctaaggacccaaaaaagtttgaagaactcaaagtcaaggaaataaaaaatggtcgccttgccttgttggctttcgtcgggttttgtgtacaacaatcagcataccctggaacaggaccgttggagaacttagcaactcacttggctgatccatggcacaacaacattggaaatgtcattatcccgagaggcattttaccatgaaattaacccccattgtaaaacaccacatgtaacaaatttgtaatgaaatggacattcacgtatgtttagaccttttacctaaaaagttactatctctccttccattccatgctactaccaaacaattgtatgttatgacacaaaaactattgggagca

SEQ ID NO: 1108 - DNA, 954 bp, Lactuca sativa
tttagtcaccagtcaccaccaccatcattcatccacaaccacaaccacaaccaccaccactaaaatcctccatttccatttccagattcatacattcttctgggaatggcttccaatacattaatgagctgcggcatccccgccgtgggccgcccctcgcttctctcctcttccaaatcaagattcgccactgctgtgccactttccggagttaccaccaacgcatctcggatttccatgtccgccgagtggatgcccggacaaccacgaccaccgtaccttgacggatctgcacctggtgattttgggtttgacccacttggtcttggtgaggtcccagagaaccttgaaaggttcaaagagtcggagctcattcactgcagatgggctatgcttgcagtacctgggattttgttacccgaagcattaggattgggcaattgggtaaaagcacaagaatgggcagccctgcccggcgggcaagcaacatacctagggaacccggtgccatggggtaccctacccacaatcttggctatcgaattcatctccattgcattcgtagaacaccaaaggagtatggaaaaagacacggaaaagaagaagtaccccggtggtgcttttgacccattaggctactcaaaagaccctaaaaccttcgcagagtacaaggtcaaagagatcaaaaatggacgtttggctttgttggcatttgtgggattttgtgtgcaacaatcggcttaccctggaaccggacccttggagaacttggcaactcatttggctgacccatggcacaacaacattggagatgtcattattcctaaaggaattttcccaaattaatatgcaacatgcatgcttgcttttgagctccaaaattctcatatgtaaaggccttgtaaaacttcatcatgtaatcaaatgaacttatattatattagtgtcaatttc

SEQ ID NO: 1109 - DNA, 944 bp, Lactuca sativa
accaccaccaccaccgctaaaatcctccatttccatttccagattcatacattcttctgggaatggcttccaatacattaatgagctgcggcatccccgccgtgggccgcccctcgcttctctcctcttccaaatcaagattcgcgactgctgtgccactttccggagttaccaccaacgcatctcggatttccatgtccgccgagtggatgcccggacaaccacgaccaccgtaccttgacggatctgcacctggggattttgggtttgacccacttggtcttggtgaggtcccagagaaccttgaaagattcaaagagtcagagctcattcactgcagatgggctatgcttgcagtacctgggattttgttacctgaagcattaggattgggcaattgggtaaaagcacaagaatgggcagccctgcccggcgggcaagcaacatacctagggaacccggtgccatggggtaccctacccacaatcttggctatcgaattcatctccattgcattcgtagaacaccaaaggagcatggaaaaagacacagaaaagaagaagtaccccggtggtgcttttgacccattaggctactcaaaagaccctaaaaccttcgcagagtacaaggtcaaagagatcaaaaatggacgtttggctttgttggcatttgtgggattttgtgtgcaacaatcggcttaccctggaaccggaccattggagaacttggcaactcatttggctgacccatggcacaacaacattggagatgtcattattcctaaaggaattttccccaattaatatgcaacatgcatgcttgcttttgagctccaaaattctcatatgtaaaggccttgtaaaacttcatcttgtaatcaaatgaacttatattatattagtgtcaatttcaaagtttgtggtaacttcttaaagatttcatca

SEQ ID NO: 1110 - DNA, 1031 bp, Lactuca sativa
cgcggggatcacaaccacaaccacaaccaccaccactaaaatcctccatttccatttccagattcatacattcttctgggaatggcttccaatacattaatgagctgcggcatccccgccgtgggccgcccctcgcttctctcctcttccaaatcaagattcgccactgctgtgccactttccggagttaccaccaacgcatctcggatttccatgtccgccgagtggatgcccggacaaccacgaccaccgtaccttgacggatctgcacctggtgattttgggtttgacccacttggtcttggtgaggtcccagagaaccttgaaaggttcaaagagtcggagctcattcactgcagatgggctatgcttgcagtacctgggattttgttacccgaagcattaggattgggcaattgggtaaaagcacaagaatgggcagccctgcccggcgggcaagcaacatacctagggaacccggtgccatggggtaccctacccacaatcttggctatcgaattcatctccattgcattcgtagaacaccaaaggagtatggaaaaagacacagaaaagaagaagtaccccggtggtgcttttgacccattaggctactcaaaagaccctaaaaccttcgcagagtacaaggtcaaagagatcaaaaatggacgtttggctttgttggcatttgtgggattttgtgtgcaacaatcggcttaccctggaaccggacccttggagaacttggcaactcatttggctgacccatggcacaacaacattggagatgtcattattcctaaaggaattttcccaaattaatatgcaacatgcatgcttgcttttgagctccaaaattctcatatgtaaaggccttgtaaaacttcatcttgtaatcaaatgaacttatattatattagtgtcaatttcaaagtttgtggtaacttcttaaagatttcatcaaatttcgaaattttatttcatcagattgtatacaatgagttatcctaatcaaaatcattttatttctc

SEQ ID NO: 1111 - DNA, 904 bp, Antirrhinum majus
cggcacgagcgccattctctacttcccttaaacaattcattaatccaaagtgcaaaccaataatttgtacaagaatcttttgagaatggcggccaacacattgatgagctgcggcgttgcagccgtggccccctcagtcctctcctcttccaagtccaaattcgcggcctcggcgaacttcggcaccactgccagcacctcaaggttcaccatgtccgccgaatggatgcccggccagccccgtccttcttacctcgacggctcggcaccaggagactatggattcgaccctcttgggcttggtgaagttccatcaaacctagaaagatacaaagaatccgagctcattcactgcagatgggctatgcttgccgttcccggtatcctagtacccgaggctttgggtttgggtaattgggtcaaagcccaggaatgggcagcagttccaggaggccaagccacttatttgggcaacccggtcccatggggcaccctacccaccattttggcgattgaattcttggctattgcctttgtagagcaccagaggagcatggaaaaggacccggaaaagaagaagtacccgggcggggctttcgacccattgggctactccaaggacccgaaaaagtttgaggaactcaaagtcaaggaaatcaaaaatggtcgtcttgcattgttggcgtttgtgggattctgcgtgcagcaatcggcatacccgggtacgggtccattggagaacttggcaactcacttggcggatccatggcacaagaacatcggagatgttgttatccctccaggaatttttcctaattgaattgtgacgaatatataccctttgtaaaactctatgtaacattattgtgtaatgaaagatggacatttgtgtgtttaaaaaaaa

SEQ ID NO: 1112 - DNA, 1025 bp, Lactuca sativa
atccacaaccgcaaccaccaccaccaccactaaaatcctccatttccatttccagattcatacattcttctgggaatggcttccaatacattaatgagctgcggcatccccgccgtgggccgcccctcgcttctctcctcttccaaatcaagattcgcgactgctgtgccactttccggagttaccaccaacgcatctcggatttgcatgtccgccgagtggatgcccggacaaccacgaccaccgtaccttgacggatctgcacctggtgattttgggtttgacccacttggtcttggtgaggtcccagagaaccttgaaagattcaaagagtcggagctcattcactgcagatgggctatgcttgcagtacctgggattttgttacctgaagcattaggattgggcaattgggtaaaagcacaagaatgggcagccctgcccggcgggcaagcaacatacctagggaacccggtgccatggggtaccctacccacaatcttggctatcgaattcatctccattgcattcgtagaacaccaaaggagtatggaaaaagacacagaaaagaagaagtaccccggtggtgcttttgacccattaggctactcaaaagaccctaaaaccttcgcagagtacaaggtcaaagagatcaaaaatggacgtttggctttgttggcatttgtgggattttgtgtgcaacaatcggcttaccctggaaccggacccttggagaacttggcaactcatttggctgacccatggcacaacaacattggagatgtcattattcctaaaggaattttcccaaattaatgtgcaacatgcatgcttgcttttgagctccaaaattctcatatgtaaaggccttgtaaaacttcatcttgtaatcaaatgaacttatattatattagtgtcaatttcaaagtttgtggtaacttcttaaagatttcatcaaatttcgaaattttatttcatcagattgtatacaatgagttatcctaatcaaaatcattttatttctc

SEQ ID NO: 1113 - DNA, 942 bp, Lactuca sativa
accattaccaccaccacttaaatcctcatttcatttcagattcatacattcttctgggaatggcttccaatacattaatgagctgcggcatccccgccgtgggccgcccctcgcttctctcctcttccaaatcaagattcgcgactgctgtgccactttccggtgttacaaccaacgcatctcggatttccatgtccgccgagtggatgcccggacaaccacgaccaccgtaccttgacggatctgcacctggggattttgggtttgacccacttggtcttggtgaggtcccagcgaaccttgaaaggttcaaagagtcggagctcattcactgcagatgggctatgcttgcagtacctgggattttgttacccgaagcattaggattgggcaattgggtaaaagcacaagaatgggcagccctgcccggcgggcaagcaacatacctagggaacccagtgccatggggtaccctacccacaatcttggccatcgaattcgtatctattgcattcgtagaacaccaaagaagcatggaaaaagacacagaaaagaagaaataccccggtggtgcttttgacccattaggctactcaaaagaccctaaaaccttcgcagagtacaaggtcaaagagatcaaaaatggacgtttggctttgttggcatttgtgggattttgtgtgcaacaatcggcataccctggaaccggccccttggagaacttggcaactcatttggctgacccatggcacaacaacattggagatgtcattattcctaaaggaattttcccaaattaatatgaagcatgcatgtttgcttttgagctcaaacattctcatatgtaaagtccttgtaatacttcatcttgtaatcaaatgaacttatattagtctcaatttcaaactttgtggtaaaagttcttaaagattcatcaaaatt

SEQ ID NO: 1114 - DNA, 947 bp, Lactuca sativa
caaccattaccaccaccacttaaatcctcatttcatttccagattcatacattcttctgggaatggcttccaatacattaatgagctgcggcatccccgccgtgggccgcccctcgcttctctcctcttccaaatcaagattcgcgactgctgtgccactttccggtgttacaaccaacgcatctcggatttccatgtccgccgagtggatgcccggacaaccacgaccaccgtaccttgacggatctgcacctggggattttgggtttgacccacttggtcttggtgaggtcccagcgaaccttgaaaggttcaaagagtcggagctcattcactgcagatgggctatgcttgcagtacctgggattttgttacccgaagcattaggattgggcaattgggtaaaagcacaagaatgggcagccctgcccggcgggcaagcaacatacctagggaacccagtgccatggggtaccctacccacaatcttggccatcgaattcgtatctattgcattcgtagaacaccaaagaagcatggaaaaagacacagaaaagaagaaataccccggtggtgcttttgacccattaggctactcaaaagaccctaaaaccttcgcagagtacaaggtcaaagagatcaaaaatggacgtttggctttgttggcatttgtgggattttgtgtgcaacaatcggcataccctggaaccggccccttggagaacttggcaactcatttggctgacccatggcacaacaacattggagatgtcattattcctaaaggaattttcccaaattaatatgaagcatgcatgtttgcttttgagctcaaacattctcatatgtaaagtccttgtaatacttcatcttgtaatcaaatgaacttatattagtctcaatttcaaactttgtggtaaaagttcttaaagattcatcaaaatttc

SEQ ID NO: 1115 - DNA, 1082 bp, Prunus persica
  misc_feature (1016)..(1016): n is a, c, g, or t
  misc_feature (1025)..(1025): n is a, c, g, or t
  misc_feature (1028)..(1028): n is a, c, g, or t
  misc_feature (1030)..(1030): n is a, c, g, or t
  misc_feature (1039)..(1039): n is a, c, g, or t
  misc_feature (1047)..(1047): n is a, c, g, or t
  misc_feature (1049)..(1049): n is a, c, g, or t
  misc_feature (1052)..(1052): n is a, c, g, or t
  misc_feature (1054)..(1054): n is a, c, g, or t
  misc_feature (1056)..(1056): n is a, c, g, or t
  misc_feature (1060)..(1061): n is a, c, g, or t
  misc_feature (1066)..(1066): n is a, c, g, or t
  misc_feature (1069)..(1071): n is a, c, g, or t
  misc_feature (1073)..(1073): n is a, c, g, or t
  misc_feature (1075)..(1075): n is a, c, g, or t
  misc_feature (1079)..(1079): n is a, c, g, or t
  misc_feature (1081)..(1081): n is a, c, g, or t
ttcttcctcctcccacagaccaaaaatcttgcaggcattcatttgttcattaatggcttccaacactttgatgagctgtggcatcgccaccacagccttcccttcagtcctctcatcctccaagtctaaatttgccaccagtgcagtccagctccccagtgttggtgccaatgcctcctccaggttctccatgtccgctgattggatgcccggccagccgagacctccttatctagacggctctgcacccggtgactttggatttgacccacttcggctaggagaagtgccagaaaacttggagaggttcaaggagtctgagctcattcactgcagatgggctatgcttgctgttccagggattctagtaccagaggctttgggattgggcaactgggtaaaggcacaagagtgggctgccgttccaggaggccaagccacctacttaggcaacccagttccatggggcacattgcccacaattttggtcatcgagttcctttccattgcttttgtagagcaccaacgcagcatggaaaaggaccctgagaagaaaaagtaccctggtggagcttttgaccccttgggctactccaaggaccctaagaagtttgaggaatacaaagtcaaggagataaaaaacggccggctcgcattgttggcttttgtgggtttcgttgttcaacagtcggcgtaccctggcaccggacctttggagaatttggccactcacttggctgacccatggcacaacaacattggggacgtcattatcccaaaggggattttgccttgattatcccatgcaatattttgatttacacccactgtaaaaattaaaattccatgtaaccgtatgcaatgaatccgaacatcttgtctttggcatgcgtgagtgagtttacaagcaaacttttactatcccccttcatatcttagatctatctaaagaactgtattgaatatatcagttagttcttttctaaatctgcttcattattcttcaaaaaaaaaanaaaaaaaanccnanttttttggnaaaggtgngnttnananaaanntttgnttnnnantntgtngna

SEQ ID NO: 1116 - DNA, 1069 bp, Actinidia deliciosa
ctctctctctctctctctaggctgttgtcggaaacatctccaactctgagctagccatggcctccaatacactgatgagctacggcatggccgccgtcctccgcccgtcaatccaatctccttccaagtctaaatgcgccgccttgccgcttctaaaccgacgtgccgcttccaccacctgccggttttccatgtcggctgactggatgcctggccagccgcggccaccctaccttgatggctcagcccccggtgacttcggattcgacccgcttggcttaggtgaagtcccggaaaacctcgaaagatacaaggagtctgagctcattcactgcagatgggctatgcttgctgttccaggaatcctggttccggaggcattgggactgggcaactgggtgaaagcgcaagagtgggcagcgatccccggaggccaagccacctacttgggacaaccggtgccgtgggggaccctcccgaccatcctggtcatcgaattcctcgccatcgccttcgtggagcaccaacgcagcatggagaaggacacggagaagaagaagtaccccggtggagccttcgacccgctcggctactccaaggaccccgcaaagttcgaggagtacaaggtcaaggaagtcaagaatggccggcttgccttgttggcattcgtggggatctgcgttcaacaatcggcttacccgggcacgggaccgttggagaacttggctactcacttggctgatccatggcacaacaacattggggacgtcctcatccctagaactatctatccttgataaattttactcaaaaaatttgaaacttcatgtaacaatgtgtactgaggcaaaattgcatatgtttgaactctgtttgtgtagattgtaaaagtggtgttctgctctgactcttgtgctactttctatatcagttagcttttaggccaacttaattttattcttgtttgatgtgaagtagaaagttggtaagctatgaaattgcggatggcaagtttctaaaagggtaaattatgttttgtacccttgcagttcaattaatattttacttt

SEQ ID NO: 1117 - DNA, 927 bp, Centaurea maculosa
  misc_feature (24)..(24): n is a, c, g, or t
  misc_feature (29)..(29): n is a, c, g, or t
  misc_feature (906)..(906): n is a, c, g, or t
ggcgggggacaccatcccattcanaccanttctctccctaaatcctccatttccatatccctttttttcttcttctggaaatggcttctaatacattgatgagctgcggcatcccggccgtgggccgcccttcgatcctctcttcttccaggtcgagattcgcaacggccgtgcctctatcgggtgttgccaccaatgcgtctcggatctccatgaccgctgattggatgcccggtcaaccccgaccaccatacctcgatggatctgcacccggggatttcggatttgacccacttcgtctcggtgaggtccccgagaatctcgagcggttcaaagagtctgagctcattcattgcagatgggctatgcttgcagtgcccgggatcttgctaccggaagccttaggattgggcaattgggtaaaagcacaagaatgggctgccctccccggaggacaagcaacgtacctcggaaaccctgttccatggggtaccctacccaccattttggcgattgaattcatctccattgccttcgtagagcaccaaaggagcatggagaaagaccccgaaaagaagaagtaccccggtggcgcttttgaccccttgggctactcaaaagacccaaaaacatttgcagagtacaaggtcaaagagatcaagaacggacgactagcgttgttggcatttgtaggattttgtgtgcaacaatcggcttaccccggtaccggacctctcgagaacttggcaactcacttggctgacccatggcacaacaacattggtgatgtcattatccctaaaggaattttcccaaactaaaatatggctccaaataatctccatattcatatgtaaaatccatgtaaaccttcatcttgtaatgaaatgaacttatattagtgtngaattgctttttttccaattc

SEQ ID NO: 1118 - DNA, 881 bp, Taraxacum officinale
atcaccaccgccacaactactaaaatcctccgtttccagatccatattatcttctgggaatggcgtcaaatacattaatgagctgcggcatccccgccgtcggccgcccctcacttctctcctcctccaagtcaaggttcgctaccgctgtgccactttccggcgttgccaccaacgcatcccggatttccatgacctccgattggatgcccggtcaaccacgaccatcgtacctagacggatccgcacctggggattttgggtttgacccactccgcctcggtgaggtcccggagaacctcgagaggttcaaagaatccgagctcattcactgtagatgggctatgctggcagtcccagggatcttgttaccggaagcattaggattggggaactgggttaaagcacaagaatgggcggctcttcccggcggccaagcaacatacctcgggaacccagttccatggggtaccttacccacgattttggcgattgaattcatctccatagcattcgtagaacaccaaagaagcatggagaaagacccggaaaagaagaagtaccccggtggtgcttttgacccattgggctactcgaaagacccgaaaacttttgccgagtacaaggtcaaagagatcaagaacggacgtttggctttgttggcttttgtgggattttgtgtgcaacaatcggcgtaccctggtaccggacctttggagaacttggcaactcatttggctgacccatggcacaacaacattggggatgtgattatccctaaaggaattttcccaaactaagatatgcttttaagctccgaattcatattgtaaagtgcatgtaaaacgtttatcttgtaatgaaatgacttatattagtgt

SEQ ID NO: 1119 - DNA, 895 bp, Taraxacum officinale
atcaccaccgccacaactactaaaatcctccgtttccagatccatattatcttctgggaatggcgtcaaatacattaatgagctgcggcatccccgccgtcggccgcccctcacttctctcctcctccaagtcaaggttcgctaccgctgtgccactttccggcgttgccaccaacgcatcccggatttccatgacctccgattggatgcccggtcaaccacgaccatcgtacctagacggatccgcacctggggattttgggtttgacccactccgcctcggtgaggtcccggagaacctcgagaggttcaaagaatccgagctcattcactgtagatgggctatgctggcagtcccagggatcttgttaccggaagcattaggattggggaactgggttaaagcacaagaatgggcggctcttcccggcggccaagcaacatacctcgggaacccagttccatggggtaccttacccacgattttggcgattgaattcatctccatagcattcgtagaacaccaaagaagcatggagaaagacccggaaaagaagaagtaccccggtggtgcttttgacccattgggctactcgaaagacccgaaaacttttgccgagtacaaggtcaaagagatcaagaacggacgtttggctttgttggcttttgtgggattttgtgtgcaacaatcggcgtaccctggtaccggacctttggagaacttggcaactcatttggctgacccatggcacaacaacattggggatgtgattatccctaaaggaattttcccaaactaagatatgcttttaagctccgaattcatattgtaaagtgcatgtaaaacgtttatcttgtaatgaaatgacttatattagtgttgaatcgcttttgt

SEQ ID NO: 1120 - DNA, 890 bp, Lactuca sativa
accaccaccactaaaatcctccatttccatttcagattcatacattcttctgggaatggcttccaacacattacggcgcttatacatccccgccgtgggccgcccctcgcttctctcctcttccaaatcaagattcgccactgctgtgccactttccggagttaccaccaacgcatctcggatttccatgtccgccgagtggatgcccggacaaccacgaccaccgtaccttgacggatctgcacctggtgattttgggtttgacccacttggtcttggtgaggtcccagagaaccttgaaaggttcaaagagtcggagctcattcactgcagatgggctatgcttgcagtacctgggattttgttacccgaagcattaggattgggcaattgggtaaaagcacaagaatgggcagccctgcccggcgggcaagcaacatacctagggaacccggtgccatggggtaccctacccacaatcttggctatcgaattcatctccattgcattcgtagaacaccaaaggagtatggaaaaagacacggaaaagaagaagtaccccggtggtgcttttgacccattaggctactcaaaagaccctaaaaccttcgcagagtacaaggtcaaagagatcaaaaatggacgtttggctttgttggcatttgtgggattttgtgtgcaacaatcggcttaccctggaaccggacccttggagaacttggcaactcatttggctgacccatggcacaacaacattggagatgtcattattcctaaaggaattttcccaaattaatatgcaacatgcatgcttgcttttgagctccaaaattctcatatgtaaaggccttgtaaaacttcatcatgtaatccaatgaacttatattata

SEQ ID NO: 1121 - DNA, 973 bp, Cucumis sativus
cactctctcaatctcttctctctttttcttcaatggcttccaacaccttgatgagctgtggcattgccaccaccgctttcccttcagtcctttcttcttctaagtctaaattcgctgtcggtgtccccatttccggtgtcgctgtcaatgcatcttcccgattttccatgtccgctgagtggatgcccggccagccccgtcccccctacctcgatggctcagctcctggtgattttggattcgaccctcttgggctgggagaagtgccagagaacctcgagagattcaaggagtctgagctaattcactgcagatgggccatgcttgctgttccagggattttggtacctgaggctttgggattgggcaactgggttaaagctcaagaatgggcagcagttccaggaggccaagctacatacttgggacaaccagttccatggggaactttgcccaccattttggtcattgagttccttgccattgcttttgtagagcaccagcgcagcatggagaaagaccccgagaagaagaagtaccctggaggtgcttttgatccattaggctactcaaaagaccctgaaaagttgaaggaatacaaagtcaaagagatcaaaaacggtcgattggcgctattggcttttgttgggttctgtgtgcaacaatcagcatacccaggaacagggccgttggagaacttggcaactcacttggctgacccatggcacaacaacattggcgacattatcattcccagaacaatttcgccttgaattttgtactgaatcataccaattgtaattaagtttctgtgtattaaatctgaactcaaggctttcctctctatgtgcctttgaacgtgctctgtaacttgattttgaccttcattttagtgcatggtgttacaatttgaggaaggaaaaaaagggataagattacaaatttaatcttaaagctttggattgtatgtcta

SEQ ID NO: 1122 - DNA, 1001 bp, Malus domestica
ctcctttctcctccccacaaacccttaatcttgcaggcactaaatttgccaatggcttccaacactttgatgagctgtggcatcgccactactgccttcccttcagtcctctcatcctccaagtctaaatttgcgaccagcgcagtccagctcccaagtattggtgccaatgcctcctccaggttctccatgtccgccgagtggatgcccggcgagccccgccctccttacctcgacggctctgcccccggtgactttggatttgacccacttcggctaggagaagtgccagagaacttagagaggttcaaggagtccgagctcattcactgcagatgggcaatgcttgctgttccagggattctagtaccagaggctttgggattgggcaactgggtaaaagcacaggagtgggctgccgttccaggaggccaagccacctacttaggcaacccagttccatggggcactttgcctacaattttggtcatcgaattcctttccattgcctttgtagaacaccaacgcagcatggagaaggaccctgagaagaagaagtaccctggtggcgcttttgaccccttgggctactccaaggaccccaagaagttcgaggaatacaaagtcaaagaggtcaaaaatggccggcttgcgttgttggctttcgtcgggtttgttgttcaacaatcggcgtaccctggcaccggaccgttggagaacttggctactcacttggctgatccatggcacaacaacattggggatgtcatcatccccaaagggattttgccttgattaattcatgcagtattgatttcacacccactgtaaagtttagaattccatgtaaccatcttcgatgaatccgaacttcttgtcatgtgtgagtgagcttaaaagcaaacttttaccatcaccttcatattttagtattgataaagaactgtacttaaagatcatgcttgaatattcttgttaattatatttcagtgcctatatat

SEQ ID NO: 1123 - DNA, 1024 bp, Malus domestica
ctcctcccttcccctccctacaaaccctaaatcttgcaggcattagttaatcaaatggcttccaacactttgatgagctgtggcatcgccaccactgccttcccctcagtcctgtcatcctcaaagtctaaatttgcgaccagtgcagtccagctcccaagtgttggtgccaatgcctcctcaaggttctccatgtcagccgactggatgcccggcgagccccggcctccttaccttgatggctctgcacccggtgactttggatttgacccacttcggctaggagaagtgcccgagaacttggagaggttcaaggagtctgagctcattcactgcagatgggcaatgcttgctgtaccagggattcttgtaccagaggctttgggattgggcaactgggtaaaagcacaagagtgggctgccgttccaggaggtcaagcgacctacttaggcaacccagttccatggggcactttgcctacaattttggtcatcgaattcctttccattgcctttgtagaacaccaacgcagcatggagaaggacactgaaaagaagaagtaccctggcggggcttttgaccccttgggctactccaaggaccccaagaagttcgaggagtacaaagtcaaagagataaaaaatggccggctcgcgttgttggctttcgttgggtttgttgttcaacaatcggcgtaccctggcacaggaccattggagaacctggctactcacttggctgacccatggcacaacaacatcggggatgtcctcatccccaaagggattttgccttgattattacgtgcagtattgattttacacccactgtaaaaattaaaattccatgtaaccatcttcaatgaatccgaagttctggccatgttgtgtgagtgagtttagaagcaaactttaccatcgccttcatattttagtattgataaagaactgtacttaaacatcaatactgaatatatcagttagttcttgtcaagtatatatatttcagttcctataatgatga

SEQ ID NO: 1124 - DNA, 962 bp, Cucumis melo
cactctctctctcaatctcttctctctttttcttcaatggcttccaacaccttgatgagctgtggcattgccaccaccgctttcccttcggtcctttcttcttctaagtctaaattcgcagccgctgtccccatttccggtgtcgctgtcaatgcatcttcccgattttccatgtcctctgagtggatgcccggccagccccgtcccccctacctcgatggctcagctcctggtgattttggattcgaccctcttcggctgggagaagtgccagagaacctcgagagattcaaggagtctgagctaattcactgcagatgggccatgcttgctgttccagggattttggtacctgaggctttgggattgggcaactgggtgaaagctcaagaatgggcagcagttccaggaggccaagctacatacttgggacaaccagttccatggggaactttgcccaccattttggtcattgagttccttgccattgcttttgtagagcaccagcgcagcatggagaaagaccctgagaagaagaagtaccctggaggtgcttttgacccattaggctactcaaaagatcctgaaaagttgaaggaatacaaagtgaaagagatcaaaaacggtcggttggcgctattggcttttgttgggttctgtgtgcaacaatcagcatacccaggaacagggccattggagaacttggcaactcacttggctgacccatggcacaacaacattggcgacattatcatccccagaacaatttcgccttgaattttgtactgaatcataccaattgtaattaaagtttctgtgtattaaatctgaactcgaggctttcctctatatgtgccttcgaaacgtgctctgtaacttgattttgaccttcattttagtgcatggtgttacaatttgaggaaggaaaagggataaaattacaaatttaatctttgagcttt

SEQ ID NO: 1125 - DNA, 972 bp, Artemisia annua
ccaaaaatctctacctattagttataccattctcaccacaaaacattattcatcaaccaatatcacactactactactactactaaatatttcatttctagactcatattttgtttctaggaatggcttctaacacattgatgagttgcggtattgccgcggtagcccgcccatccatgttctcttcttccaagtcgagattcgcaacggccgtgccactttctggagttgcaaccaacgcgtctcgggtttctatgactgcggactggatgcccgggcagcctagaccaccttacctagatggatcagcacccggtgactttgggttcgacccacttcgtctaggtgaggttccatcgaacctcgagaggttcaaggagtccgagctcattcactgcagatgggctatgcttgctgttccagggatcttgctacctgaagctttaggtttgggcaattgggtaaaagcacaagaatgggctgctgtcccgggaggacaagcaacctacctagggaaccccgtcccatggggtaccctacccacaattttggccatagagttcgtctccattgccttcgtagagcaccaaaggagcatggaaaaggaccccgaaaagaaaaagtaccccggtggcgcttttgacccattgggctactcaaaagacccaaaaacgtttgccgagaacaaggtcaaagagattaaaaatggacgtctagcgttgttggcatttgttggtttcgttgtgcaacaatcggcttaccctggtaccggacccttggagaacttggcaactcacttggctgacccatggcacaacaacattggggatgtcattatccctaaaggaattttcccaaactaaaatacactaccggtctccaaattcatatgtaaaatccatgtaacctgtcgtcttgtaatgaatggaacttatattagtgttgaattacttttgcgagcttaaagtttat

SEQ ID NO: 1126 - DNA, 1118 bp, Artemisia annua
cattgacgagcttcttttcccaaataagtcccttcttgctaaagacaccaaaaatctctacctattagttataccattctcaccacaactaacaatacactactactactactactactaaatatttcatttctagactcatattttgtttctaggaatggcttctaacacattgatgagttgcggtattgccgcggtagcccgcccatccatgttctcttcttccaagtcgagattcgcaacggctgtgccactttctggagttgcaaccaacgcgtctcgggtttctatgactgcggactggatgcccgggcagcctagaccaccttacctagatggatcagcacccggtgactttgggttcgacccacttcgtctaggtgaggttccatcgaacctcgagaggttcaaggagtccgagctcattcactgcagatgggctatgcttgctgttccagggatcttgctacctgaagctttaggtttgggcaattgggtaaaagcacaagaatgggctgccgtcccgggaggacaagcaacctacctagggaaccccgtcccatggggtaccctacccacaattttggccatagagttcgtctccattgccttcgtagagcaccaaaggagcatggaaaaggaccccgaaaagaaaaagtaccccggtggcgcttttgacccattgggctactcaaaagacccaaaaacgtttgccgagtacaaggtcaaagagattaaaaatggacgtctggcgttgttggcatttgttggtttcgttgtgcaacaatcggcttaccctggtaccggacccttggagaacttggcaactcacttggctgacccatggcacaacaacattggggatgtcattatccctaaaggaattttcccaaactaaaatacactaccggtctccaaattcatatgtaaaatccatgtaacctgtcgtcttgtaatgaatggaacttatattagtgttgaattacttttgcgagcttaaagtttattatttcgtcgttacatttatcttccaactatacttaggtacaaatttatttggcaactgtttgtatcattagcatgtttaacatattgttatctactaatacttatgtggc

SEQ ID NO: 1127 - DNA, 1075 bp, Artemisia annua
acaccaaaaatctctacctattagttataccattctcaccacaactaacaatactactactactactactactaaatatttaatttctagactcatattttgtttctaggaatggcttctaacacattgatgagttgtggtattgccgcggtagcccgcccatccatgttctcttcttccaagtcgagattcgcaacggctgtgccactttctggggttgcaaccaacgcgtctcgggtttctatgactgcggactggatgcccgggcagcctagaccaccttacctagatggatctgcacccggtgactttgggttcgacccacttcgtctaggtgaggttccatcgaacctcgagaggttcaaggagtccgagctcattcactgcagatgggctatgcttgctgttcctgggatcttgctacccgaagctttaggtttgggcaattgggtaaaagcacaggaatgggctgctgtccctggaggacaagcaacctacctagggaaccccgtcccatggggtaccctacccacaattttggccatagagttcgtctccattgccttcgtagagcaccaaaggagcatggaaaaggaccccgaaaagaagaaataccctggtggcgcttttgacccattgggctactcaaaagacccaaaaacgtttgccgagaacaaggtcaaagagattaaaaatggacgtctagcgttgttggcatttgttggtttcgttgtgcaacaatcggcttaccctggtactggtccattggagaacttggcaactcacttggctgacccatggcacaacaacattggggatgtcattatccctaaaggaattttcccaaactaaaatacactaccggtctccaaattcatatgtaaaatccatgtaacctgtcgtcttgtaatgaatggaacttatattagcgttgaattacttttgcgagcttaaagtttattatttcttcgttacatttatcttccaactatacttaggtacgaaatttatttggcaactgtttgtatcattagcatgtttaacgcgattgttatctactaatacttatgtggca

SEQ ID NO: 1128 - DNA, 888 bp, Senecio madagascariensis
ccatttccggatttgatcattttactctgggaatggctgctaatacattaatgagctgcggtatcgcgcctttaggccgtccttccatgttttcgtcttccaagtccagattcgcaacggctgtgccattttcggccgttgctactaatggctcgcggttgtccatgacttctgattggatgcctggacaaccacgaccatcttacctagatggatccgcacccggtgatttcgggtttgacccacttggtcttggttcggtccctgagaatctcgaaaggttcaaggagtccgagctcattcactgcagatgggctatgcttgcagttcccgggatcttgttacccgaagcgttaggattgggaaattgggttaaagcacaagaatgggctgctcttcccggtggacaagcaacatacttagggaaccctgttccatggggtactttacccaccattttggcaatagagtttatctcgattgctttcgtagagcaccaaaggagcatggaaaaagacaccgaaaagaagaagtaccccggtggcgcttttgacccattaggctactcaaaagacccaaaaacgttcgcagagtacaaagtcaaggagatcaaaaatggtcgtctagcgttattggcattcgttggattctgtgtgcaacaatcggcttaccctggtaccggacccttggagaacttagcaactcacttggctgacccatggcacaacaacattggagatgtcgttattcctaaaggcattttcccaaactaaaatacactatcgatctccgaattcatatgtaaaatccatgtaaactctgtcttgtaatgaaatgaacttatattagtgttgaattccgtttgtgaattcaaaaagattatcgcaa

SEQ ID NO: 1129 - DNA, 1039 bp, Fragaria vesca
cttcacatttccatactcaataaccagtctaagtctccttggccacaacagaaaaattttgcagagaaggagttgaatcaacttaaatggcttccaacactttgatgagctgtggcattgccaccacagccttcccttcagtcctatcttcctccaagtctaaattcgccactgcagtccagctccctagtgttggcgccaatgcttcctccaggttctccatgtcagcggagtggatgcctggccagccccggcctccttacctcgatggatccgctccaggtgactttggatttgacccgcttagactaggagaagtaccagagaacttggagaggttcaaggaatctgaactgattcactgcagatgggctatgcttgctgttccagggattctagtaccagaagcattggggttaggcaactgggtaaaggcacaagaatgggcagcacttccaggaggccaagcaacttacctaggcaatccagttccatggggaactttgcctacaattttggtcatcgagttcctctccattgccttcgtagagcatcaacgtagcatggaaaaggatccggagaagaagaagtaccctggtggagctttcgaccccttgggatactccaaggacccaaagaagttcgaggaatacaaagtcaaagaggtcaaaaatggtcggcttgcattgttggcttttgttggattcgtagttcaacaatcggcgtaccccggcaccggaccgttggagaatttggccactcacttggctgatccatggcacaacaacattggggacatcattatccccaaagggcttttgcctaattgatattatgcaatatcaatttactttgaccccctgtaaaattccatgtaatcatctgcaatgaaccatagctcgattcatctctttggcatgtttatgagtgagcttagaagaagcaaacgtttaccatcagatttatattgattgagtatctgaaagaactgtacttaaagattatcgttgaatacatcagtagttcttgttcatatttt

SEQ ID NO: 1130 - DNA, 1045 bp, Helianthus annuus
  misc_feature (968)..(968): n is a, c, g, or t
  misc_feature (978)..(978): n is a, c, g, or t
  misc_feature (987)..(987): n is a, c, g, or t
atcaccaccactactgttaccaactaaaactattcatttccagattaagtttttgttctgggaatggcttctaatacattaatgagctgcggcatctccgccgtttgccggccgtcgcttttctcgtcttctaagtcgagattcgcaaccgctgtcccgctttctggtgttgccaccaatgcttcccggatttccatgaccgctgactggatgcccggtcaaccacgaccaccctacctagacggatctgcacccggggatttcgggtttgacccacttcgtcttggtgaggtcccagagaacctcgagaggttcaaagagtctgagctcattcactgcagatgggctatgcttgcagttccagggattttgttaccagaagccttagggttgggcaactgggtaaaagcacaagaatgggctgctgtacccggaggacaagctacatacctcgggaaccctgttccttggggtaccctacccaccattttggccatagagttcgtctcaatcgccttcgtagagcaccaaaggagcatggagaaagaccctgaaaagaagaagtaccctggtggcgcttttgaccccttgggctactcaaaggacccaaagaagtttgaagagtacaaggtcaaagaaatcaaaaatggacgcttagcgttgttggcatttgtgggattttgcgtgcaacaatcggcttaccctggtaccggacccttggagaacttggcaactcacttggctgacccatggcacaacaacattggagatatcgttattcctaaaggagttttcccaaactaaaatacgctaccaatctccgaattcatatgtaaaatacatgtaactcttcgtcttgttatgaaatgaacttatattagtgttgaactgtttttgtgaatttaaaagttcgtttcgaatttccgttagtattttatgtttctattacatgggattgtaaaatacgntcagtatagnagttatcgntataaatcgatgaaaattttgacgggaaaaaattttagtgcaaaacccgaaaacttgt

SEQ ID NO: 1131 - DNA, 981 bp, Helianthus annuus
accacaaaaatctcaaccatattacttgcatcaacttcaccactattgttcatccaccaccactactgttaccaactaaaactattcatttccagattaagtttttgttctgggaatggcttctaatacattaatgagctgcggcatctccgccgtttgccggccgtcgcttttctcgtcttctaagtcgagattcgcaaccgccgtcccgctttccggtgttgccaccaatgcttcccggatttccatgaccgctgactggatgcccggtcaaccacgaccaccctacctagacggatctgcccccggggatttcgggtttgacccactccgtcttggtgaggtcccagagaacctcgagaggttcaaagagtctgagctcattcactgcagatgggctatgcttgcagttccagggattttgttaccagaagccttagggttgggcaactgggtaaaagcacaagaatgggctgctgtacccggaggacaagctacatacctcgggaaccctgttccttggggtaccctacccaccattttggccatagagttcgtctcaatcgccttcgtagagcaccaaaggagcatggagaaagaccctgaaaagaagaagtaccctggtggcgcttttgaccccttgggctactcaaaggacccaaagaagtttgcagagtacaaggtcaaagaaatcaaaaatggacgcttagcgttgttggcatttgtgggattttgcgtgcaacaatcggcttaccctggtaccggacccttggagaacttggcaactcacttggctgacccatggcacaacaacattggagatatcgttattcctaaaggagttttcccaaactaaaatacgctaccaatctccgaattcatatgtaaaatacatgtaactcttcgtcttgttatgaaatgaacttatattagtgttgaactgtttttgtgaatttaaaagttcgtttcgaatttccgtta

SEQ ID NO: 1132 - DNA, 1691 bp, Catharanthus roseus
atccaaagaattcggcacgagggttcaattatttgtctgagaaaatggggagtagagctatatttatgatgatgcgctcatcaacgatttctgctggaattttcttcaatttgaagagaagtagttttccaattgttaaaaatgttgaacaacatagcaagaagcagtcaattcgtaattattcacaagaaaaatccagtcttgagtctcctgctgatgttgctcgtttggctgaaactgctcgtatttctctcaccccagatgaagtggaagaatttgctccgaagattagacaagtcgtagactggtttgggcaacttcaagcagttgatcttcagagtattgaaccatcaataagagcagataccgaaggcgataatatacgagatgatcttcctgcaacttttgaaaacagggaatccataataagttctataccgagttacgaagagccttatatcaaagttccaaaagtattaaacaaggagtaaggatgcacagatgatgatgacatttggaatcttgagcatgcaatggggatctctgatttgctgcggatgaatggtgcctgttttaggccttttcttcactctctttttcacggcataccctgcttctgtattgtttgtttttaacactattgccggtttacctcgatggcgttccagatattattaacatgaagtagaacaaattgattctcaaatgcaaacatgttcaacacttgcaaagtgatttgcatttattaaatgaagtattctcgataattctgcaaaaaaaaaaaaaaaaaaccctcgtgccgaattcggcacgaggcgccactcagatcttcaaatttgtctaaaaaatggcggccaatacattgatgagctgtggcgttgccgccgtttgtccatctgttctttcttcttctaaatccaaattcgcctcctctttgccgctgcctagtggtgtcgctgccgctaatggctcagctaaaatgtctgccgattggatgcccggtcagcctagacctccatatctcgatggatcagcccctggagacttcgggtttgacccgcttcgtcttggtgaagtaccagagaacctggagaggtacaaggaatctgaactcatccactgtagatgggctatgcttgcagtgcctgggattttggtaccagaggccttaggttatggaaactgggtaaaggctcaagaatgggcagcagttcctggaggacaagcaacttacttgggaaatccagtgccatggggtacccttcctaccattttggttatagaattccttgccattgcttttgtagagcaccaaagaagtatggagaaagacccggagaaaaagaagtaccctggtggagcttttgatcccttgggctactctaaagacccggctaaattcgaagaacttaaagtcaaggagatcaagaatgggagacttgcattgttagcatttgtgggattttgtgttcaacaatcggcataccctggaacaggtccactggaaaacttggctactcacttggcagacccatggcacaacaacattggggatatcattatccctacatcacttttgccttgaagcataccctttgtaaaaaaaaaactctcttgtaacatcaatggatattaatgttgaatgcgcacggtgtatccttcaatataatctagacataatttgtttaatt

SEQ ID NO: 1133 - DNA, 995 bp, Helianthus annuus
agcatttggatattgcattttatcacccaaaaaaactcctccataatacttgtacaaaactcatcaccaccattattcattcaccacaactaacaaaacctcctgttcaagatccacaattcttctgggaatggcttctaattcgttaatgagctccggcatccccggcgtgtgccgccccgcggtcctgtcttcatctaagtcaagatttgcaactgctgtgcctctttcaggtgttgccaccaatgcttctaggatttccatgaccgctgattggatgcccggtcaaccacggccaccgtatctagacgggtctgcacccggggattttgggttcgacccacttcgtcttggtgaagttccggagaacctcgagaggttcaaagagtctgagcttattcactgcagatgggctatgcttgcagtgccagggattttgttaccagaagccttaggattgggcaactgggtaaaagcacaagaatgggctgctgtcccaggaggacaagctacatacctaggaaaccctgttccttggggtacactacccacaattttggccatagagttcatctccattgcttttgtagagcaccaaaggagcatggaaaaagacccagaaaagaagaagtacccaggcggcgctttcgacccattgggctactcaaaagacccgaaggcgttcgcagagtacaaagttaaagaaatcaaaaacggacgtctagcgttgttggcattcgtgggattctgtgtgcaacaatcggcttaccctggtactggacccttggagaacttggcaactcacttggctgacccatggcacaacaacattggagatatcatcattcctaaagggattttcccaaactagaacacaccaccgacctcagaattcatatgtaaaatccatgtaaaccttcatcttgtaatgaaatgaacttatattagtgttgaactggttttgtgaacttgaaatttcatttcaacttttttgt

SEQ ID NO: 1134 - DNA, 958 bp, Gossypium hirsutum
ctacccaaaaaaaaaaataagaacacacaacaatggccgccaacacactaatgagctgtggcatagccaccacatttccttcacttctttcctcatcaaagtccaagttcagtggcgccgccgtatcgttgcctagtgctgttggtaccaatgttggccaccgtgttagcatgtcagctgactggatgcctggtcaacctagaccaccttaccttgatgggtcagcaccaggtgactttgggtttgacccactaagactaggtgaggtccctgagaaccttgagaggtacaaagaatctgagttgattcactgcagatgggctatgcttgctgttccaggtatattggtaccagaggccttagggttaggaaactgggtaaaagctcaagaatgggcagcaattccaggtggccaagccacttacttagggaacccagtcccatggggtaccctccccaccatcttggtcattgaattcctatctatcgccttcgttgagcaccaacgaagcatggagaaggacaccgagaagaagaagtaccccggcggcgctttcgaccccttgggattctccaaggaccccaaaaagttcgaagaatacaaggtcaaagagatcaagaacggtcgtctagcattgttggcatttgtgggattctgtgttcaacaatcagcttacccaggcactggaccattggagaatttggctacacatttggctgatccatggcacaacaacattggagatgttatcattcctagatcactttacccttagattatgatagattgatggaatattttaaatgtaatgtccgttcttccattgcgtaaaacatatgtaatgaattctaatttgatggctttgttatgtgtaattataatttttatatgatctgaatgtcttaaattttgtaaactttttatctatcaaaaaatttacaattggattattgtaaa

SEQ ID NO: 1135 - DNA, 877 bp, Gossypium hirsutum
ttttcctcccatggccgccaccaacacattgatgagctgtggcatcgccaccgctttcccttcagtgctttcctcttcaaagtccaagttcgccaccgctacgccgttgcctagctttggcgccaatgttggccaccgtgttagcatgtcggctgactggatgcctggtcagcctaggcctccttatcttgatggttcagcacctggtgactttggatttgatccacttagacttggtgaggtgccggagaaccttgagaggtacaaggaatctgagttgattcactgcagatgggctatgcttgctgttcctggtatattggtgccagaggcattggggtatggaaactgggtaaaggcacaagaatgggcagccgttcctggtgggcaagccacttacttaggcaaccctgttccatggggaactctcccaacaatcttggtcatcgagttccttgccatcgccttcgtcgagcaccaacgcagcatggagaaagataccgagaaaaagaagtaccccggcggtgctttcgaccccttgggatactccaaggaccctaaaaagttcgaggaatacaaagtcaaagagatcaagaacggtcgtttggcattgttggcgtttgtgggattttgtgttcaacaatcagcttaccctggaactggaccattggagaacttggcaactcacttggctgatccatggcacaacaacattggagatattatcatccccagatcaatttccccttgaatgatggaacattttaaaatgatgtccattgcccactgtgtaaaactcccatgtaatccataattccacatgtaatgtaatgaatcagggttcatgacttttacctatactatatagaccatcatc

SEQ ID NO: 1136 - DNA, 1096 bp, Beta vulgaris
  misc_feature (625)..(625): n is a, c, g, or t
  misc_feature (712)..(712): n is a, c, g, or t
  misc_feature (763)..(763): n is a, c, g, or t
  misc_feature (785)..(785): n is a, c, g, or t
  misc_feature (1064)..(1064): n is a, c, g, or t
gcttctttcattcttccccttctgggccaattttgttttaccttagctgaagagcttagctatggcttccaacgcattaaccagttgcggcatcgctgccgtattcccttcttctctttcttcttctaagtctaagtttgctgcctctgtaccattagttaatctatcttgcaatgtctcgtctcggttcaccatgtctgctgaatggatgcccggtcaacccaggccaccctaccttgatggatcagctcctggggactttggatttgacccacttcggcttggggaggtaccagaaaatctggaaaggttcaaggagtctgagctcattcattgcagatgggcaatgcttgcagtgccagggattctagtacctgaagccttaggattaggaaactgggtaaaagctcaagaatgggctgcccttcccggaggtcaagcaacctacttaggcaaccccgttccatggggaaacctacctaccattttggcaattgaattcctagcaatcgcattcgtagagcaccaaagaagcatggagaaagactctgagaagaagaagtacccgggtggagctttcgacccgttgggttactctaaggacccaaagaagttcgaggagttnaaggtgaaagagatcaaaaatggtcgccttgcattgttagctttcgttggattttgtgttcagcaatcagcctatccaggaacaggnccattggaaaacttggctactcatttggcagacccatggcacaataacatnggagacattcttattcctccancactttaatttctccttgaatgtacgatgacggtcaagaaccatacatgctgtaaaaatcgaaatcagaagcatttgtaatgatatttgtgtgattaaacattgagatatgctttagaagaatggctatgagaaattgagaacaacacagtctagaagataaacttgtttccatcacacctgcaagtcccatgacaactaaaaaaaataagaagtgcatgaacatgatcataagaagaaagcaacattttttttgtatattagtgaatattgaaaattntattagtgtagacacctacattccatctccta

SEQ ID NO: 1137 - DNA, 942 bp, Ricinus communis
tcctcaactcacacatattcttctccaccgctaacgcttttgctactgctactgctactgctaccacccaatattcagatactgagaaaatggccactaacacattgatgagctgtggcattgccactgctttcccttctcttctttcttcttccaagtccaaatttgcttcttctgttcctcttccttgtgttaatggctcatcttcacgtatcaccatgtctgctgattggatgcctggccagccccgcccgccttatcttgatggctcagctcctggtgactttggattcgaccctcttcggctaggtgaggttccagagaatcttgaaagatttaaggagtctgaactcattcactgcagatgggctatgctcgctgtgcctggaatcctagtaccagaggccttgggtttgggcaactgggtgaaggcacaagagtgggctgcaattccaggtggtcaagcaacttacttaggccaaccagttccgtggggaacccttcctacaattttggtgattgagttcttagccattgcctttgttgagcaccaacggagcatggagaaagaccctgagaagaagaagtacccaggtggtgcttttgatcccttgggttactccaaggaccctgctaagttccacgaatacaaggtcaaggaaatcaagaatggtcggctagcactgttagcatttgttgggatctgtgtgcaacaatcagcatacccaggcactggaccattggagaacttggcaactcacttggctgacccatggcacaacaacattggggatataatcatccccacatcgttttcaccttgaagaaatttttttgtacccgttgtaaaatcctttgtaacaatctttgtaatgaaacagaattaccatatgtttggtccgtgtagaatgagaaagtatcttatgttttgtatggttctgc

SEQ ID NO: 1138 - DNA, 980 bp, Castanea mollissima
attcattctccctttggttcctctccaaaaacacaaaacttcaatcagagacaaatggctgccaacagattgatgagctgtggcatcgccaccacagctttcccatcagtcctctcttcttcaaagtccaaatttgccacagctacccctctttctagtgctggtgccaatgcctcgtcccgctttaccatgtcggccgagtggatgccaggtcagcctcgccctgcacacctcgatggctcggcacccggtgactttggatttgacccacttgggctaggtgaagttccagagaaccttgaaagatttaaggaatccgaactcatccactgcagatgggctatgcttgctgttccaggaatcctagtaccagaggcgttgggattggggaactgggtgcaggctcaggagtgggctgcaattccaggaggccaagccacatacttgggaaacccagtaccatggggtaccctacccaccattttggttattgaattcctttcaattgccttcgttgagcaccaacgtagcatggagaaagaccctgagaagaagaagtaccccggtggtgcttttgaccccttgggctactccaaggaccctaaaaaattcgaggaatacaaggtcaaagagattaaaaatggtcggctagcattgttggcttttgtggggttctgcgttcaacaatcagcttatcctggcacaggaccattggagaacttggctactcacttggctgacccatggcacaacaacattgggaatgtgattatcccaagagggttgtaattttgatcatactttcactgtaaaagtccatgtgacattctgtaatgaatcgggatttctttggtctgtgtaattataagcttagaagtgctacattttattaactttcactttggtacctaaaaatactgtgaaaattagtgtacttgtttgattctagtaaatggaaaacaagtctagataattcgtgg

SEQ ID NO: 1139 - DNA, 917 bp, Cynara scolymus
  misc_feature (256)..(256): n is a, c, g, or t
  misc_feature (471)..(471): n is a, c, g, or t
  misc_feature (547)..(547): n is a, c, g, or t
  misc_feature (607)..(607): n is a, c, g, or t
gggatctcaccaccaccaccaccacttctttctctaatcctccatttccatatcccattttttcttctggaaatggcttctaatacattaatgagctgcggcatccccgccgtcggccgcccttcgcttctctcttcttccaagtcaagatttgcagcggctgtgcctctatccggtgttgccaccaatgcttctcggatctccatgacagctgattggatgcccggtcaaccccgaccaccatatctagatgganctgcacccggggatttcggatttgacccacttcgtcttggtgaggtcccagagaacctcgagaggttcaaagagtcggagctcattcactgcagatgggctatgcttgcagttccagggatcttgctaccggaagccttaggattgggcaattgggtaaaagcacaagaatgggctgctctccccggaggtcaagcaacatacctagggaacccngttccatggggtaccctgcccaccattttggcgatcgaattcatctccattgccttcgtagagcaccaaaggagcntggaaaaagacccagaaaagaagaagtaccccggtggcgcttttgacccattgggctacncaaaagaccccaaagcatttgcagagtacaaggtcaaagagataaaaaacggacgtttagcgttgttggcatttgtgggattttgtgtgcaacaatcggcttaccccggtaccggacctttggagaacttggcaactcacttggctgacccatggcacaacaacattggagatgtcattattcctaaaggaattttcccaaactgaaatatgggttcccaatgatctccaaattcatatgtaaaatccatgtaaacccttcatattgtaatgaaatgaacttatatattagtgttgaattgctttctatc

SEQ ID NO: 1140 - DNA, 874 bp, Populus trichocarpa
cctgtactgacctcaatttctccatcacccattctcaaaaacgcagcttcacacttgttcacgggttctaagagaatggccaccaatacattgatgagctgcggcattgccaccgctttcccttcacttctttcatcttcaaagtccaaattcgcctcttcaattccacttcccagtgtcaatggcacctctcgtgtcaccatgtctgctaactggatgccaggccagcctcgtccaccttacctcgatggctcagcccccggtgactttgggttcgacccacttcgactgggcgaggtccctgagaatctggagagatacaaggagtccgaactcattcactgcagatgggctatgcttgctgttcctggaattctggtaccagaggccctgggtctgggcaactgggtaaaagctcaagagtgggctgcaactccaggtggccaagctacttatctgggccaaccagttccatggggaaccctccctatcattctggccattgaattcgttgccattgcctttgttgagcaccaacgtagcatggagaaagacacagagaagaagaagtaccctggtggtgcttttgatcctctaggatactccaaggaccctcagaagttcgaggaatacaaagtcaaggaaattaagaatggccgtctagcactgttggcatttgttgggatctgtgtgcaacaaacagcttatcctggtactggaccattggagaacttggcaactcacctggctgacccatggcacaacaacatcggggacgttctcatccctagatcggtctcgccttgaaaaatcaaatattgtattgcttatctactgtaaccatctgcaatgaaacaggatttcattatcattc

SEQ ID NO: 1141 - DNA, 854 bp, Euphorbia esula
ctcttcttcttcttctccatcaattcaattccacaatcatagaatggctgctaagacattgatgagctgtggaatagccacagcttttccttctcttctttcatcttctaaatcgaaattcgcatcttcgattcctcttccagctgttaatggctcttctcgtatctccatgactgctgattggatgcctggacagccacgtcctccttatctagatggatctgctcctggtgattttggattcgacccgcttagattgggagaagttccagagaatctagagagattcaaggagtctgaactcgtccactgcagatgggctatgctcgctgttccagggatgttagtgccagaggcattgggtttaggcaactgggtaaaggcacaagagtgggcagcccttccaggaggtcaagcaacctaccttggacaacccgttccatggggtaccctccctaccattttggtcattgagtttctagccattgcctttgttgagcaccaacgcagcatggagaaagaccccgaaaagaagaagtaccccggtggtgcttttgaccctctaggctactctaaggaccctgccaagtttgaagagtacaaggtcaaggaaatcaagaacggtcggctagcattgttggcttttgtgggtttctgtgttcaacaatccgcatacccaggaaccggaccattggagaacttggcaacccatttggctgacccatggcacaacaatattggagatattatcatccccaaaggccttttgccttgaacttttccaactctttttcttgtgcttcccactgtaaaattccatttaaccagctctaatgatgaaacataagttccat

SEQ ID NO: 1142 - DNA, 996 bp, Helianthus annuus
acaatcagcatttggatattgcattttatccccaaaaaaactcctccataatacttgtacaaaactcatcaccaccattattcattcaccacaactaacaaaaacctcctgttcaagatccatacttcttctgggaatggcttctaattcgttaatgagctccggcatccccggcgtgtgccgccccgcggtcctgtcttcatctaagtcaagatttgcagctgctgtgccactttcaggtgttgccaccaatgcttctaggatttccatgaccgctgattggatgcccggtcaaccacggccaccgtatctagacgggtctgcacccggggatttcgggttcgacccacttcgtcttggtgaagttccggagaacctcgagaggttcaaagagtctgagcttattcactgcagatgggctatgcttgcagtgccagggattttgttaccagaagccttaggattgggcaactgggtaaaagcacaagaatgggctgctgtcccaggaggacaagctacatacctaggaaaccctgttccttggggtacactacccacaattttggccatagagttcatctccattgcttttgtagagcaccaaaggagcatggaaaaagacccagaaaagaagaagtaccctggcggcgctttcgacccattgggctactcaaaagacccgaaggcgttcgcagagtacaaagttaaagaaatcaaaaacggacgtctagcgttgttggcattcgtgggattctgtgtgcaacaatcggcttaccctggtactggacccttggagaacttggcaactcacttggctgacccatggcacaacaacattggagatatcatcattcctaaagggattttcccaaactagaacacaccaccgacctcagaattcatatgtaaaatccatgtaaaccttcatcttgtaatgaaatgaacttatattagtgttgaactggttttgtgaacttgaaatttcatttcaacttt

SEQ ID NO: 1143 - DNA, 950 bp, Triphysaria pusilla
cattcttatccaactcttcatccaagaatcaaaaatagtccaccatggcagctaatgcattgatgagctgtggcgtcgccgccgttcggccctccatcctctcctcctccaagtcgaaattcgccgcccctgcgagtttcgccaccaatgccaccacctctaggttctccatgtccgccgagtggatgcccggcgagccccgcccaccttacctcgacggatcggccccgggagattttggattcgacccacttcgtctaggagaagtcccacaaaatcttgagagatacaaggaatctgaattaatacactgcagatgggctatgcttgctgttcctggaatacttgtgcctgaggcattgggcctgggcaactgggtcaaggcccaagaatgggcagcccttccgggtgggcaagccacttatttgggcaacccggttccatggggtaccctacccacaattctggctatagaatttttggcaattgcctttgttgagcatcaaaggagcatggagaaagacccggaaaagaggaagtaccccggtggagcttttgacccgttgggctactccaaagactcaaaaaagcttcaagagctcaaaatcaaggaagtaaaaaatggtcgtcttgctttgttggcatttgtgggcttttgcgtgcaacaatcggcgtacccaggcacaggcccgttggagaacttggcaactcacttggctgatccatggcacaacaacatcggtgacatcgtcattccttcaggaatttttcctaattaaatcaacttttgtgacagtatcccacattgtaaaattcttcaaatattaataatattgtgtattgaatttatcttatgaatttagttgacgtatgtttattaatatatgaatggtgagatcaagacataaaaaactgcaatgctgaaaatcataattattattattgttcca

SEQ ID NO: 1144 - DNA, 1014 bp, Ipomoea nil
cacttccatctcttcttcatccccaagcccattttctcccttcccgacaatttccctcgatcgctcaaagaaaaaatggcgtccagattgatgagctgcggcgtcgcagccgtttgctcctccgttctctcttcttctaagtccaagttcgccaccgccgtgcccttgcccgtcgccgcaaatgtcaccgcctccggcaggatcaccatgtcctcctccgactggatgcccggccagccccgtccaccttacctcgacggctctgcacccggagacttcgggttcgacccacttgggctaggagaagtgccagaaaaccttgagagatacaaggaatctgagctcatccactgcagatgggctatgcttgctgtgcctgggatcataataccagaggcattgggtttggggaactgggtaaaggcacaagaatgggcagcgattccaggaggacaggcgacgtacctgggacagccggtgccatggggcacacttcctaccattttggccatcgaattcctggccattgcattcgtggagcaccaaagaagtatggagaaagacactgagaaaaagaagtaccccggtggcgccttcgaccccttgggctactccaagcaggaccctgctaaactccacgagctcaaagtcaaggagatcaagaacggtcgccttgcgttgttggcattcgtgggaatctgcgttcagcagtcggcgtacccaggaacaggaccgctggagaacttggcgagccacttggcggatccatggcacaacaacatcggagacattcttatccctagaactatttcgccctgaaaattatattaatgtaaaactccgatccgatgaacacaaatttgtaatccactgaacttcattgtgaatctttgggtctgtataagtacataccaattttatatgtgagctccatgttactactagagaaaaaggtaacttgctaggtaccgtgttttgtgtttgataaagttttactctttatatataagagtc

SEQ ID NO: 1145 - DNA, 986 bp, Ipomoea batatas
tttctcccttcccggccattcccctccatcgctcaaccaaaaaattaatggcgtccaaattgatgagctgcggcgtcgcagccgtttgctcctccgttctctcttcttctaagtccaagttcgccgccgccgtgcccttgcccgtctccgcaaatgtcaccgcctccggcaggatcaccatgtccgcggactggatgcccggccagccccgcccaccttacctcgacggctctgcacccggagacttcggcttcgacccacttcggctaggagaagtgccagaaaaccttgagagatacaaggaatctgagctcatccactgcagatgggctatgcttgctgtgcctgggatcataataccagaggcattgggtttggggaactgggtaaaggcacaagaatgggcagcgattccaggaggacaggcgacgtacctgggacagccagtgccgtggggcacccttcctacgatcttggccatcgaattcctcgccattgcattcgtagagcaccaaaggagcatggagaaagacaccgagaagaagaagtaccccggcggcgctttcgaccccttgggctactccaaacaggaccctgctaagctccacgagctcaaagtcaaggagatcaagaacggtcggcttgcgttgttggcattcgtgggaatctgcgttcagcagtcggcgtacccaggaacaggaccgctggagaatttggcgagtcacttggcggatccatggcacaacaacatcggagacattcttatccctagaaatgtttccccctgaaaattaattaatacaatgatgatgtaaaactcttgtaatccagtgaacttcattgtatgtgcatctttgggtctgtataagtacataccaatttgatatgtgagctccatgttactactagagaaaaagataactaggtatcatgttttgtacgtgtttgatcaacttatactttttctttagtgtatgagagtccag

SEQ ID NO: 1146 - DNA, 994 bp, Gossypium hirsutum
  misc_feature (130)..(131): n is a, c, g, or t
cacacaacaatggccgccaacacactaatgagctgtggcatagccaccacatttccttcacttctttcctcatcaaagtccaagttcagtggcgccgccgtatcgttgcctagtgctgttggtaccaatnntggccaccgtgttagcatgtcagctgactggatgcctggtcaacctagaccaccttaccttgatgggtcagcaccaggtgactttgggtttgacccactaagactaggtgaggtccctgagaaccttgagaggtacaaagaatctgagttgattcactgcagatgggctatgcttgctgttccaggtatattggtaccagagggcttagggttaggaaactgggtaaaagctcaagaatgggcagcaattccaggtggccaagccacttacttagggaacccagtcccatggggtaccctccccaccatcttggtcattgaattcctatctatcgccttcgttgagcaccaacgaagcatggagaaggacaccgagaagaagaagtaccccggcggcgctttcgaccccttgggattctccaaggaccccaaaaagttcgaagaatacaaggtcaaagagatcaagaacggtcgtctagcattgttggcatttgtgggattctgtgttcaacaatcagcttacccaggcactggaccattggagaatttggctacacatttggctgatccatggcacaacaacattggagatgttatcattcctagatcactttacccttagattatgatagattgatagaatattttaaaagtaatgtccgttcttccattgcgtaaaacatatgtaatgaattctaatttgatggctttgttatgtgtaattataattttttatatgatctgaatgtcttaaattttgcaaactttttatctatcaaaaaacttacaattggattattgtaaatttcatatgtaatgattatcattgtttgtgtgaaaaaaaattaaaggttaaatagctc

SEQ ID NO: 1147 - DNA, 1020 bp, Triphysaria pusilla
atcctttccaattccaatatacttgtacctcaaccccaacattttttcccattcttatccaactcttcatccaagaatcaaaaatagtccaccatggcagctaatgcattgatgagctgtggcgtcgccgccgtgcggccctccctcctctcctcctccaagtccaaattcgccgcccctgcgagtttcgccaccaatgccaccacctctaggttctccatgtccgccgagtggatgcccggcgagccccgcccaccttacctcgacggatcggcgccgggagattttggattcgacccgcttcgtctaggagaagtcccacaaaatcttgaaagatacaaggaatctgaattaatacactgcagatgggctatgcttgctgttcctggaatacttgtgcctgaggcattgggcctgggcaactgggtcaaggcccaagaatgggcagcccttccaggtgggcaagccacttatttgggcaacccggttccatggggtaccctacccacaattctggcgatagaatttctggcaattgcctttgttgagcaccaaaggagcatggaaaaagacccggaaaagaggaagtacccgggtggagcttttgacccgttgggctactccaaagactcaaaaaagcttcaagagctcaaaatcaaggaagtaaaaaatggtcgtcttgctttgttggcatttgtgggcttttgcgtgcaacaatcggcatatcctggcacaggcccattggaaaacttggcaactcacttggctgatccatggcacaacaacatcggtgacatcgtcattccttcaggaatttttcctaattaaatcaactttcgtgacagtatcccacattgtaaaattcttcaaatattaataatattgtgtattgaatttatgttatgaatttagttgacgtatattgatcgtatttggtaaaaaataatccccaaatatgaatgtcgagatcaagatataaaaaactgcaatgctaaacatcataatattattattattgta

SEQ ID NO: 1148 - DNA, 1190 bp, Triphysaria pusilla
tccaactctttatccaagaatcaaaaatagtccaccatggcagctaatgcattgatgagctgtggcgtcgccgccgtgcggccctccctcctttcctcctccaagtcgaaattcgcctcccctgcgagtttcgccaccaatgccaccacctctaggttctccatgtccgccgagtggatgcccggcgagccccgcccaccttacctcgacggatcggccccgggagattttggattcgacccacttcgtctaggagaagttccacaaaatcttgagagatacaaagaatctgaattaattcactgcagatgggctatgcttgctgttcctggaatccttgtacctgaggcattgggcctgggcaactgggtgaaggcccaagaatgggcagcacttccaggtgggcaagccacttatttgggcaacccagttccatggggtaccctacccacaattctggcaatagaatttctggcaattgcctttgttgagcaccaaaggagcatggagaaagacccagaaaagaggaagtacccgggtggagcttttgacccgttgggctactccaaagactcaaaaaagcttcaagagctcaaaatcaaggaagtaaaaaatggtcgtctggctttgttggcatttgtgggcttttgcgtgcaacaatcggcgtacccaggcacaggcccattggaaaacttggcaactcacttggctgatccatggcacaacaacatcggcgacattgtcattccttcaggaatttttcctaattaaatcaattctcgtgacagtatcccacattgtaaaattcttcaactattaataatattgtgtattgaatttatgttatgaatttagttgacgcatattgatcatatttggtaaaaataatccccaaatatgaatgtcgagatcaagatataaaaaactgcaatgctaaacatcataatattattattattgtatttatactgatagctttcactatttcttttcatgccatattccttactagtaagatgatggaatttgatatattccgttctaccagtttatctatctccttatacactacttgcaacaaacggactccgaacattatgtttccaattgtaccatgttaatgaaccaaacaaatcttccgataaagaagttgtagtaagtttaaatttcacttgaaaggtttgcttttt

SEQ ID NO: 1149 - DNA, 976 bp, Manihot esculenta
acttctcattctcctccacttcttcatccattctcaacaaactcagtttcagattctgagaatggccactaacacattgatgagttgtggcattgccactgccttcccttctcttctctcttcttctaagtccaaattctcctcttcactccctcttcctagtgtcaatggcttctctcgtttcaccatgtctgctgattggatgcccggccagccccgccctccttatctcgacggctccgctcctggtgactttgggttcgacccccttcggctaggtgaggttcctgagaaccttgagagattcaaggagtctgagctcatccactgcagatgggctatgcttgctgttcctggaatcctagtaccagaggccttgggattaggcaactgggtgcaggcacaagagtgggctgcagttcctggtggtcaagcaacctacttgggccaaccagttccatggggaacacttccaaccattttagtcattgagttccttgccattgcctttgttgagcatcaacgcagcatggagaaagatcctgagaagagaaagtaccctggtggtgcttttgatcctttgggctactccaaggaccctgcaaagttccatgaatacaaggtcaaagaaatcaagaatggtcggctagctttgttggcttttgttgggttctgtgtgcaacaatcagcttacccaggaactggaccattggagaacttggcaactcacttggctgatccatggcacaacaacattggggatattatcatccccagaacgctttcgccttgaagagaaatttagttaatatattcaattcactgtaaaattcccatataaccatctgtaatgaaacagaaatttccatctcatatctttggcctctgtagaatttgaagtcttttcttttctagtaagtgtgctgtgaattaaaatgacaatgcagaatttgcaacatcattaagtaccctggcg

SEQ ID NO: 1150 - DNA, 933 bp, Manihot esculenta
cagtttcagattctgagaatggccactaacacattgatgagttgtggcattgccactgccttcccttctcttctctcttcttctaagtccaaattctcctcttcactccctcttcctagtgtcaatggcttctctcgtttcaccatgtctgctgattggatgcccggccagccccgccctccttatctcgacggctccgctcctggtgactttgggttcgacccccttcggctaggtgaggttcctgagaaccttgagagattcaaggagtctgagctcatccactgcagatgggctatgcttgctgttcctggaatcctagtaccagaggccttgggattaggcaactgggtgcaggcacaagagtgggctgcagttcctggtggtcaagcaacctacttgggccaaccagttccatggggaacacttccaaccattttagtcattgagttccttgccattgcctttgttgagcatcaacgcagcatggagaaagatcctgagaagagaaagtaccctggtggtgcttttgatcctttgggctactccaaggaccctgcaaagttccatgaatacaaggtcaaagaaatcaagaatggtcggctagctttgttggcttttgttgggttctgtgtgcaacaatcagcttacccaggaactggaccattggagaacttggcaactcacttggctgatccatggcacaacaacattggggatattatcatccccagaacgctttcgccttgaagagaaatttagttaatatattcaattcactgtaaaattcccatataaccatctgtaatgaaacagaaatttccatctcatatctttggcctctgtagaatttgaagtcttttcttttctagtaagtgtgctgtgaattaaaatgacaatgcagaatttgcaacatcattaagtaccttggcg

SEQ ID NO: 1151 - DNA, 965 bp, Citrus sinensis
tctcccctcccttcaccgtcaaccctgcccacccctcacacagctctcccaaaatggcttccaacactctgatgagctgcggcatcgccaccaccgctttcccttcggtcctctcatcttctaaatccaaattctttactgcagtttcacttccagctgccgccaatgcaacctcgaaatacgccatgtctgctgactggatgcccggcgagccccggccgccttatcttgatggttcagccccaggggactttggatttgacccacttcggcttggcgaagttcctgagaaccttgagagatacaaggagtctgaactcattcactgcagatgggctatgcttgctgttccagggatcttggtgccagaggcattgggattgggcaactgggtgcaggcgcaagagtgggcagcagttcctggaggacaagccacatacttaggcaaccctgttccatggggcactctccccacaattttggtgattgaattcctttccattgccttcgttgagcaccaacgcagcatggagaaagaccccgagaagaagaagtaccccggtggtgctttcgaccccttgggcttctccaaggacccccagaagttcgaggaatacaaagtcaaggagataaaaaatgggcgtttggcattgttggcatttgtgggtttctgcgtgcaacaatcagcatatccgggcacaggaccattggagaacttggcaactcacttggctgatccatggcacaacaacattggggacgttattatccccagagggattgtgccttgaagaactgcattgttaaattatccagtccactgtaaaattccctgttaaaagagcctttaatgaaacagaattcgtatctttctgactgtaagattagaaagtaattgtcctccaatgacgttcgtgctagaatctaatactactgtgattgccgtaatcaagagctattttttt

SEQ ID NO: 1152 - DNA, 874 bp, Populus trichocarpa
cctgtactgacctcaatttctccatcacccattctcacaaacgcagcttcacacttgttcacgggttctaagagaatggccaccaatacattgatgagctgcggcattgccaccgctttcccttcacttctttcatcttcaaagtccaaattcgcctcttcaattccacttcccagtgtcaatggcacctctcgtgtcaccatgtctgctgactggatgcctggccagcctcgtccaccttacctcgatggctcagcccccggtgactttgggttcgacccacttcgactgggcgaggtccctgagaatctggagagatacaaggagtccgaactcattcactgcagatgggctatgcttgctgttcctggaattctggtaccagaggccctgggtctgggcaactgggtaaaagctcaagagtgggctgcaactccaggtggccaagctacttatctgggccaaccagttccatggggaaccctccctatcattctggccattgaattcgttgccattgcctttgttgagcaccaacgtagcatggagaaagacacagagaagaagaagtaccctggtggtgcttttgatcctctaggatactccaaggaccctcagaagttcgaggaatacaaagtcaaggaaattaagaatggccgtctagcactgttggcatttgttgggatctgtgtgcaacaaacagcttatcctggtactggaccattggagaacttggcaactcacctggctgacccatggcacaacaacatcggggacgttctcatccctagatcggtctcgccttgaaaaatcaaatattgtattgcttatctactgtaaccatctgcaatgaaacaggatttcattatctttc

SEQ ID NO: 1153 - DNA, 926 bp, Cleome gynandra
ggggaaccaaatctctctctctctctctctctctcacgcagaaatggcctcgaacactctgatgagctacggcgtcgccgctgcgtgcccgtcgcttctctcatcgtctaagtcaaagttcgtcgctggcggagtctcacttcccatcgccggtggaaatggcggccgcgtcagcatgtccgccgattggatgccaggtcaacctcgccctccttacctcgatggctctgctcctggtgacttcggattcgacccgcttaggctgggagaagttccagagaacttggaaagatacaaggaatcagaactcatccattgcagatgggcaatgcttgctgtacctgggatattggtgcccgaggcgttgggatatggtaactgggtgaaggctcaggagtgggcagcgaccccgggaggccaagccacgtacttgggtaaccccgtgccatggggcactcttcccacgattctggtgatcgaattcttggctattgcctttgtggagcaccaaaggagtatggagaaagatcccgagaagaagaagtatccgggaggtgcttttgacccgcttggatactccaaagatcctaagaagttcgaggaattgaaggttaaggagatcaagaacgggcgtctggcgctactggcatttgtgggattctgcgtgcaacaatcggcttacccagggacaggacctttggagaacttggcgactcacttggctgatccatggcacaacaacattggtgacatcatcatccctatttccctttctccctgaaaatcatcaatacacattagttatctccactgttcatctttcaaccacaaaacgttacggtttggtactattaattagccctcctctctctgtaatttgatcactagggtttacatatatgcttatcaaatctatttgcttcaag

SEQ ID NO: 1154 - DNA, 954 bp, Cleome spinosa
atctccaccaaatctctccctctctatcagaaatggcttcgaacgcgctgatgagctgcggcatcgccgccgcgtacccgtcgcttctctcgtcgtcgaagtcgaagttcgttgcaggcggagtgtcactgcccatcgccggcgtcaacggcggcggccgcgtcagcatgacagccgattggatgccaggtcaacctcgccctccttacctcgacggctctgctcctggcgactttggattcgacccacttaggctgggagaagttccggagaatttggagagatacaaggagtcagagctcatccactgcagatgggcaatgcttgctgttccagggatattggtgcctgaggcattggggtatggaaactgggtgaaggctcaggaatgggcggcgacaccgggaggtcaagccacgtacttgggcaaccccgtgccatggggcactcttccgaccattctcgtgatcgagttcttggctatcgcttttgtcgagcaccagagaagtatggagaaagaccccgagaagaaaaagtaccccggaggtgccttcgaccctctcggatactccaaagatcccaagaagttcgaggaattgaaggttaaagagatcaagaacgggcgactcgcgttgttggcattcgtggggttctgcgtgcagcaatcggcttacccgggcacggggccattggagaacttggctactcacttggctgatccatggcacaacaacattggtgacattgtcatccctccttccctttcgccctaaatccagagttcgtcctcatttcatctttcaaccactgtaaaattggtaacgtgtgtgtgtaaaaacatcaccttgcaatgaacgcgcttgtcctcctcccttgtctgtgtaatctgataactagggcttagatatgcatacatatatatcaaatgtatttgcttggaatctcttcaactgg

SEQ ID NO: 1155 - DNA, 1048 bp, Glycine max
aaaaattgccagttacattcccttcacaagattctcacaaacaactcttgagaaagaaagaatggctgccaacacattgatgagttctgccatctcagccttcccatctctcctttcctcctcaaaatccagatttgccgcagcagttcctctttccagctttgttgtcaccaatgcctcttcttctcgcttttccatgagtgctgactggatgcctggccagcctagacccccctaccttgatggttcagcacctggtgactttggattcgaccctcttcgtcttggtgaagtaccagagaatcttgagaggttcaaagagtcagaactcattcactgcagatgggccatgcttgctgttccagggattttggttccagaggcattgggcttaggcaactgggtaaaggctcaggaatgggctgcagttcctggtggccaagcaacctacctaggcaacccagttccatggggcaccctacccaccattctggccattgaattccttgctatttccttcgtggagcaccaaaggagcatggagaaggaccctgaaaagaagaaataccctggtggtgcttttgatcctttgggatactctaaggaccctaaaacattccacgaatacaaagtcaaagaaattaaaaatggacgtcttgctttgttggcttttgtgggattctgtgttcaacaatcagcttatcccggcactggacctttggagaacttggctgctcacttggctgacccatggcacaacaacattggaaacgtcattattccacaatcgattttgccttgaaaaaaaatatatatttgtttcaatagctacctgtataactccgtgtaacaatttgtaatgaatcggatcgatcttgctacgttggtatcgctgtgctgtaattaaactttgaattcaaactcatagatactctggcaactagttggtatgaaagagaggcttgaagcaaacttccaagtccaagtttaaaatttgcattacatgactaaatccatatatcatgatgaataaagcatgttttggacc

SEQ ID NO: 1156 - DNA, 934 bp, Glycine max
gattctaaaacattgccagtgccattcccttcacaccattctcacaaaacaactttcaaactctgagaaagaatggctgccaacacattgatgagtactgctatctcagccttcccatctctcctttcttcctcaaaatccagatttgccaccgcagttcctctttctagctttggtgtcaccaatgcctcttcttctcgcttttctatgagtgctgactggatgccaggccagcctagacctccttaccttgatggttcagcacctggtgactttggattcgaccctcttcgtcttggtgaagtaccagagaatcttgagaggttcaaagagtcagaactcattcactgcagatgggccatgcttgctgttccagggattttggttccagaggcattgggcttaggcaactgggtaaaggctcaggaatgggcagcagttcctgggggccaagcaacctacctaggcaatccagttccatggggcaccctacccaccattctggccattgaattccttgctatttcctttgtggagcaccaaaggagcatggagaaggacccagagaagaagaaataccctggtggtgcttttgatcctttgggatactctaaggaccctaaaacattccatgaatacaaagtcaaagaacttaagaatggacgtcttgctttgttggcttttgtgggattctgtgttcaacaatcagcttatcccggcactggacctttggagaacttggctgctcacttggctgacccatggcacaacaacattggaaacatcattattccacaatcgattttgccttgaaaaaaaaaaatcaaatatttgttctaatagctacttgtataactccatgtaacaatttgtaatgaatcagattgctatgttggtatctctgtgttgtaattaaacttcgaattcaaactca

SEQ ID NO: 1157 - DNA, 951 bp, Brassica juncea
aacacacacctctccttcacatctttcttatttgtactaaacagaaaggcagagagagaccagagaatacaatggcgtcgaactctctcatgagctgcggcatcgccgccgtctacccttcgcttctttcttcttcaaagtctaaatttgcctcctccggagtttccctccccaacgttgggaacgttggccgcgtcagaatggctgctcactggatgcctggcgagccacgtcccgcttacctcgacggctctgcccctggtgactttgggtttgacccgcttggactcggagaggttccagagaaccttgagaggtacaaagaatcagagctcatccactgtagatgggctatgctcgctgttccagggattttggtaccagaggctttgggatacggaaactgggttaaggctcaagagtgggcagcagtacctggaggacaagccacttacttggggaacccggtcccttggggtactttgcccacaatcttggctatagagttcttagctattgcctttgttgagcaccagaggagcatggagaaagaccctgagaaaaagaagtacccgggaggtgcatttgaccctcttggatactccaaagacccgaagaagttcgaggagttgaaagttaaggagatcaagaacgggcgtcttgcattattggcgtttgtaggattctgtgtgcaacaatcagcctacccaggcacaggaccactggagaacctggctactcacttggcggatccatggcacaaaaacattggcgatattgttatccctttgaactagtgacttgtaaaaaaaagaagaagatagtaacatatcctatgagctttatgtgtatcaaaactctctgtaatgaaagacagattgtgaaacctttgttttgtcttggtgatggatttgcttcgtgtgagcttgaattctatgtgattataccttt

SEQ ID NO: 1158 - DNA, 904 bp, Manihot esculenta
tgtactctcctcaaagccttgcctccttccattcttctccacttcttaatccattctcagcaacccagtttcagattcctacaatggccgccaacacgttgatgagctgtggcattgccactgctttcccttctcttctctcctcttctaagtccaaattcgccactgcaatccctcttcctagcgtcaatgtctcctctcgtatcaccatgtctgctgattggatgcctggccagccccgccctccttatctcgatggctccgctcctggtgactttgggttcgacccacttcgtctaggtgaggtccctgagaatcttgagagatttaaggagtctgaactcattcactgcagatgggctatgcttgctgttcctggaatcctagtgccagaggccttggggttaggcaactgggtgcaggcacaagagtgggctgcagttcctggtggacaagctacctacttgggtcaaccagttccatggggaaccctcccaaccattttagtcatcgagttccttgccattgccttcgttgagcaccaacgcagcatggagaaagatcctgagaagaggaagtaccctggtggtgcttttgatcctttgggctactccaaggaccctgcaaagttccatgaatacaaggtcaaggaaatcaagaatggtcgtctagcactattggcatttgtgggaatctgtgtacaacaatcagcatacccagggacaggaccattggagaacttggcaacacacttggcagatccatggcacaataacattggggatattgtcatccctagatctcttttgccttgaacaaagattcatttatccactgtaaaattcccatgtcaccatctgtaatgaaacagattttcccatctttggcctgcctatatatataa

SEQ ID NO: 1159 - DNA, 928 bp, Brassica juncea
cacatctttcttctttgtggtaaacagaaagggagatagagagacaacaatggcgtcgaactcgctaatgagctgcggcatcgctgccgtctacccttctcttctttcttcttcaaagtctaagttcgtatcctccggagtttctctacccaacgccggtaacgttagccgtatcagaatggctgctcactggatgcctggcgagccacgaccagcttacctcgacggttctgctcctggtgactttgggtttgacccacttggacttggagaggttccagagaaccttgagaggtacaaagaatcagagctcatccactgtagatgggctatgctagctgttccagggatactggtaccagaggcattaggatatggaaactgggttaaggctcaagaatgggcagcagtacctggaggacaagccacttacttggggaacccagtcccttggggtactttgcccacaatcttggctatagagttcttagctattgcatttgttgagcaccagaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaagatagtaatatatcctatgagctttgtgtatcaaaactctgtgttatgaaagacacattgtgaaacctgcgttttgttgaattctatgtgattaaaaccttttgaatcagtttaggaactcaaaaaaacgcagagtacg

SEQ ID NO: 1160 - DNA, 909 bp, Brassica juncea
acacctatccttcacatctttcttctttgcagtaaacaaaaagagggagagagatcaaagaatacaatggcgtctaactcgctcatgagctgcggcatcgccgccgtctacccttcccttctttcttcttcaaagtctaaattcgtctccgctggagttgctctccccaacgttgggaacgttggccgcgtcagaatggctgctcactggatgcccggcgagccacgtccagcttacctcgacggctctgcccctggtgactttgggtttgacccgcttggacttggagaggttccagagaaccttgagagatacaaagaatcagagctcatccactgtagatgggctatgctcgccgttccagggattttggtaccagaggctttgggatacggaaactgggttaaggctcaagagtgggcagcagtacctggaggacaagccacttacttgggaaacccggttccatggggtactttgcccaccatcttggctatagagttcttagctattgctttcgttgagcaccagaggagcatggagaaagaccctgagaaaaagaagtacccgggaggtgcatttgaccctcttggatactccaaagaccccaagaagttcgaggagttgaaagtcaaagagatcaagaacgggcgtcttgcattgttggcgtttgtaggattctgtgtgcaacaatcagcctacccaggcacaggaccattggagaacctggctactcacttggcggatccatggcacaaaaacattggcgatattgttatccctttcaactagtgactttgtaaagaaaagatagtaatgtatcctatgagctttatgtgtatcaaaactctctgtaatgaaagacagattgtgaaacctttgttttgtcttggtgatggattgcttcgt

SEQ ID NO: 1161 - DNA, 985 bp, Brassica juncea
acacctctccttcacatatttcttctttgtagtaatcagaaaggcagagagagagagagagatcagaggaaacaatggcgtctaactcgctcatgagctgcggcatcgccgccgtctacccttcccttctttcttcttcaaagtctaaattcgtctcagccggagtttctctccccaacgttggtaacgttggccgcatcagaatggctgctcactggatgcccggcgagccacgtccagcttacctcgacggctctgcccctggtgactttggatttgaccctcttggacttggagaggttccagagaaccttgagagatacaaagaatcagagctcatccactgcagatgggctatgcttgctgttcctgggattttggtaccagaggctttgggttacggaaactgggtcaaagctcaagaatgggcagcagtgcccggaggacaagccacttacttgggcaaccctgtcccatggggtactttgcccacaatcttggctatagagttcttagctattgcctttgtggagcaccagaggagcatggagaaagaccctgagaaaaagaagtaccctggaggcgcatttgaccctcttggatactccaaggacccgaagaagtttgaggagttgaaagtcaaggagatcaagaacgggaggcttgccttgttggcgtttgtaggattctgtgtgcagcaatcggcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactctctgtaatgaaagacagattgtctgaaacctttgttttgtcttggtgatctattgcttcgtgtgagcttgaattctatgtgattaaaccttttgaatcggtttacgaaccgatatgtgacttaacaa

SEQ ID NO: 1162 - DNA, 984 bp, Brassica juncea
atccaaacacacctctccttcacatatttcttctttgtagtaatcagaaaggcagagagagagagagagatcagaggaaacaatggcgtctaactcgctcatgagctgcggcatcgccgccgtctacccttcccttctttcttcttcaaagtctaaattcgtctcagccggagtttctctccccaacgttggtaacgttggccgcatcagaatggctgctcactggatgcccggcgagccacgtccagcttacctcgacggctctgcccctggtgactttggatttgaccctcttggacttggagaggttccagagaaccttgagagatacaaagaatcagagctcatccactgcagatgggctatgcttgctgttcctgggattttggtaccagaggctttgggttacggaaactgggtcaaagctcaagaatgggcagcagtgcccggaggacaagccacttacttgggcaaccctgtcccatggggtactttgcccacaatcttggctatagagttcttagctattgcctttgtggagcaccagaggagcatggagaaagaccctgagaaaaagaagtaccctggaggcgcatttgaccctcttggatactccaaggacccgaagaagtttgaggagttgaaagtcaaggagatcaagaacgggaggcttgccttgttggcgtttgtaggattctgtgtgcagcaatcggcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactctctgtaatgaaagacagattgtctgaaacctttgttttgtcttggtgatctattgcttcgtgtgagcttgaattctatgtgattaaaccttttgaatcggtttacgaaccgatatgtg

SEQ ID NO: 1163 - DNA, 1010 bp, Brassica rapa
atccaaacacacctctccttcacatatttcttctttgtagtaatcagaaaggcagagagagagatcagaggaaacaatggcgtctaactcgctcatgagctgcggcatcgccgccgtctacccttcccttctttcttcttcaaaatctaaattcgtctcagccggagttgctctccccaacgttggtaacgttggccgcgtcagaatggctgctcactggatgcccggcgagccacgtcccgcttacctcgacggctctgctccaggtgactttggatttgaccctcttggacttggagaggttccagagaaccttgagagatacaaagaatcagagctcatccactgcagatgggctatgcttgctgttcctgggattttggtaccagaggctttgggttacggaaactgggtcaaagctcaagaatgggcagcagtgcccggaggacaagccacttacttgggcaaccctgtcccatggggtactttgcccacaatcttggctatagagttcttagctattgcctttgtggagcaccagaggagcatggagaaagaccctgagaaaaagaagtaccctggaggcgcatttgaccctcttggatactccaaggacccgaagaagtttgaggagttgaaagtcaaggagatcaagaacgggaggcttgccttgttggcgtttgtaggattctgtgtgcagcaatcggcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactctctgtaatgaaagacagattgtctgaaacctttgttttgtcttggtgatctattgcttcgtgtgagcttgaattctatgtgattaaaccttttgaatcggtttacgaaccgatatgtgacttaacaaaatttacatcatttagattgtca

SEQ ID NO: 1164 - DNA, 957 bp, Lotus japonicus
ctcagttacacaccccataatttccaacatcctgtgagaatggcttctaacacgcttatgagttctgctatctcagcattcccttctcttctttcttcttcaaaatcaagattcgccactgcagctccactatcatgttttggtaccaatgcctcttctcgtttctccatgactgctgactggatgcctggccagcctagacccccttaccttgatggctcagcacctggtgactttggattcgaccctcttcgtcttggtgaagtaccagagaatcttgagagattcaaggagtcagaactcattcactgcagatgggccatgcttgctgttccagggattttggtaccagaggcactaggcttaggcaactgggtaaaagctcaggaatgggcagcacttcctgggggacaagcaacctacctaggcaaccctgttccatggggtaccctccccaccgttctggccattgaattccttgctatttcttttgtggagcaccagagaagcatggagaaggacccagagaagaagaaataccctggtggtgcttttgatcctttgggatactccaaggaccctaaaaagttccatgaatacaaagtcaaagaaattaagaatggacgtcttgctctgttggcttttgtgggtttctgtgttcagcaatcagcttatccaggcactggacccttggagaacttggctactcacttggctgacccatggcacaacaacattgggaatgtccttattcccccacaatagattttgtaatgaaaattccaatctttggtaatgatagttgctacctgtaatactctcgtgaaacattttgtaatgaaactgatcgatcacgcaatgtttgtatgatcccagtgttgtaattaaacgttgaattaatttggttcaaaactcatgctatggcatgcaacccgatggtatgaaacaaagctaaaa

SEQ ID NO: 1165 - DNA, 904 bp, Zea mays
caataatcagaaaggcagagagagagagagagatcagaggaaacaatggcgtctaactcgctcatgagctgcggcatcgccgccgtctacccttcccttctttcttcttcaaagtctaaattcgtctcagccggagtttctctccccaacgttggtaacgttggccgcatcagaatggctgctcactggatgcccggcgagccacgtccagcttacctcgacggctctgcccctggtgactttggatttgacccgcttggacttggagaggttccagagaatcttgagagatacaaagaatcagagctcatccattgcagatgggctatgctcgctgttccagggattttggtaccagaggctttgggatacggaaactgggtcaaggcccaagaatgggcagcagtgcctggaggacaagccacttacttgggcaacccagtcccatggggtactttgcccacaatcttggctatagagttcttagctattgcctttgtggagcaccagaggagcatggagaaagaccctgagaaaaagaagtaccctggaggtgcatttgaccctcttggatactccaaggacccgaagaagtttgaggagttgaaagtcaaggagatcaagaacgggcgtcttgcgttgttggcgtttgtaggattctgtgtgcagcaatcggcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactttctgtaatgaatgacagattgtctgaaacctttgttttgtcttggtgatctattgcttcgtgtgagcttgaatcc

SEQ ID NO: 1166 - DNA, 1027 bp, Raphanus sativus
gctgacaacatccaaaacacctctctctctcgttcacatctttcttctttgtggtaaacagaaagggagatagagagagacaacaatggcgtcgaactcgctcatgagctgcggtatcgccgccgtctacccttctcttctttcttcttcaaaatctaaattcgtctcggccggagttgctctccccaacgccgggaatgttggccgtgtcagaatggctgctcactggatgcccggcgaaccacgaccagcttacctcgacggttctgctcctggtgactttgggtttgacccactcggacttggagaggttccagagaaccttgagaggtacaaagaatcagagctcatccactgtagatgggctatgcttgctgttccagggatattggtaccagaggctttgggatatggaaactgggtaaaggctcaagaatgggcagcagtacctggaggacaagccacttacttggggaacccagtcccttggggtactttgcccacaatcttggctatagagtttttagctattgcatttgttgagcaccagaggagtatggagaaagaccctgagaaaaagaagtacccgggaggtgcatttgaccctcttggatactccaaagacccaaagaagttcgaggagttgaaagttaaagagatcaagaacgggaggcttgcgttgttggcgtttgtaggcttctgtgtgcaacaatctgcctacccaggcacaggaccattggagaacctggctactcacttggcggatccatggcacaaaaacattggcgatgttgttatccctttcaactagtgacttgtaaaaaaagatagtaatgtatcctatgagctttatgtgtatcaaaactctgtctagtgaaagacagattgtgaaacctatgttttgtctcggtgatcgattgctcctgtgagcttgttgaagtctatgttattaaaccttttgaatcgaaacaaacatgcatcagagagattttcgaaatgcaataaaaggaaacattgaagtcggcga

SEQ ID NO: 1167 - DNA, 1032 bp, Raphanus sativus
  misc_feature (85)..(85): n is a, c, g, or t
  misc_feature (87)..(88): n is a, c, g, or t
ctgacaacatccaacacacacctctccttcacatctttcttctttgtagtaaaacagaaaggcagagggaaatagagatcagagnanncaatggcgtcgaactcgctcatgagctgcggcatcgccgccgtctacccttcccttctttcttcttcaaagtctaaattcgcctcctccggatttgcccttcccaacgccgggaacgttggccgtatcagaatggctgctcactggatgcccggcgagccgcgtcctgcttacctcgacggttctgctcctggtgactttgggtttgaccctcttggacttggagaggttccagagaatcttgagagatacaaagaatcagagctcatccactgtagatgggctatgcttgctgttccagggattttggtaccagaggctttgggatacggaaactgggtcaaggctcaagaatgggcagcagtacctggaggacaagccacttacttgggaaacccggtcccatggggtactctgcccacaatcttggctatagagttcttagctattgcctttgttgagcaccagaggagcatggagaaagaccctgagaaaaagaagtaccctggaggtgcatttgaccctcttggatactccaaagaccccaagaagtttgaggagttgaaagttaaggagatcaagaacgggaggcttgcgttgttggcctttgtaggcttctgtgtgcagcaatcggcttacccagggacaggaccattggagaacttggctactcacttggctgatccatggcacaaaaacattggcgatattgttatccctctgaactagtgacttgtaaaaaaatggtagtaatgtgtcctatgatgagcttcatgtgtatcaaaactctctgtaatgaaaagacagattgtgaaacctatgatgttttgtcttggtgatcgactgcttcgtgtgagcttgaattctatgtggttttactatttgtaatatcatattcctgatgtttcattgaaacaatatttaaaatcatttagattggtcata

SEQ ID NO: 1168 - DNA, 926 bp, Tragopogon dubius
ttctgggaaatggcttctaatacattgatgagctgcggcatccccgccgtaggccgcccatctcttctctcttcctccaagtcaagattcgccaccgctgtgccactttctggtgttgccaccaactcatcccggatttccatgaccgccgattggatgcccggacaaccacgaccaccatacctagacggatctgcacctggggattttggatttgacccacttcgtcttggtgaagtccagaaaacctcgaaaggttcaaagaatctgaactcattcactgcagatgggctatgcttgcataccggggatcttgttacctgaagctttgggattgggaaactgggtaaaagcacaagaatgggctgcacttcccggaggacaagcgacatacctagggaacccagtgccatggggtaccctacccacggttttggctattgaattcatctccattgccttcgtagagcaccaaaggagcatggagaagaagtaccctggtggcgcttttgacccattgggatactcgaaagatccaaaagcttttgctgagaacaaagtgaaagagatcaagaacggacgtttggctttgttggcattcgtgggattttgtgtgcaacaatcggcttaccctggtaccggacctttggagaacttggcaactcatttggctgacccatggcacaacaacattggagatgttattatccctaaaggaattttcccaaattaatatgctccaaagctccaagttcatatgtaaagtccatgtaaaccttcatatattgtaatgaaatgaacttatattagtgttgaatccctttggtcaactttaaagcttattgcaagttcttgaagatttcaatttgaaaattcattttgttcatcccctcaggcgataaatagagagattgtttgaaactaac

SEQ ID NO: 1169 - DNA, 1043 bp, Panax ginseng
gttttttttttttttttacgcgggaaaggcgccgccatgtggtgttggtaccccgggaaattcggccattacggccggggatccctctcagccttctttctctctctcttttttcttcattttagtctagtattctcagctagacgattacaatatttctgagaatggccacaaatgcactgatgagctgtggcatcgccgccgtcttcccttcggttctttcctcttcaaagtctaaatttgcggcggcattgccgcagtctttggttagtgccaatggcacaacatcccgctacaccatgacttccgattggatgcctggccagccccggccaccctaccttgacggatcagcacccggagatttcggattcgacccgctaggacttggttcagtcccggaaaaccttgagagattcaaggagtctgaactcatccactgcagatgggccatgcttgctgttccagggattttggtgcctgaggctttgggtttgggcaactgggtacaggctcaagagtgggcagcaatccccggaggacaagcaacctacttgggcaacccagtcccatggggtacccttcccaccattttggtcatcgaattcctctccattgcattcgttgagcaccaaagaagcatggagaaagattccgagaagaaaaagtaccccggtggagcttttgacccattaggctactccaaggacccgaagaaattcgaggagtataaggtcaaggaggtcaaaaatgggcgtcttgcattgctggcattcgtgggattctgtgttcaacagtctgcatacccaggaacaggaccattggagaacttggcaactcacttggctgacccatggcacaacaacatcggaaatgtccttatccccagaggactttaatttgccttgatggagtccagtttaatatgaaatagcctcattgtaaaactcatgtaacattatttatgctacctaatgaagtgaacttgtgtatctgtatatgattgtccttttttaagtttgaagagtaattttacttaccag

SEQ ID NO: 1170 - DNA, 996 bp, Theobroma cacao
cggggattctgaactttctcttcttctagttagctcccccaaacaaaagtttctcccccaaaaagaccatggctgccaacacactcatgagctgtggcatagccaccgcattcccttcagtcctctcctcctccaagtccaagttcgccgccgccgtgcagttgcctggtgttggtgccaatggtagccaccgtgttagcatgtcagctgactggatgcctggtcagcctaggccaccttaccttgatggctcagcaccaggtgactttggatttgacccactaaggctcggtgaggtcccagagaaccttgagaggtacaaggagtctgagttgattcactgcagatgggctatgcttgctgttcctggtatcttggtaccagaggctttggggtatggaaactgggtaaaggctcaagaatgggcggcaattcctggtggacaagccacttacctgggcaaccctgttccatggggtaccctccctatcatcttggtcatcgaattcttcgccatcgccttcgttgagcaccaacgcagcatggagaaggacaccgagaggaagaaataccctggtggtgcttttgatcccttgggatactccaaggaccccaaaaagttcgaggaatacaaggtcaaagagatcaagaatggtcgccttgcattgttggcattcgtgggattctgtgttcaacaatcagctagacctggcactggaccactggagaacttggcaactcacttagctgatccatggcacaacaacattggagaaatcatcatccccagatcaatctcaccttgatgagggaatacccattttgtaaaactccatgtaatcatctgtaatattgaatcagaattccacgacttttggtctgcgtaattaggctttttacaggtttcatttcatgtgacctttagctagaacacctcaaatattgtgaacattatcaatatatattacttaaattatcaactcaaaatttagtcca

SEQ ID NO: 1171 - DNA, 917 bp, Brassica juncea
tggtaaacggagagagagagagagagagacaacaatggcgtcgaactcgctcatgagctgcggcatcgccgccgtctacccttctcttctttcttcttcaaagtctaagttcgtctccgccggagttgctctccccaacgccgggaacgttggccgtatcagaatggctgctcactggatgcccggcgagccacgaccagcttacctcgacggttctgctcctggtgactttgggtttgacccacttggacttggagaggttccagagaaccttgagaggtacaaagaatcagagctcatccactgtagatgggctatgctcgctgttccagggatattggtaccagaggctttgggatatggaaactgggttaaggctcaagaatgggcagcagtacctggaggacaagccacttacttgggcaatccagtcccttggggtactttgcccacaatcttggctatagagttcttagctattgcctttgttgagcaccagaggagtatggagaaagaccctgagaaaaagaagtacccaggaggtgcatttgaccctcttggatactccaaagacccaaagaagttcgaggagttgaaagttaaagagatcaagaacgggaggcttgcgttgttggcgtttgtaggattctgtgtgcaacaatctgcctacccaggcacaggaccattggagaacctggctactcacttggcggatccatggcacaaaaacattggcgatattgttatccctttgaactaagtgacttgtaaaaaaagatagtaatatatcctatgcgctttatgtgtatcaaaactctgtgtagtgaaagacagattgtgaaacctgtgttttgtctcggtgatcgattgctcgtgtgagcttgttgaagtcaatgtgattaaaccttttgaatcaa

SEQ ID NO: 1172 - DNA, 993 bp, Brassica juncea
atccaaacacacctctccttcacatctttcttctttgtagtaaacagaaagagggagagagaccaaagaatacaatggcgtctaactcgctcatgagctgcggcatcgccgccgtctacccttcccttctttcttcttcaaagtctaaattcgtctcctccggagttgctctccccaacgttgggaacgttggccgcgtcagaatggctgctcactggatgcccggcgagccacgtccagcttacctcgacggctctgcccctggtgactttgggtttgacccgcttggacttggagaggttccagagaaccttgagaggtacaaagaatcagagcttatccactgtagatgggctatgctagctgttccagggatactggtaccagaggctttgggatatggaaactgggttaaggctcaagaatgggcagcagtacctggaggacaagccacttacttagggaacccagtcccttggggtactttgcccactatcttggctatagagttcttagctattgcatttgttgagcaccagaggagtatggagaaagaccctgagaaaaagaagtacccgggaggtgcatttgaccctcttggatactccaaagacccaaagaagttcgaggagttgaaagttaaagagatcaagaacgggaggcttgccttgttggcgtttgtaggattctgtgtgcagcaatcggcctacccaggcacaggaccattggagaacctggctactcacttggcggatccatggcacaaaaacattggcgatattgttatccctttgaactaagtgacttgtaaaaaaagatagtaatatatcctatgcgctttatgtgtatcaaaactctgtgtagtgaaagacagattgtgaaacctgtgttttgtctcggtgatcgattgctcgtgtgagcttgttgaagtcaatgtgattaaaccttttgaatcaaaaatttgattcatgatatgcttatttgaaacaaaaa

SEQ ID NO: 1173 - DNA, 946 bp, Brassica napus
gcagcgtccgcacctctccttcacatatttcttctttgtagtaatcagaaaggcagagagagagagagagatcagaggaaacaatggcgtctaactcgctcatgagctgcggcatcgccgccgtctacccttcccttctttcttcttcaaagtctaaattcgtctcagccggagtttctctccccaacgttggtaacgttggccacatcagaatggctgctcactggatgcccggcgagccacgtccagcttacctcgacggctctgcccctggtgactttggatttgacccgcttggacttggagaggttccagagaatcttgagagatacaaagaatcagagctcatccattgcagatgggctatgctcgctgttccagggattttggtaccagaggctttgggatacggaaactgggtcaaggcccaagaatgggcagcagtgcctggaggacaagccacttacttgggcaacccagtcccatggggtactttgcccacaatcttggctatagagttcttagctattgcctttgtggagcaccagaggagcatggagaaagaccctgagaaaaagaagtaccctggaggtgcatttgaccctcttggatactccaaggacccgaagaagtttgaggagttgaaagtcaaggagatcaagaacgggcgtcttgcgttgttggcgtttgtaggattctgtgtgcagcaatcggcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactctctgtaatgaatgacagattgtctgaaacctttgttttgtcttggtgatctattgcttcgtgtgagcttgaattctatg

SEQ ID NO: 1174 - DNA, 947 bp, Heritiera littoralis
gtagaatcatggcagccaacacagtaatgagttgtggcatagccaccgcattcccttcactcctttcctcttccaagtccaagttcttcgccgcggtgccattgccttgtgttggtgctaatgttagccaccgtgttaggatgtctgctgactggatgcctggtcagcctaggccaccttaccttgatggttcagctccaggtgactttggttttgacccactgagacttggtgaggtccctgagaaccttgagaggtacaaggagtctgagttgattcactgcagatgggctatgcttgctgttcctggaatgttggtgccagaggccttggggtatggaaactgggtaaaggctcaagaatgggccgcaattcctggtggacaagctacttacttaggcaaccctgttccatggggtaacctccctaccatattggtcattgaattcctagccattgccttcgttgagcaccagcgcagcatggagaaggacaccgagaagaagaagtaccctggtggagctttcgatcccttgggatactccaaggaccccaaaaggttcgaggaatacaaggtcaaagagatcaagaatggtcgtcttgcattgttggcattcgtaggattctgtgttcaacaatcagcttaccctggcactggaccattggagaacttggcaactcacttagctgatccatggcacaacaacattggcgatgtcatcatccccagatcaattgtgccttgatgatgatgatggaatatatttaaacataatgtccgttctcccattgtaaaactccatgtaatcagatgtaatgaatcataatttcatgactttggtatgtgtaattagacttcttcttataagtttcattttctgtgagcttctcttagagaacacgtataattttgtatcagtcttttcttctgaaatttacttaaaaat

SEQ ID NO: 1175 - DNA, 941 bp, Brassica juncea
atccaaacacacctctccttcacatctttcttctttgtagtaaacagaaagagggagagagaccaaagaatacaatggcgtctaactcgctcatgagctgcggcatcgccgccgtctacccttcccttctttcttcttcaaagtctaaattcgtctcctccggagttgctctccccaacgttgggaacgttggccgcgtcagaatggctgctcactggatgcccggcgagccacgtccagcttacctcgacggctctgcccctggtgactttgggtttgacccgcttggacttggagaggttccagagaaccttgagagatacaaagaatcagagctcatccactgtagatgggctatgctcgccgttccagggattttggtaccagaggctttgggatacggaaactgggttaaggctcaagagtgggcagcagtacctggaggacaagccacttacttgggaaacccggttccatggggtactttgcccaccatcttggctatagagttcttagctattgctttcgttgagcaccagaggagcatggagaaagaccctgagaaaaagaagtacccgggaggtgcatttgaccctcttggatactccaaagaccccaagaagttcgaggagttgaaagtcaaagagatcaagaacgggcgtcttgcattgttggcgtttgtaggattctgtgtgcaacaatcagcctacccaggcacaggaccattggagaacctggctactcacttggcggatccatggcacaaaaacattggcgatattgttatccctttcaactagtgactttgtaaagaaaagatagtaatgtatcctatgagctttatgtgtatcaaaactctctgtaatgaaagacagattgtgaaacctttgttttgtcttggtgatggattgcttcgtgtgagcttgagttctatgtcatta

SEQ ID NO: 1176 - DNA, 946 bp, Brassica juncea
ctccctcacatctttcttagtaaacagaaaggcagagagagagagagaccaaagagtacaatggcgtcgaactcgctcatgagctgcggcatcgccgccgtctacccttcacttctttcttcttcaaagtctaaattcgtctcctccggagttgccctccccaacgttgggaatgctggccgcgtcagaatggctgctcactggatgcctggcgagccacgtccagcttacctcgacggctctgctccaggtgactttggatttgacccacttggacttggagaggttccagagaatcttgagagatacaaagaatcagagctcatccattgtagatgggctatgctcgctgttccagggattttggtaccagaggctttgggatacggaaactgggttaaggctcaagagtgggcagcagtacctggaggacaagccacttacttggggaacccggtcccatggggtactttgcccacaatcttggctatagagttcttagctattgcctttgtcgagcaccagaggagcatggagaaagaccctgagaaaaagaagtacccaggaggtgcatttgaccctcttggatactccaaagacccaaagaagttcgaggagttgaaagttaaagagatcaagaacgggaggcttgcgttgttggcgtttgtaggattctgtgtgcaacaatctgcctacccaggcacaggaccattggagaacctggctactcacttggcggatccatggcacaaaaacattggcgatattgttatccctttgaactaagtgacttgtaaaaaaagatagtaatatatcctatgcgctttatgtgtatcaaaactctgtgtagtgaaagacagattgtgaaacctgtgttttgtctctgtgatcgattgctcgtgtgagcttgttgaagtcaatgtgattaaaccttttgaatcaaaaa

SEQ ID NO: 1177 - DNA, 958 bp, Brassica juncea
atccatacacacctctccctcacatctttcttagtaaacagaaaggcagagagagagagagaccaaagagtacaatggcgtcgaactcgctcatgagctgcggcatcgccgccgtctacccttcacttctttcttcttcaaagtctaaattcgtctcctccggagttgccctccccaacgttgggaatgctggccgcgtcagaatggctgctcactggatgcctggcgagccacgtccagcttacctcgacggctctgctccaggtgactttggatttgacccacttggacttggagaggttccagagaatcttgagagatacaaagaatcagagctcatccattgtagatgggctatgctcgctgttccagggattttggtaccagaggctttgggatacggaaactgggttaaggctcaagagtgggcagcagtacctggaggacaagccacttacttggggaacccggtcccatggggtactttgcccacaatcttggctatagagttcttagctattgcctttgtcgagcaccagaggagcatggagaaagaccctgagaaaaagaagtacccgggaggtgcatttgaccctcttggatactccaaagacccgaagaagttcgaggagttgaaagttaaggagatcaagaacgggcgtcttgcattattggcgtttgtaggattctgtgtgcaacaatcagcctacccaggcacaggaccactggagaacctggctactcacttggcggatccatggcacaaaaacattggcgatattgttatccctttgaactagtgacttgtaaaaaaagaagaagatagtaacatatcctatgagctttatgtgtatcaaaactctctgtaatgaaagacagattgtgaattgttttgtcttggtgatggatttgcttcgtgtgagcttgaattctatgtgattataccttttgaattggt

SEQ ID NO: 1178 - DNA, 1107 bp, Musa acuminata
ggagaaggaagagtgaggcgaaaaaatggcatccagtgctttgagaagctgcgccgtcctcttcccgagcctcctctcgtcttccaagtcgcagttcgttagctcggtcgccatctcatgcaccaacggcgcgtcccgtttctccatgtccgccgactggatgcccggccagccacgtcccccgtacctcgacggctccgcccccggtgacttcgggttcgatccgcttcgcctcggggaagttccggagaacctggagaggtacaaggagtcggagctgatccactgcagatgggcgatgcttgctgtgccagggatcttggtgccggaagcactgggcctgggcaactgggtgaaggcgcaggagtgggcggcgatccccggcgggcaggcgacgtacctaggcaacccagtcccctggggcactctccccaccatcctcgtcatcgagttcttcgccattgccttcgtggagcaccagcgcagcatggagaaggaccccgagaagaagaagtaccccggcggagccttcgacccgctgggctactccaaagaccccgtcaagttcgaggagtacaaggtcaaggagatcaagaacggtcggctcgctttgctggccttcgtgggcttctgcgtgcagcagtcggcgtaccctggaaccgggccattggagaacttggcaacccacctggctgacccatggcacaacaacatcggagacattgtcatccccagatccattttgccatgaacgagaccgagagagagagagagacagagagaactcatcctgtcactcctgcaaaatcccatgtaaaacatgtgctttccgtgcactcatctcgttgtaacacaaagaacgtatatggctttccatgtagacgatcgatgttgcttcctcttatccttctttgccgaacaccaggatggatgatttagccaggaggagaaatgaaacatgcccttattttggtagggaagaatggtctgccctgccatgaacaaagataaaaaaacacttgttttgattgttattcttgacaagagatgaagcactttaaatatctttgctattccaccctcccagaacaggggcgctgggcgtcc

SEQ ID NO: 1179 - DNA, 1029 bp, Brassica napus
  misc_feature (18)..(18): n is a, c, g, or t
  misc_feature (28)..(28): n is a, c, g, or t
ggaccggtccggaatttngggtcgaggnagcgtccgcatatttcttctttgtagtaatcagaaaggcagagagagagagagagatcagaggaaacaatggcgtctaactcgctcatgagctgcggcatcgccgccgtctacccttcccttctttcttcttcaaagtctaaattcgtctcagccggagtttctctccccaacgttggtaacgttggccacatcagaatggctgctcactggatgcccggcgagccacgtccagcttacctcgacggctctgcccctggtgactttggatttgacccgcttggacttggagaggttccagagaatcttgagagatacaaagaatcagagctcatccattgcagatgggctatgctcgctgttccagggattttggtaccagaggctttgggatacggaaactgggtcaaggcccaagaatgggcagcagtgcctggaggacaagccacttacttgggcaacccagtcccatggggtactttgcccacaatcttggctatagagttcttagctattgcctttgtggagcaccagaggagcatggagaaagaccctgagaaaaagaagtaccctggaggtgcatttgaccctcttggatactccaaggacccgaagaagtttgaggagttgaaagtcaaggagatcaagaacgggcgtcttgcgttgttggcgtttgtaggattctgtgtgcagcaatcggcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactctctgtaatgaatgacagattgtctgaaacctttgttttgtcttggtgatctattgcttcgtgtgagcttgaattctatgtgattaaaccttttgaatcggtttacgaaccgatatgtgacttaacaaaatttacttcatttagattgta

SEQ ID NO: 1180 - DNA, 808 bp, Brassica napus
caatggcgtctaactcgctcatgagctgcggcatcgccgccgtctacccttcccttctttcttcttcaaagtctaaattcgtctcctccggagttgctctccccaacgttgggaacgttggccgcgtcagaatggctgctcactggatgcccggcgagccacgtccagcttacctcgatggttctgctccaggtgattttgggtttgacccgcttggacttggagaggttccagagaaccttgagagatacaaagaatcagagctcatccattgcagatgggcaatgctcgctgttccagggattttggtaccagaggctttggggtacggaaactgggtcaaagctcaagaatgggcagcagtgcctggaggacaagccacttacttggggaacccggtcccatggggtactttgcccacaatcttggctatagagttcttagctattgcctttgttgagcaccagaggagcatggagaaagaccctgagaaaaagaagtaccctggaggcgcatttgaccctcttggatactccaaggacccgaagaagtttgaagagctgaaagtcaaggagatcaagaacgggcgtcttgcgttgttggcgtttgtaggattctgcgtgcagcaatcggcctacccaggcacaggaccattggagaacctggctactcacttggcggatccatggcacaaaaacattggcgatattgttatccctttgaactagtgacttgaaaaaaagataataatatatcctatgagctttatatatcaaaactctgtgttatgaaagacacattgtgaaac

SEQ ID NO: 1181 - DNA, 1002 bp, Coffea canephora
cggccgggggcccttctccttgtcaaaccatctttttgtcttctgccattttttcttgctttccagaattctctccagttctgaagaagatggcagcaaatacattgacgagctgcggcatcgccgccgttagcccttcagtcctctcatcatccaagtcaaagttcgccacctccctggcactgcccaccagtgcttcctccagcagcaggttcaccatgtcagctgaatggatgcccggcgagccacggccaccgtaccttgatggctcagctccaggagacttcggcttcgacccacttcgttttggtgaagttccagaaaacttggaaagatacaaggaatctgagctcatccattgccgatgggccatgcttgctgtgccaggggtcctagtaccagaggcattgggtctgggaaactgggttcaggctcaagagtgggcagccattccaggaggacaagcaacctacttggggcaaccagttccatggggcaacctccctaccatcttggccattgagttccttgccattgcttttgtagagcaccagagaagcattgagaaagacactgaaaagaagaagtaccctggtggagcctttgacccgttgggcttctccaaggaccctgcaaaattcgcagagtacaaagtcaaggaagtcaagaatggccgccttgccttgttggctgtcgtgggattcgcggttcaacagtcggcataccctggaactggaccgctggagaacttagctgctcacttggcagatccatggcacaacaacattggaaacgtcatcatccccagatctatttatccttgaatcacatgatgatcgatgcagtatttagatcacacacattgtaaaaactttcttgtgtaacattaatcgacattcatggaatcccagctgcctattatggaatgtaatgtactagttccttccaacacctttctgctgcactcagtttcgcagagcaaacatgaatacatccaatttc

SEQ ID NO: 1182 - DNA, 939 bp, Coffea canephora
  misc_feature (14)..(18): n is a, c, g, or t
cccttctcctcgtnnnnnatctttttgtcctctgccattttttcttgctttccagaattctctccagttctgaagaagatggcagcaaatacattgacgagctgcggcatcgccgccgttagcccttcagtcctctcatcatccaagtcaaagttcgccacctccctggcactgcccaccagtgcttcctccagcagcaggttcaccatgtcagctgaatggatgcccggcgagccacggccaccgtaccttgatggctcagctccaggagacttcggcttcgacccacttcgttttggtgaagttccagaaaacttggaaagatacaaggaatctgagctcatccattgccgatgggccatgcttgctgtgccaggggtcctagtaccagaggcattgggtctgggaaactgggttcaggctcaagagtgggcagccattccaggaggacaagcaacctacttggggcaaccagttccatggggcaacctccctaccatcttggccattgagttccttgccattgcttttgtagagcaccagagaagcattgagaaagacactgaaaagaagaagtaccctggtggagcctttgacccgttgggcttctccaaggaccctgcaaaattcgcagagtacaaagtcaaggaagtcaagaatggccgccttgccttgttggctgtcgtgggattcgcggttcaacagtcggcataccctggaactggaccgctggagaacttagctgctcacttggcagatccatggcacaacaacattggaaacgtcatcatccccagatctatttatccttgaatcacatgatgatcgatgcagtatttagatcacacacattgtaaaaactttcttgtgtaacattaatcgacattcatggaatcccagctgcctattatggaatgtaatgtactagttccttccaac

SEQ ID NO: 1183 - DNA, 1316 bp, Vitis vinifera
tggattttcccatatctctcctcctcatacttctgctacttatcttccctcttcttccatcactgccaattcttctctctcactcgctcatcaaacacatctctccattttcttgaagatggcatccactgtgctgagaagctgcggcgtcgccgctgttgccccatcgctgctatcttcttccaagtctaaattcgccacctcgctgccactccccaatgctgccgccggctctgcccgggtcaccatgtctgccgactggatgcccggccagccccgcccaccctaccttgatggctccgcccctggtgactttggatttgacccacttcggcttggtgaagtcccagagaatctggagagatataaggaatccgaacttatccactgcagatgggctatgctcgctgttccgggagtcctagtgccagaagccttgggcttaggcaactgggtacaggctcaagagtgggcagcaattccaggaggccaagccacctacttgggcaacccagtcccatggggcaacctcccgaccattttggcgatcgaattcctggccattgcctttgttgagcaccaacgcagcatggagaaggacaccgagaagaagaagtaccctggtggcgctttcgacccattaggctactccaaggaccctgtcaagttcgaggaatacaaagtgaaagagatcaaaaatggccgccttgcaattttggcgttcgtcgggttctgcgtccaacagtcggcttatcccggaacaggaccattggagaatctggcttctcacttggcagacccatggcacaacaacattggcgatgtcatcatccccagatcaattatgccttgagtatggaattttaatttgatccataccccaccgtaaaactccattttatcatctgtaatgaatctgagttgcatatctttgatctatgtatgataattcctattactcatcttcatcctagtgactagcactcatcttagatccaaaaactattgtgaaaactgtgaatctcagtatatcagttgctgcaataccagtgtgacttcatctcaatatattgggaaagaatgctagtggcagtagttcaaccaggatcaagaggaatgtatgctagagaaaacagtatacaccatgtctgtatatgtacattcggcaaggacttctgcgtttgattgaactatggttgatcatcaactgggtattaaacactacattcccgatcatgatcataatcataatctagactatattatagtttaagtttcattaatagagaatttgaataaagttaatatttcattta

SEQ ID NO: 1184 - DNA, 840 bp, Cajanus cajan
gcggggacaagtgccattcattattctctcagttccaaatttgccactcagaaaatggctaccaacacactgatgagttctgctgtcacagccttcccttctcttctctcttcctcaaagtccaagtttgccactgcaattcctctttcaagctttgccaccaatgcctcttctcgctttaccatgacttctgactggatgccaggccagcctagacccccttaccttgatggttcagcacctggtgactttggatttgaccctctccgtcttggtgaagttccagagaatcttgagaggttcaaagagtcagaactcattcactgcagatgggccatgctggctgttccagggattttggttccagaagcattgggcttaggcaactgggtaaaggctcaggaatgggctgcagttcctgggggccaagcaacctacctaggcaaccctgttccatggggcacccttcccaccattctggtcattgaattcctttctattgcctttgtggagcaccaaaggagcatggagaaagacccagaaaagaagaaataccctggtggtgcttttgatcctttgggctactccaaggaccctaaaacattccacgaatacaaagtcaaggaaattaagaatggacgtcttgccctgttggcttttgtgggattctgtgttcaacaatcagcttatccaggcactggacctttggagaacttggctactcacttggctgatccatggcacaacaacattggaaatgtcattattccccaatcgattttgccttgaaaaaccaatccaatctttcttttaatagctacctgtataactccatgtaac

SEQ ID NO: 1185 - DNA, 1020 bp, Raphanus sativus
  misc_feature (111)..(111): n is a, c, g, or t
acatccaacacacacctctcgttcacatctttcttctttgtagcaaacagaaagggagagagagggagagagagatcggagaatacaatggcgtcgaactcgctcatgagntgcggcatcgccgccgtctacccttctcttctttcttcttcaaagtctaaattcgtctcctccggatttgccctccccaatgccgggaacgttggccgtatcagaatggctgctcactggatgcccggcgagccacgtcccgcttacctcgacggttctgctcctggtgactttgggtttgaccctcttggacttggagaggttccagagaaccttgagaggtacaaagaatcagagctcatccactgtagatgggctatgctcgctgttccagggattttggtaccagaggctttgggatacggaaactgggtcaaggctcaagaatgggcagcagtacctggaggacaagccacttacttgggcaacccggtcccatggggtactctgccaacaatcttggctatagagttcttagctattgcctttgttgagcaccagaggagcatggagaaagaccctgagaaaaagaagtacccgggaggtgcatttgaccctcttggatactccaaagaccccaagaagtttgaggagttgaaagttaaggagatcaagaacgggaggcttgcgttgttggcgtttgtaggcttctgtgtgcagcaatcggcttacccagggacaggaccattggagaacttggctactcacttggctgatccatggcacaaaaacattggcgatattgttatccctttgaactagtgacttgtaaaaaaaatggtagtaatgtgtcctatgagcttcatgtgtatcaaaactctctgtaatgaaaagacagattgtgaaacctatgatgttttgtcttggtgatcgactgcttcgtgtgagcttgaattctatgtggttttactatttgtaataccatattcctgatgtttcattgaaacaatatttaaaatcatttagatt

SEQ ID NO: 1186 - DNA, 1032 bp, Arabidopsis lyrata
acacgtggcccaatgaaaaagccacgcaggctctgtatagccaattgcaatctgattttagattctcatctcacaaatcttacttatacgatccgtctcccacattcacacttccaccaaacacctctcgtccacatcgacagatagagagaaacgatggcgtcgaactcgctaatgagctgcggcatcgccgccgtttacccttcgcttctctcttcttccaagtctaaattcgtttccgccggagttccgctccctaacgccgggaatgttggtcgtatcagaatggctgctcactggatgcccggcgagccacgaccagcttacctcgacggttctgctcctggtgactttggatttgacccacttggacttggagaagttccagagaaccttgagagatacaaagagtcagagctcatccactgtagatgggctatgctcgctgttcctgggattttggtaccagaagcattaggatatggaaactgggttaaggctcaggaatgggcagcagtaccagggggtcaagccacgtacttgggaaacccggtcccgtggggtactttgcccacaatcttggccattgagttcttagccattgcattcgttgagcaccagagaagtatggagaaagaccccgagaagaagaagtacccgggaggcgcatttgaccctcttggatactcaaaggaccccaagaagctcgaggaattgaaagttaaggagatcaagaacgggcgacttgcgctgttggcgtttgtaggattctgtgttcaacagtcggcttacccggggacaggaccattggagaacctggcaactcacttggctgatccatggcacaacaacattggcgatattgttatccctttcaactaatgaatgtaaaaatagaaatatgtaccttatgagctttatgtgtatcaaaaacactgtgtaatgaaagacagatttgtgaaaacctgtattttgtcttggtgatcgatttgctcgtgtgagcatgaattctaagtgatgaaaccttttgaa

SEQ ID NO: 1187 - DNA, 954 bp, Brassica juncea
gatccaaaacacctctctctcgttcacatctttcttctttgtggtaaacagaaaggaagttagagagagagagaaaaaaacaatggcgtcgaactcgctcatgagctgcggcatcgccgccgtctacccttctcttctctcttcttcaaagtctaagttcgtctccgccggagttcctctccccaacgccgggaacgttggccgtgtcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctcgctgttccagggattttggtaccagaggctttgggatatggaaactgggttaaggctcaagaatgggcagcagtacctggaggacaagccacttacttggggaacccagtcccttggggtactttgcccacaatcttggctatagagttcttagctattgcctttgttgagcaccaaaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaaagatagtaatatatcctatgagctttgtgtatcaaaactctgtgttatgaaagacacattgtgaaacctgcgttttgttacacaaagctcataggatatattgttatccctttgaactgatgacttgtaaaa

SEQ ID NO: 1188 - DNA, 976 bp, Brassica napus
cgttcacatctttcttctttgtggtaaacagaaagggagttagagagagagagacaacaatggcgtcgaactcgctcatgagctgcggcatcgccgccgtctacccttctcttctttcttcttcaaagtctaaattcgtctccgccggagttccactccccaacgccgggaacgttggccgcatcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctggctgttccagggattttggtaccagaggctttgggatatggaaactgggttaaggcacaagaatgggcagcagtacctggaggacaagccacttacttggggaacccagtcccttggggtactttgcccacaatcttggctatagagttcttagctattgcatttgttgagcaccagaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaaagatagtaatatatcctatgagctttgtgtgtatcaaaactctttgttatgaaagacacattgtgaaacctgtgttttgttgaattctatgtgattaaaaccttttgaatcagtttaggaactcaaatgtggttgtggtattaactagtaatatcagattcctgatgcttcttttga

SEQ ID NO: 1189 - DNA, 1020 bp, Artemisia annua
acagtggtatcaacgcagtactccgacggggatcctacaacactacaaacattcactaccaattactattaaattttcttagaatggcttccaatacattaatgagctatggcattccagccgttgcccgcccttcagttctctcatcatctaagtcgagatttacggccaatgtgccactttttggtgttgtgtctaacgggtcgaggttggtcatgacatctgattggatgcctggccaaccccgaccatcctacttagacggatctgctcccggtgacttcggttttgacccacttcgtctaggcgaagtcccagagaacctggagagatttaaagagtccgaactcatccactgtcgatgggctatgttggcagtcccagggattttggtacctgaagcattgggtttaggcaattgggtaaaagcacaagaatgggcagcccttccaggaggccaagctacttatttagggaaccctgttccatggggtaccctacccacaattttggccatagagttcatttctatcgcctttgtagaacaccaaaggagcatggaaaagaaccccgaaaagagaaagtatccaggtggtgctttcgaccccttgggttactccaatgacccaaaaaagtttgaggagtacaaggtcaaagagatcaaaaacggacggctagcattgttggctttcgtggggttctgcgtgcaacaatcggcatatcctggaactggaccgttggagaatttggcaactcacttggctgacccatggcatagcaacatcggggatgttattatccctaaaggatttttgccttaagttttgatcgaatcttaattgcaatatgtaatatagactgatgatgcctttgtaaagttcgtgtaatcaccatcagttctacaatgaaaggagtcaattagtcattttatactcaagtatttcattagttaacatttttatgtctcgaatccatgtgaagtagttccatgacatacaagcttacatcatatgcaacagt

SEQ ID NO: 1190 - DNA, 872 bp, Artemisia annua
  misc_feature (60)..(60): n is a, c, g, or t
  misc_feature (73)..(73): n is a, c, g, or t
  misc_feature (80)..(80): n is a, c, g, or t
tcactaccgattactattttcttagaatggcttccaatacattaatgagctatggcattncagccgttgcccncccttcngttctctcatcgtctaagtcgagatttacggccaatgtgccactttttggtgttgtgtctaatgggtcgaggttggtcatgacatctgattggatgcctggccaaccccgaccatcctacttagacggatctgctcccggtgacttcggctttgacccacttcgtctaggcgaagtcccagagaacctggagagatttaaagagtccgaactcatccactgtcgatgggctatgttggcagtcccagggattttggtacctgaagcattgggtttaggcaattgggtaaaagcacaagaatgggcagcccttccaggaggccaagctacttatttagggaaccctgttccatggggtaccctacccacaattttggccatagagttcatttctatcgcctttgtagaacatcaaaggagcatggaaaagaaccccgaaaagagaaagtaccctggtggcgcttttgaccccttgggttactccagtgacccaaaaaagtttgaagagtacaaggtcaaagagatcaaaaacggacggctagcattgttggctttcgtggggttctgcgtgcaacaatcggcatatcctggaactggaccgttggagaatttggcaactcacttggctgacccatggcatagcaacatcggggatgttattatccctaaagggtttttgccttaagttttgatcgaatcttaattgcaatatgtacaatagactgatgatgcctttgtaaagtgtgtgtaatcaccatcagttctacaatgaaaggagtcaattagtcatttt

SEQ ID NO: 1191 - DNA, 853 bp, Brassica juncea
aatggcgtcgaactcgctaatgagctgcggcatcgccgccgtctacccttctcttctttcttcttcaaagtctaagttcgtctccgccggagttccactccccaacgccgggaacgttggccgtatcagaatggccgctcactggatgcccggcgagccacgaccagcttacctcgacggttctgctcctggtgactttgggtttgacccacttggacttggagaggttccagagaaccttgagaggtacaaagaatcagagctcatccactgtagatgggctatgctcgctgttccagggattttggtaccagaggctttgggatatggaaactgggttaaggctcaagaatgggcagcagtacctggaggacaagccacttacttggggaacccagtcccttggggtactttgcccacaatcttggctatagagttcttagctattgcctttgttgagcaccaaaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaaagatagtaatatatcctatgagcttttgtgtatcaaaaactctgtgttatgaaagacacattgtgaaacctgcgttttgttgaattctatgtgattaaaaccttttgaatca

SEQ ID NO: 1192 - DNA, 890 bp, Brassica oleracea
  misc_feature (21)..(21): n is a, c, g, or t
ggacgcgtccgcgttcacatntttcttctttgtggtaaacagaaagggagttagagagagagagacaacaatggcgtcgaactcgctcatgagctgcggcatcgccgccgtctacccttctcttctttcttcttcaaagtctaaattcgtctccgccggagttccactccccaacgccgggaacgttggccgtatcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctggctgttccagggattttggtaccagaggctttgggatatggaaactgggttaaggcacaagaatgggcagcagtacctggaggacaagccacttacttggggaacccagtcccttggggtactttgcccacaatcttggctatagagttcttagctattgcatttgttgagcaccagaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcactggaccattggagaacttggctactcacttggccgatccatggcacaaaaacattggcgatattgttatccctttcaactgatgacttgtaaaaaaagatagtaatatatcctatgagctttgtgtgtatcaaaactctttgttatgaaagacacattgtgaaacctgtgttttgt

SEQ ID NO: 1193 - DNA, 947 bp, Brassica rapa
atccaaaacacctctctctcgttcacatctttcttctttgtggtaaacagaaagggagttagagagagagaacaatggcgtcgaactcgctcatgagctgcggcatcgccgccgtctacccttctcttctttcttcttcaaagtctaagttcgtctccgccggagttcctctccccaacgccgggaacgttggccgtgtcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctcgctgttccagggattttggtaccagaggctttgggatatgggaactgggttaaggctcaggaatgggcagcagtacctggaggacaagccacttacttggggaacccagtcccttggggtactttgcccacaatcttggctatagagttcttagctattgcctttgttgagcaccaaaggagtatggagaaggaccctgagaaaaaaaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaagatagtaatatatcctatgagctttgtgtatcaaaactctgtgttatgaaagacacattgtgaaacctgcgttttgttgaattctatgtgattaaaaccttttgaatcagttaggactcaaatgtggttgtgg

SEQ ID NO: 1194 - DNA, 1021 bp, Brassica napus
ccacgcgtccgggaagggatattggacatcgttgaaagctttttccttagggaaatcgctttctacaggtaattcaaaaagtttttttgtacaacaaaataaataaaaaacacctctcgttcacatctttcttctttgtggtaaacagaaagggagttagagagagagagacaacaatggcgtcgaactcgctcatgagctgcggcatcgccgccgtctacccttctcttctttcttcttcaaagtctaaattcgtctccgccggagttccactccccaacgccgggaacgttggccgcatcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctggctgttccagggattttggtaccagaggctttgggatatggaaactgggttaaggcacaagaatgggcagcagtacctggaggacaagccacttacttggggaacccagtcccttggggtactttgcccacaatcttggctatagagttcttagctattgcatttgttgagcaccagaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaaagatagtaatatatcctatgagctttgtgtgtatcaaaactctttgttatgaaagacacattgtgaaacctgcgttttgttgaattctatgtgattaaaaccttt

SEQ ID NO: 1195 - DNA, 893 bp, Brassica napus
ttcttctttgtggtaaacagaaagggagttagagagagagaacaatggcgtcgaactcgctcatgagctgcggcatcgccgccgtctacccttctcttctttcttcttcaaagtctaagttcgtctccgccggagttcctctccccaacgccgggaacgttggccgtgtcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctcgctgttccagggattttggtaccagaggctttgggatatgggaactgggttaaggctcaggaatgggcagcagtacctggaggacaagccacttacttggggaacccagtcccttggggtactttgcccacaatcttggctatagagttcttagctattgcctttgttgagcaccaaaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcgatattgttatccctttgaactgatgacttgtaaaaaaagatagtaatatatcctatgagctttgtgtatcaaaactctgtgttatgaaagacacattgtgaaacctgcgttttgttgaattctatgtgattaaaaccttttgaatc

SEQ ID NO: 1196 - DNA, 1038 bp, Thellungiella halophila
gatactgacacttccaaacacctcttgttcacatctttctctttgtagtaaacagaaagggagagagagagagagatagaagacaatggcgtcgaactcgctcatgagctgcggcatcgccgccgtttacccttcgcttctttcttcttcaaagtctaaattcgtctccgccggagttcctctccccaacgccgggaacgtcggccgaatcagaatggccgctcactggatgcccggagagccacgaccagcttacctcgacggttctgctcctggtgactttggatttgacccacttggacttggagaggttccagagaaccttgagcgatacaaagaatcagagctcatccactgtagatgggccatgctcgctgttccagggattttggtaccagaggctttgggatatggaaactgggttaaggctcaagaatgggcagcattacctggaggacaagccacttacttggggaatcctgtcccatggggtactttgcccacaatcttggccatagagttcttggctattgcatttgtcgagcaccagagaagtatggagaaagaccccgagaaaaagaagtacccgggaggcgcatttgaccctcttggatactccaaagacccgaagaagttcgaggagttgaaagttaaggagatcaagaacgggcggcttgcgttgttggcctttgtaggattctgtgtgcaacaatctgcctacccaggcacaggaccattggagaaccttgctactcacttggcggatccatggcacaaaaacattggcgatattgttatccctttgaactagtgactgtaaaaaaaaaagaaaattagcaatatatcctgtgagctttatgtgtaatcaaaactctgtgtaatgaaagacagattgtgaaacctgtattttgcctctgtgattgatttggtcttgtgagcttgaattctaagtgattaaaccttttgaatcgggttacgaacccaaatgtggccaacttgtaatatttgtatttagattaaaaatctgatggttctttg

SEQ ID NO: 1197 - DNA, 1249 bp, Cajanus cajan
ggggattgatttttaagatctaacatgtaacctccaccacacacaaacctccatgatatccacaagtggttccacctcaacaatcaaaccggatggccaaaatatctacgtggaccaataacaagtcacaagctaacatcatcgcccaatggaaatccacttttggatttgcctatatccacaccactctcctatattcttcttgtgctgtttcctacgttacaagtgccattcattattctctcagttccaaatttgccactcagaaaatggctaccaacacactgatgagttctgctgtcacagccttcccttctcttctctcttcctcaaagtccaagtttgccactgcaattcctctttcaagctttgccaccaatgcctcttctcgctttaccatgacttctgactggatgccaggccagcctagacccccttaccttgatggttcagcacctggtgactttggatttgaccctctccgtcttggtgaagttccagagaatcttgagaggttcaaagagtcagaactcattcactgcagatgggccatgcttgctgttccagggattttggttccagaagcattgggcttaggcaactgggtaaaggctcaggaatgggctgcagttcctgggggccaagcaacctacctaggcaaccctgttccatggggcacccttcccaccattctggtcattgaattcctttctattgcctttgtggagcaccaaaggagcatggagaaagacccagaaaagaagaaataccctggtggtgcttttgatcctttgggctactccaaggaccctaaaacattccacgaatacaaagtcaaggaattaagaatggacgtcttgccctgttggcttttgtgggattctgtgttcaacaatcagcttatccaggcactggacctttggagaacttggctactcacttggctgatccatggcacaacaacattggaaatgtcattattccccaatcgattttgccttgaaaaaccaatccaatctttcttttaatagctacctgtataactccatgtaacaatttgtaatgaatcagatctcgctgtgttggcacccctgtgttgtaattatactatgaactaatatgtttccaaactcatacttttgccaacttccgataatttgcattgcattttcaacgatgtaaaggtggtagagtataagatttaggagaaatattgagaaagagagaagagtaaacaatgattttctta

SEQ ID NO: 1198 - DNA, 843 bp, Aquilegia formosa
gataacaattccaatactagtagtattaccactaccacacagctccattccaatggcttccaatgctcttaggagttgcggtctggcagctgcgtttccatctcttctctcatcatccaattctaaattcgtcacttcagtagctcttccagttggcagaaccaatgcatcatcagggttcaaaatgtcagctgagtggatgcccggccagcctcgaccaccttaccttgatggatcagctccaggtgactttggatttgaccctcttggacttggtgaggtacctgagaaccttgagaggttcaaggaatctgaactcattcactgcagatgggctatgctagcagtaccagggatcttgttgccagaagcattaggcttaggtaactgggtgcaagctcaggagtgggctgcgctaccaggcggacaggctacttacttgggtaatccagtcccatggggaacactcccaaccatcctcgcaatcgaatttcttgccattggttttgtagagaaccaacgcacaatggaaaaagacccagaaaagaagaagtaccctggtggagctttcgatccattaggttactctaaagaccctaaaaagtttgaagagtacaaggtcaaagagataaaaaacggtcgtctagcattgttggccttcgttggattctgcgtccaacaatcagcctaccctggaacagggccattagagaatttggctactcacttggctgatccatggcacaacaacattgggaacgttgtgatcccaaaaggaattttgccataagtgatgaattgtagttgtatccatgtaatgctctaaaatgaatcaaaactgca

SEQ ID NO: 1199 - DNA, 998 bp, Brassica juncea
tggatccaaacacatctctctccttcacatctttcttcttcgtagtaaacagagagaccaaagaatacaatggcgtcgaactcgctcatgagctgcggcatcgccgccgtctacccttcccttctttcttcttcaaagtctaaattcgtttcctccggagttgctctccccaacgccggcaacgttggccgcgtcagaatggctgctcactggatgcccggcgagccacgtccggcttacctcgacggttctgccccaggtgactttggatttgaccctcttgggcttggagaggttccagagaaccttgagagatacaaagaatcagagctcatccattgcagatgggctatgctcgctgttccagggattttggtaccagaggctttgggatacggaaactgggtcaaggcccaagaatgggcagcagtacctggaggacaagccacttacttaggcaacccggtcccgtggggtactttgcccacaatcttggctattgagttcttagctattgcctttgttgagcaccagaggagcatggagaaagaccctgagaaaaagaagtaccctggaggcgcatttgaccctcttgggtactccaaggacccgaagaagtttgaggagttgaaagtcaaggagatcaagaacggacgtcttgctttgttggcgtttgtaggattctgtgtgcaacaatctgcctacccaggcacaggaccattggagaacctggctactcacttggcggatccatggcacaaaaacattggcgatattgttatccctttgaactagtgactttgtaaagaaaagatagtaatgtgtcctatgagctttatgtgtatcaaaactctctgtaatgaaagacagattgtctgaaacctttgttttgtcttggtgatctattgcttcgtgtgagcttgaattctatgtgattaaaccttttgaatcggtttacgaaccgatatgtgacttaacaaaatttacatcatttagaa

SEQ ID NO: 1200 - DNA, 922 bp, Brassica juncea
gggatccaaacacatctctctccttcacatctttcttcttcgtagtaaacagagagaccaaagaatacaatggcgtcgaactcgctcatgagctgcggcatcgccgccgtctacccttcccttctttcttcttcaaagtctaaattcgtttcctccggagttgctctccccaacgccggcaacgttggccgcgtcagaatggctgctcactggatgcccggcgagccacgtccggcttacctcgacggttctgccccaggtgactttggatttgaccctcttgggcttggagaggttccagagaaccttgagagatacaaagaatcagagctcatccattgcagatgggctatgctcgctgttccagggattttggtaccagaggctttgggatacggaaactgggtcaaggcccaagaatgggcagcagtacctggaggacaagccacttacttaggcaacccggtcccgtggggtactttgcccacaatcttggctattgagttcttagctattgcctttgttgagcaccagaggagcatggagaaagaccctgagaaaaagaagtaccctggaggcgcatttgaccctcttgggtactccaaggacccgaagaagtttgaggagttgaaagtcaaggagatcaagaacggacgtcttgctttgttggcgtttgtaggattctgtgtgcaacaatcggcatacccaggcacaggacctttggagaacctggctactcacttggcggatccatggcacaaaaacattggcgatattgttatccctttgaactagtgactttgtaaagaaacgatagtaatgtatcctatgagctttgtgtgtatcaaaactctctgtaatgaaagacagattgtgaaacctatgttttgtcttggtgatcgattgcttgcgtgtgcgcttg

SEQ ID NO: 1201 - DNA, 1028 bp, Brassica oleracea
gacagacagcatccaaacacatctctctccttcacatctttcttcttcgtagtaaacagagagaccaaagaatacaatggcgtcgaactcgctcatgagctgcggcatcgccgccgtctacccttcccttctttcttcttcaaagtctaaattcgtttcctccggagttgctctccccaacgccggcaacgttggccgcgtcagaatggctgctcactggatgcccggcgagccacgtccggcttacctcgacggttctgccccaggtgactttggatttgaccctcttgggcttggagaggttccagagaaccttgagagatacaaagaatcagagctcatccattgcagatgggctatgctcgctgttccagggattttggtaccagaggctttgggatacggaaactgggtcaaggcccaagaatgggcagcagtacctggaggacaagccacttacttaggcaacccggtcccgtggggtactttgcccacaatcttggctattgagttcttagctattgcctttgttgagcaccagaggagcatggagaaagaccctgagaaaaagaagtaccctggaggcgcatttgaccctcttgggtactccaaggacccgaagaagtttgaggagttgaaagtcaaggagatcaagaacggacgtcttgctttgttggcgtttgtaggattctgtgtgcaacaatcggcatacccaggcacaggacctttggagaacctggctactcacttggcggatccatggcacaaaaacattggcgatattgttatccctttgaactagtgactttgtaaagaaacgatagtaatgtatcctatgagctttatgtgtatcaaaactctctgtaatgaaagacagattgtgaaacctatgttttgtcttggtgatcgattgcttgcgtgtgcgcttgatttctatgtgatcaaaccttttgaatcggtttacgaacccaaatgtccaaatgtcgtttaactatttgtaatatcatattcctaaaaaaaaaaagctt

SEQ ID NO: 1202 - DNA, 963 bp, Brassica napus
ctccttcacatctttcttcttcgtagtaaacagagagaccaaagaatacaatggcgtcgaactcgctcatgagctgcggcatcgccgccgtctacccttcccttctttcttcttcaaagtctaaattcgtttcctccggagttgctctccccaacgccggcaacgttggccgcgtcagaatggctgctcactggatgcccggcgagccacgtccggcttacctcgacggttctgccccaggtgactttggatttgaccctcttgggcttggagaggttccagagaaccttgagagatacaaagaatcagagctcatccattgcagatgggctatgctcgctgttccagggattttggtaccagaggctttgggatacggaaactgggtcaaggcccaagaatgggcagcagtacctggaggacaagccacttacttaggcaacccggtcccgtggggtactttgcccacaatcttggctattgagttcttagctattgcctttgttgagcaccagaggagcatggagaaagaccctgagaaaaagaagtaccctggaggcgcatttgaccctcttgggtactccaaggacccgaagaagtttgaggagttgaaagtcaaggagatcaagaacggacgtcttgctttgttggcgtttgtaggattctgtgtgcaacaatcggcatacccaggcacaggacctttggagaacctggctactcacttggcggatccatggcacaaaaacattggcgatattgttatccctttgaactagtgactttgtaaagaaacgatagtaatgtatcctatgagctttatgtgtatcaaaactctctgtaatgaaagacagattgtgaaacctatgttttgtcttggtgatcgattgcttgcgtgtgcgcttgatttctatgtgatcaaaccttttgaatcggtttacgaacccaaatgtccaaatgtcgttt

SEQ ID NO: 1203 - DNA, 1022 bp, Brassica napus
acacagacagcatccaaacacatctctctccttcacatctttcttcttcgtagtaaacagagagaccaaagaatacaatggcgtcgaactcgctcatgagctgcggcatcgccgccgtctacccttcccttctttcttcttcaaagtctaaattcgtttcctccggagttgctctccccaacgccggcaacgttggccgcgtcagaatggctgctcactggatgcccggcgagccacgtccggcttacctcgacggttctgccccaggtgactttggatttgaccctcttgggcttggagaggttccagagaaccttgagagatacaaagaatcagagctcatccattgcagatgggctatgctcgctgttccagggattttggtaccagaggctttgggatacggaaactgggtcaaggcccaagaatgggcagcagtacctggaggacaagccacttacttaggcaacccggtcccgtggggtactttgcccacaatcttggctattgagttcttagctattgcctttgttgagcaccagaggagcatggagaaagaccctgagaaaaagaagtaccctggaggcgcatttgaccctcttgggtactccaaggacccgaagaagtttgaggagttgaaagtcaaggagatcaagaacggacgtcttgctttgttggcgtttgtaggattctgtgtgcaacaatcggcatacccaggcacaggacctttggagaacctggctactcacttggcggatccatggcacaaaaacattggcgatattgttatccctttgaactagtgactttgtaaagaaacgatagtaatgtatcctatgagctttatgtgtatcaaaactctctgtaatgaaagacagattgtgaaacctatgttttgtcttggtgatcgattgcttgcgtgtgcgcttgatttctatgtgatcaaaccttttgaatcggtttacgaacccaaatgtccaaatgtcgtttaactatttgtaatatcatattcctaatgttcc

SEQ ID NO: 1204 - DNA, 1031 bp, Manihot esculenta
gacatgtactctcctcaaagccttgcctccttccattcttctccacttcttaatccattctcagcaacccagtttcagattcctacaatggccgccaacacgttgatgagctgtggcattgccactgctttcccttctcttctctcctcttctaagtccaaattcgcctcttcaatccctcttcctagcgtcaatgtctcctctcgtatcaccatgtctgctgattggatgcctggccagccccgccctccttatctcgatggctccgctcctggtgactttgggttcgacccacttcgtctaggtgaggtccctgagaatcttgagagatttaaggagtctgaactcattcactgcagatgggctatgcttgctgttcctggaatcctagtgccagaggccttggggttaggcaactgggtgcaggcacaagagtgggctgcagttcctggtggacaagctacctacttgggtcaaccagttccatggggaaccctcccaaccattttagtcatcgagttccttgccattgccttcgttgagcaccaacgcagcatggagaaagatcctgagaagaggaagtaccctggtggtgcttttgatcctttgggctactccaaggaccctgcaaagttccatgaatacaaggtcaaggaaatcaagaatggtcgtctagcactattggcatttgtgggaatctgtgtacaacaatcagcatacccagggacaggaccattggagaacttggcaacacacttggcagatccatggcacaataacattggggatattgtcatccctagatctcttttgccttgaacaaagattcatttatccactgtaaaattcccatgtcaccatctgtaatgaaacagattttcccatctttggcctgcctatatatatatgtgtgtgtgtgtgtgttcatggtgtgaggctgggaccttcactctaggggtttctcttactgtcctacgcccacttaaacaatcatggatgtcaattttcttgtgaattagaatgattctagt

SEQ ID NO: 1205 - DNA, 966 bp, Vigna unguiculata
gggttgtctttcccccaattcacacactcttcaccaattctcacaactcttcagagccaaacaatggctgccaacacattgatgagctctgctatcacagccttcccttctctcctttcttcctcaaaatcaaggtttgcctctgcagttcccatttccagctttgccaccaatgcctcttctaggttttccatgactgctgattggatgcctggccagcctagacccccttatcttgatggttcagcaccaggtgattttggattcgaccctcttcgtcttggtgaagtgccagagaatcttgagaggttcaaagaatcagaactcattcactgcagatgggccatgcttgctgttccagggattttggttccagaggcattgggcttaggaaactgggtaaaggctcaggaatgggctgcagttcctgggggccaagctacctacctaggcaacccagttccatggggcacactacccacgattcttgtcattgaattccttgctatttcctttgtggagcaccaaaggagcatggagaaagacccagagaagaagaaataccctggtggtgcttttgatcctttgggatactccaaggaccctaaagcattccatgaatacaaagtcaaagaacttaagaatggacgtcttgctttgttggcttttgtgggattctgtgttcaacaatcagcttatcctggaactggacctttggagaacttggcaactcacttggctgacccatggcacaacaacatcggaaacatcattattccacaatcgattttgccttgaaaaatccaatatttgttctaatagctacttgtataactccatgtaacaatttgtaatgaatcagatatggctatgttggtattcctgtgcagtaattatacttctgattagtatgtttcggaactcatactttgacaactcagttagtataaaacgaaagattagaga

SEQ ID NO: 1206 - DNA, 973 bp, Mesembryanthemum crystallinum
gtcatcctacaactcatcaccacaatctccttgcttctttctttcttaacaaaacctacttgccgtagttcatcgactcaacaatggcttctaatgccttgaggagctgcggcattgcggcggttttcccatcttctctctcctcctcaaaatctgtgtttgctacctccgtgccattaggaaatgtctcgtgtaactcgtctcgcttcaccatgtcggcggagtggatgcctggccagcctagaccaccctaccttgatggatcagctcccggtgactttggatttgacccacttcgactaggggaagtgcctgagaatttggagaggttcaaggagtctgagctaatccactgcagatgggcaatgcttgcggttccagggatcattgtacctgaagccttgggattaggcaactgggtgaaagctcaagaatgggcagcaattcccggaggtcaagccacctacttgggcaaccccgtcccatggggtaacttgccaaccattttggccatcgagttccttgccattgcctttgtagagcaccaaaggagcatggagaaagaccctgagaagaggaagtaccccggtggagctttcgacccattaggctactctaaggaccctaagaagttcgaggaattgaaaatcaaggaggttaagaatggtcgtcttgcattgttggctttcgtggggttctgcattcaacaatcagcgtatcctggaacaggtccgctagaaaacttggcaactcacttggctgacccatggcacaagaacattggggacattctcatccccccatcaatgtagacttgaatgtatgcgtaattatgatcagaaccatacatgatgtaaaaatgtccaatgcatttacctgtaatgataactattatgctatgatatgcaagtaaatgtgttttaaatgtagaaacaacttatttgtgctattctaatgttgcttgattctatgt

SEQ ID NO: 1207 - DNA, 948 bp, Eucalyptus gunnii
tctctctctctctctctctctcgcgctccattctccgaagactcaccgatcgtctccggtctccgagaatggccgccaactcgttgatgagctgcggcatctccaccacctccttcccatccgtcctctcctcctccaagtcgaagttcgccgccgccgtcccgctcccgagcggcgccgccacgaatgccgcgtcgcgcttctccatgtcggccgactggatgcccggttcgccccggccaccctacctcgacggctcggcacccggcgacttcgggttcgacccgcttcggctcggggaagtcccggagaacctggagagattcaaggagtctgaactcattcactgcagatgggctatgctcgctgttcccgggatcttggtgccggaagccttgggcttaggaaactgggtgcaagcgcaggagtgggcggccaagcccggaggccaggccacctacttgggcaacccggtcccgtggggaactctgcccaccatcctcgccatcgagttcatctccatcgcctttgtcgagcaccagcgcagcatggagaaggacccggagaagaagaagtaccccggcggcgccttcgaccccctcggctactccaaggaccccgtcaagttcgaggagctcaaagtgaaggagatcaagaacggtcgtctggcgttgttggcgttcgtcgggttctgcgtccagcaaacggcttaccctggcaccgggcccctggagaacttggcgacgcaccttgctgatccgtggcacaacaacatcggggacatcctcattccctgaacggtctcgccttgaaacgacatcgagaaagatagaagagtctcctgtatgagttggacacatcctgtaaaatcccttcgtgatcatctgtaacgaatcccgtgatcctttgctacgagtcttttatgaatcatgctaattgtctggagtg

SEQ ID NO: 1208 - DNA, 1005 bp, Quercus alba
atcaacgcagagtacatgggacattcattcattctctctttggttcctctccaaaaacacaaaacttcaatcagagacaaatggctgccaacacattgatgagctgtggcatcgccaccacagctttcccatcagtcctctcttcttcaaagtccaaatttgccacagctacccctctttctagtgttggtgccaatgcctcgtcccgctttaccatgtcagccgagtggatgccaggtcagcctcggcctaaacacctcgatggctcggcacccggggactttggatttgacccacttgggctaggtgaagttccagagaaccttgaaagatttaaggaatccgaactcatccactgcagatggtgtatgcttgctgttccaggagtcctagtaccagaggcattgggattgggcaactgggtgcaggctcaggagtgggctgcagttccaggaggccaagccacatacttgggaaacccagtgccatggggtaaccttcccaccattttggctattgaattccttgcaatttccttcgttgagcaccaacgtagcatggagaaagaccccgagaagaagaagtaccctggtggtgcttttgaccccttgggctactccaaggaccctaaaaaattcgaggaatacaaggtcaaagagattaaaaatggtcggcttgcaattttggcttttttggggttctgcgttcaacaatcagcttatcctggcacaggaccattggagaacttggcttctcacttggctgacccatggcacaacaacattgggaatgtgattatcccaagagggttgtaattttgatcatacttttcactgtaaaagtccatgtgacattctgtaatgaatcgggatttctttggtctgtgtaattataagtttagaattgctacattataaactttcactttggtacctaaaaattactgtgaaagtcagtgtacctgttttattctagaaaatgcaaaacaagtctagttaattcgtg

SEQ ID NO: 1209 - DNA, 1101 bp, Quercus alba
atggggactggttcctcttccataatccacattcattcattctctctttggttcctctccaaaaacacaaaacttcaatcagagacaaatggctgccaacacattgatgagctgtggcatcgccaccacagctttcccatcagtcctctcttcttcaaagtccaaatttgccacagctacccctctttctagtgttggtgccaatgcctcgtcccgctttaccatgtcagccgagtggatgccaggtcagcctcggcctaaacacctcgatggctcggcacccggggactttggatttgacccacttgggctaggtgaagttccagagaaccttgaaagatttaaggaatccgaactcatccactgcagatggtgtatgcttgctgttccaggagtcctagtaccagaggcattgggattgggcaactgggtgcaggctcaggagtgggctgcagttccaggaggccaagccacatacttgggaaacccagtgccatggggtaaccttcccaccattttggctattgaattccttgcaatttccttcgttgagcaccaacgtagcatggagaaagaccccgagaagaagaagtaccctggtggtgcttttgaccccttgggctactccaaggaccctaaaaaattcgaggaatacaaggtcaaagagattaaaaatggtcggcttgcaattttggcttttttggggttctgcgttcaacaatcagcttatcctggcacaggaccattggagaacttggcttctcacttggctgacccatggcacaacaacattgggaatgtgattatcccaagagggttgtaattttgatcatacttttcactgtaaaagtccatgtgacattctgtaatgaatcgggatttctttggtctgtgtaattataagtttagaattgctacattataaactttcactttggtacctaaaaattactgtgaaagtcagtgtacctgttttattctagaaaatgcaaaacaagtctagttaattcgtggtagtggtcgagagaaatgctgggaacaagctccaattgactgggatagtgactaactatttgggtattttcttcttgcactctaaag

SEQ ID NO: 1210 - DNA, 1073 bp, Quercus alba
acattcattcattctctctttggttcctctccaaaaacacaaaacttcaatcagagacaaatggctgccaacacattgatgagctgtggcatcgccaccacagctttcccatcagtcctctcttcttcaaagtccaaatttgccacagctacccctctttctagtgttggtgccaatgcctcgtcccgctttaccatgtcggccgagtggatgccaggtcagcctcggcctaaacacctcgatggctcggcacccggggactttggatttgacccacttgggctaggtgaagttccagagaaccttgaaagatttaaggaatccgaactcatccactgcagatggtgtatgcttgctgttccaggagtcctagtaccagaggcgttgggattgggcaactgggtgcaggctcaggagtgggctgcagttccaggaggccaagccacatacttgggaaacccagtgccatggggtaaccttcccaccattttggctattgaattccttgcaatttccttcgttgagcaccaacgtagcatggagaaagaccccgagaagaagaagtaccctggtggtgcttttgaccccttgggctactccaaggaccctaaaaaattcgaggaatacaaggtcaaagagattaaaaatggtcggcttgcaattttggcttttttggggttctgcgttcaacaatcagcttatcctggcacaggaccattggagaacttggcttctcacttggctgacccatggcacaacaacattgggaatgtgattatcccaagagggttgtaattttgatcatacttttcactgtaaaagtccatgtgacattctgtaatgaatcgggatttctttggtctgtgtaattataagtttagaattgctacattataaactttcactttggtacctaaaaattactgtgaaagtcagtgtacctgttttattctagaaaatgcaaaacaagtctagttaattcgtggtagtggtcgagagaaatgctgggaacaagctccaattgactgggatagtgactaactatttgggtattttcttcttgcactctaaag

SEQ ID NO: 1211 - DNA, 1032 bp, Arabidopsis thaliana
atagtgcagatggatatcgaacagaagaacatgatatcgagaagacacgtggcccaatgaaaaagccacgcaggctctgtatagccaattgcaatctggttttagattctcatctcacaaatcttacttatacgatcagtctcccacattcacacttccaccaaacacctctcgtccacatctttctcctttggtggcaaacacaacgacagatagagagaaacgatggcgtcgaactcgcttatgagctgtggcatagccgccgtgtacccttcgcttctctcttcttccaagtctaaattcgtatccgccggagttccactcccaaacgccgggaatgttggtcgtatcagaatggctgctcactggatgcctggcgagccacgaccagcttaccttgacggttctgctcctggtgactttgggtttgacccacttggacttggagaagttccagcgaaccttgagagatacaaagagtcagagctcatccactgtagatgggctatgctcgctgttcctgggattttggtaccagaagcattaggatatggaaactgggttaaggctcaggaatgggcagcactaccagggggtcaagccacttacttgggaaacccagtcccgtggggtactttgcccacaatcttggccattgagttcttagccattgcatttgttgagcaccagagaagtatggagaaagaccctgagaagaagaagtacccgggaggcgcatttgaccctcttggatactcgaaggaccccaagaagctcgaggaattgaaagttaaagagatcaagaacgggcggcttgcgctgttggcgtttgtaggattctgtgtgcaacagtcggcttacccggggacaggaccattggagaacttggcaactcacttggcggatccatggcacaacaacattggcgatattgttatccctttcaactaatgaatgtaaaaatagaaatatgtgtaccttatgagctttatgtgtatcaaaaacactgtgtaatgaaagacagatttgtga

SEQ ID NO: 1212 - DNA, 1077 bp, Populus trichocarpa
atcatcctttctcacaaactcaacttcacttcgccacagattctaacagaatatatggccgccaccaatacattgatgagctgtggcattgccactgctttcccttcactcctatcatcttcaaagtccaaatttgcctcttcaattccacttcctagtgtcaatggcacctctcgtgtcaccatgtcagctgactggctgcctggccagcctcgtccaccttaccttgatggctcagccccaggtgactttgggttcgacccacttagactgggtgaggtccctgagaatctcgagagatacaaggagtctgagctcattcactgcagatgggctatgcttgctgttcctggaatcctaataccagaggccttaggtctgggcaactgggtgaaagctcaagagtgggctgcagccccaggtggccaagctacttatttgggccagccagttccatgggggaccctccctaccgtcttggccattgaattcgttgccatcgcctttgtggagcaccaacgtagcatggagaaagacccagagaagaagaagtaccctggcggtgcttttgatcctctgggcttctccaaggaccctaagaagttcgaggaatacaaagtcaaagaaattaaaaatggccgtctagcactgttggcatttgttgggttctgtgtgcagcagtcagcttaccctggcactggaccattggagaacttggcaactcacttggctgacccatggcacaacaacattggggacattatcgtccctagaacgctttcgccttgaaaaatcaaatattgcttcgagtatctactgtaaattccatgtaaccatgatgaaatgatgtgagatttattgatctataggccatgcctctatgatcaacagtgggatttgttttagttgttgttcagaattctgtaaatcctcatcaccggacagaacccctgatgtgttgtcggccgagtgataaataggtttgctatcaatattgttactatcgcgagatagaataaaagaaaagatgaaaaataatttttttaataaatgcatttgatgatggtctagacctcc

SEQ ID NO: 1213 - DNA, 1048 bp, Populus trichocarpa
catcctttctacaaactcaacttcacttcgccacagattctaagagaatatatggccgccaccaatacattgatgagctgtggcattgccactgctttcccttcactcctatcatcttcaaagtccaaatttgcctcttcaattccacttcctagtgtcaatggcacctctcgtgtcaccatgtcagctgactggctgcctggccagcctcgtccaccttaccttgatggctcagccccaggtgactttgggttcgacccacttagactgggtgaggtccctgagaatctcgagagatacaaggagtctgagctcattcactgcagatgggctatgcttgctgttcctggaatcctaataccagaggccttaggtctgggcaactgggtgaaagctcaagagtgggctgcagccccaggtggccaagctacttatttgggccagccagttccatgggggaccctccctaccgtcttggccattgaattcgttgccatcgcctttgtggagcaccaacgtagcatggagaaagacccagagaagaagaagtaccctggcggtgcttttgatcctctgggcttctccaaggaccctaagaagttcgaggaatacaaagtcaaagaaattaaaaatggccgtctagcactgttggcatttgttgggttctgtgtgcagcagtcagcttaccctggcactggaccattggagaacttggcaactcacttggctgacccatggcacaacaacattggggacattatcgtccctagaacgctttcgccttgaaaaatcaaatattgcttcgagtatctactgtaaattccatgtaaccatgatgaaatgatgtgagatttattgatctataggccatgcctctatgatcaacagtgggatttgttttagttgttgttcagaattctgtaaatcctcatcaccggacagaacccctgatgtgttgtcggccgagtgataaataggtttgctatcaatattgttactatcgcgagatagaataaaagaaaagatgaaaaataatttttttaataaa

SEQ ID NO: 1214 - DNA, 903 bp, Curcuma longa
agaaatggcgtccactgccctgcggagctgcgccgtgctcttccccagcctcctctcctcttccaagtccaagttcgccgctggctccctcgccctcccctcctcccacggtgcctccgtcggccgcttctccatgtccgccgactggatgcccggccagccacggccgccctacctcgacggctccgcccccggcgacttcgggttcgacccactccgcctcggagaggttccggagaacctggagaggtacaaggagtccgagctcatccactgccggtgggcgatggccgccgtgccggggatcttgattccggaggcgctgggactgggcaactgggtgaaggcccaggagtgggcggccatacccggaggccaggccacctaccttggcaacccggtgccgtggggcaccctcccgaccatcctcgtcatcgagttcctcgcgatcgccttcgtggagcaccagcgcagcatagagaaggacccggagaagaagaagtaccccggcggtgccttcgaccccttgggttactccaaggaccctgccaagttcgaagagtacaaggtcaaggagatcaaaaatggtcggctcgctctgctggcattcgtgggaatttgcgtccagcaatctgcgtacccgggcactggacctttggagaacctggcctcccacttggctgacccatggcacaacaacatcggggacatcgtgatccccagatccatcgtgccatgagttagctagagggggctgtagcttcctcgccacaccgtaaagtttcatgtcgaacatgcctttgccctgttgggtagctgtatttaatcggtgacacgatattagttgcatgatcttgtttgatttctaatccaagaaatttgggcaagtgaatcactgatctc

SEQ ID NO: 1215 - DNA, 998 bp, Tropaeolum majus
cggccggggaccttcatccagctctctcgaattcaagccaagaagtaaggcttgtggtattttcttcaagacaaaaaaatggccaccaacacactgatgagccatgggatatctacaccggccttccccacacttctctctgcatctaaatcaaaattcgccgcagcattttctcttcctagtaccatcagcaatggaaatcgtttcgtcatgtctgcggagtggatgcccggtcaaccccgtccctcttatctagatggctcagcaccaggtgattttggattcgatccacttgggcttggggcagtcccagaaaacttagaaagattcaaggagtctgaactcattcactgcagatgggctatgcttgctgttccagggattttagtgccagaggctttggggttaggtaactgggttcaggctcaagagtgggctgcagtccctggaggtcaagcaacctacctaggaaacccggttccatggggcactctccctaccattcttgccattgaattcttagccattgcgttcgtggaacaccagcggagcatggagaaagaccccgagaagagaaagtatcccggtggtgctttcgatcctttaggctactctaaggatcccaagaagttcgaggagtacaaagtaaaggagatcaaaaatggtcgcctagcgttgctagcgtttgtgggtttctgtgtgcaacaatcagcatatccagggacagggcctttggaaaacttggcaagtcatttggctgacccatggcacaacaccattggggacattgtcatccccagatcaatttataattgaggaaattatcaaaattttcttctttagtcaatatcctcggtctgtgtgggtcttgaaatgtaacagtttgtaatgatatcagaactttcatgtttatggttctatgtaattaatcattttacatgactatgaaagttagtttggctgctacaactgggatgcatgtacattttacattttca

SEQ ID NO: 1216 - DNA, 1034 bp, Quercus alba
attcattctctctttggttcctctccaaaacacaaaacttcaatcagagacaaatggctgccaatacattgatgagctgtggcatcgccaccacagctttcccatcagtcctctcttcttcaaagtccaaatttgccacagctacccctcttcctagtgttggtgccaatgcctcgtcccgctttaccatgtcggccgagtggatgccaggtcagcctcggcctaaacacctcgatggctcggcacccggggactttggatttgacccacttgggctaggtgaagttccagagaacctcgaaagatttaaggaatccgaactcatccactgcagatggtctatgcttgctgttccaggagtcctagtaccagaggcgttgggattgggcaactgggtgcaggctcaggagtgggctgcagttccaggaggccaagccacatacttgggaaacccagtgccatggggtaaccttcccaccattttggctattgaattccttgcaatttccttcgttgagcaccaacgtagcatggagaaagaccctgagaagaagaagtaccctggtggtgcttttgaccccttgggctactccaaggaccctaaaaaattcgaggaatacaaggtcaaagagattaaaaatggtcggcttgcgattttggcttttctggggttctgcgttcaacaatcagcttatcctggcacaggaccattggagaacttggcttctcacttggctgacccatggcacaacaacattgggaatgtgattatcccaagagggttgtaattttgatcatacttttcactgtaaaagtccatgtgacattctgtaatgaatcgggatttctttggtctgtgtaattataagtttagaattgctacattataaactttcactttggtacctaaaaattactgtgaaagtcagtgtacctgttttattctagaaaatgcaaaacaagtctagttaattcgtggtagtggtcgagagaaatgctgggaacaagctccaattgactgggatagtgactaa

SEQ ID NO: 1217 - DNA, 956 bp, Phaseolus coccineus
cacactcatcaccaattctcacaactcttcttcacactcagaaaatggcagccaacacattgatgagctctgctatcacagccttcccttctttactttcttcctcaaaatcaaggtttgcctcttcagttcccatttccagctttggcaccaatgcctcttctaggttttccatgacttctgactggatgcctggccaacctagacccccttaccttgatggttcagcaccaggtgactttggattcgatcctcttggtcttggtgaagtaccagagaatcttgagaggttcaaagagtcagaactcattcactgcagatgggccatgcttgctgttccagggattttggttccagaggcattggggttaggaaactgggtaaaggctcaggaatgggctgcagttcctggggggcaagccacctacctaggcaacccagttccatggggcacactacccaccattctggtcattgaattccttgccatttcctttgtggagcaccaaaggagcatggagaaagacccagagaagaagaaataccctggtggtgcttttgatcctttgggatactccaaggaccctaaaagtttccatgaatacaaagtcaaagaaattaagaatggacgtcttgctctgttggcttttgtgggaatttgtgttcaacaatcagcttatcctggaactggacctttggagaacttggctactcacttggctgacccatggcacaacaacattggaaacatcgttattccacaatcgatttcgccttgaaaaaaccaatatttgttctagcacctacttgtataactccatgtaacaatttgtaatgaatcagatctggctatgttggtaccctgtgcagtgattatactttcaattactatgttttgaaactcatactttggcaacacgttagtatgaaacgaaagcttagaaaacttttaagcc

SEQ ID NO: 1218 - DNA, 907 bp, Liriodendron tulipifera
  misc_feature (536)..(536): n is a, c, g, or t
  misc_feature (548)..(548): n is a, c, g, or t
  misc_feature (635)..(635): n is a, c, g, or t
  misc_feature (671)..(671): n is a, c, g, or t
  misc_feature (681)..(681): n is a, c, g, or t
agagaaagaagacagagatggcgtcgagcgccttgaggagctgcggagtggcgtcggtcgtcccttctctcctctcatcgtcgaaatccaaattcgccaacgcaatcgccctcccgaattctttctccaatgcgtcgtcccggtgggccatgtcagctgaatggatgcctggccagccccgaccgccttatctcgacggttcggcacccggtgacttcgggttcgatccgcttcggctcggcgaggtcccggagaacctcgagagattcaaggagtctgaactcattcactgccgatgggcaatgcttgctgttccagggatcctggtgccagaggctttgggcttgggcaattgggtgaaggcacaagagtgggccgcggtaccaggtgggcaggcgacctacctaggcaacccagtcccatggggcaccctcccaaccatcctcgtcattgaattcatcgccattgcctttgtggagcaccagcgtagcatggagaaagacacggagaagaagaagtacccgggcggagccttngaccccttgggntactccaaggaccccgaaaagttcaaggaatacaagatcaaggagatcaaaaacggccggcttgccttgttggcctttgtgggattntgcgtccagcaatcggcttatcccggaacgggcccnctggaaaatntggcaacccacttggctgatccatggcacaacaacattggcgatgtcctgatcccaagaaacctttcgccttgatgagtatttgaattttagtcaaacgccactgtaaaactccacgtattcatctgtatgagtatgaagaatgaattgcatctatcatctgtgtttgatctcctaaatccctctttttcatgccccaaatacaaagcagcatagaaaacttcctt

SEQ ID NO: 1219 - DNA, 1178 bp, Arachis hypogaea
gcacgaggctgccatttccttgattgactatttttgagtgagagagaatggcgtctaacacattgatgagttctactatatcagctttcccgtctcttctttcttcctcaaagtcaagatttgccacttcaattccaatctcatgctttggaagcaatgtgtcttctcgcttctccatgactgctgactggatgccaggccagcctagacccccttaccttgacggttcagctccaggtgactttggatttgaccctcttcgtcttggagcagtaccagagaatcttgagagattcaaggagtctgaacttatccactgcagatgggctatgcttgctgttccaggtatgttggtaccagaggcattgggcttaggaaattgggtgcaagctcaggaatgggctgcgaagcccggaggccaagcaacctaccttggaaaccctgttccatggggcaccctccccaccattttggtgattgaattccttgctattgcttttgtggagcaccaaagaagcatggagaaagaccccgagaagaagaaataccctggtggtgcctttgatcctctgggatactctaaggatcctaagaagttccacgaatacaaaatcaaagaaatcaagaatggacgtcttgctttgttggcttttgtgggattctgtgtgcaacaatcagcataccctggcactggcccattggagaacttggccactcacttggctgatccatggcacaacaacattggaaatgtcatcattcccttttgaattcagagatttctctgctcttttgtgctgtacttgtaattagaatttaatttgatatgatatgatatgtttcagaagtcacaactcatacttcgtgatgaaacttttaagctcaaggagaatgataatcaaataaaaagaagcaagagatggtgataattggcgttagaatcaagttaaaatgtgtgtataactgtatccttccttttctgttgtaaagtttcttcatagtttcacgatcatcatcagcgagcaggagaaaaaagtgaaaaaaactgtcgcgcctcggccagtcgaacctagactcgacagcttagcatggcggcgcaatcgagctcactgcaattcgcttatgagtcgattacattcattgccgatcactgctgactgaaacctggctaaccacta

SEQ ID NO: 1220 - DNA, 1173 bp, Arachis hypogaea
gcacgaggctgccatttccttgattgactatttttgagtgagagagaatggcgtctaacacattgatgagttctactatatcagctttcccgtctcttctttcttcctcaaagtcaagatttgccacttcaattccaatctcatgctttggaagcaatgtgtcttctcgcttctccatgactgctgactggatgccaggccagcctagacccccttaccttgacggttcagctccaggtgactttggatttgaccctcttcgtcttggagcagtaccagagaatcttgagagattcaaggagtctgaacttatccactgcagatgggctatgcttgctgttccaggtatgttggtaccagaggcattgggcttaggaaattgggtgcaagctcaggaatgggctgcgaagcccggaggccaagcaacctaccttggaaaccctgttccatggggcaccctccccaccattttggtgattgaattccttgctattgcttttgtggagcaccaaagaagcatggagaaagaccccgagaagaagaaataccctggtggtgcctttgatcctctgggatactctaaggatcctaagaagttccacgaatacaaaatcaaagaaatcaagaatggacgtcttgctttgttggcttttgtgggattctgtgtgcaacaatcagcataccctggcactggcccattggagaacttggccactcacttggctgatccatggcacaacaacattggaaatgtcatcattcccttttgaattcagagatttctctgctcttttgtgctgtacttgtaattagaatttaatttgatatgatatgatatgtttcagaagtcacaactcatacttcgtgatgaaacttttaagctcaaggagaatgataatcaaataaaaagaagcaagagatggtgataattggcgttagaatcaagtaaaatgtgtgtataactgtatctacttttctgttgtaagtttcttcatattttcacaatcatcatcagcagcaggagaataaagtgaaaaaaactgtcgcgcctcggccagtcgaacctagactcgacagcttagcatggcggcgcaatcgagctcactgcaattcgcttatgagtcgattacattcattgccgatcactgctgactgaaacctggctaaccacta

SEQ ID NO: 1221 - DNA, 1056 bp, Mimulus guttatus
aaaaaaaaaaaaaaattatggccgcgaatgcattgatgagctgcggcatggcggcggccgccgtcgtccgcccgtcggtcctctcatcttcgaagtcgagattcgccgcctcaattccgatggccacgagcggcggcgccaccacctcacggtttacaatgtccgccgagtggatgcccggggagcctcgcccaccctacctcgatggatctgcacctggagactttggatttgatccacttggtctgggtgaagtgccagcaaatctagaaaggtacaaggagtctgagctcattcactgcagatgggctatgcttgctgtgcctgggatcctagtcccggaggcgttggggttgggcaactgggtaaaggcacaagaatgggcggcactaccgggcgggcaagcgacttatttgggcaacccggttccgtgggggaccctacccacaattttggctattgaattcttggcaattgcatttgtcgagcaacaaaggagcatggaaaaggacccggaaaagaagaagtacccgggtggggctttcgacccgttgggttactccaaggacccgaagaagcttcaagagctcaaagtcaaggaaattaaaaatggtcgcctagcattgttggcatttgttggattctgtattcagcaaacggcatacccgggtaccggcccgttggagaacttggcaacccatttggccgacccatggcacaacaacattggagatgtccttattcctaaataatttactaaattaaatatgtgttttttttgtctccaaattaaattcaacccattattgtaaagctccttgtaacattaattattattattattattattgtttatgtgtgtattggacatggtatatttatgtatctcttttttgtttgcactttaattcagtgattactttgcacgattagggctcggtcggttatcgttgtaaggttctattgactaaataatagggctgctagtatcacgtttggttgatacgattcatatttactcaaatgcattgcagaaattgaaatcctctattatta

SEQ ID NO: 1222 - DNA, 1086 bp, Mimulus guttatus
attaatttcactcacaaaaaagaaaaaatcaaaaaaaaaaaaaaattatggccgcgaatgcattgatgagctgcggcatggcggcggccgccgtcgtccgcccgtcggtcctctcatcttcgaagtcgagattcgccgcctcaattccgatggccacgagcggcggcgccaccacctcacggtttacaatgtccgccgagtggatgcccggggagcctcgcccaccctacctcgatggatctgcacctggagactttggatttgatccacttggtctgggtgaagtgccagcaaatctagaaaggtacaaggagtctgagctcattcactgcagatgggctatgcttgctgtgcctgggatcctagtcccggaggcgttggggttgggcaactgggtaaaggcacaagaatgggcggcactaccgggcgggcaagcgacttatttgggcaacccggttccgtgggggaccctacccacaattttggctattgaattcttggcaattgcatttgtcgagcaacaaaggagcatggaaaaggacccggaaaagaagaagtacccgggtggggctttcgacccgttgggttactccaaggacccgaagaagcttcaagagctcaaagtcaaggaaattaaaaatggtcgcctagcattgttggcatttgttggattctgtattcagcaaacggcatacccgggtaccggcccgttggagaacttggcaacccatttggccgacccatggcacaacaacattggagatgtccttattcctaaataatttactaaattaaatatgtgttttttttgtctccaaattaaattcaacccattattgtaaagctccttgtaacattaattattattattattattattgtttatgtgtgtattggacatggtatatttatgtatctcttttttgtttgcactttaattcagtgattactttgcacgattagggctcggtcggttatcgttgtaaggttctattgactaaataatagggctgctagtatcacgtttggttgatacgattcatatttactcaaatgcattgcagaaattgaaatcctctattatta

SEQ ID NO: 1223 - DNA, 749 bp, Brassica napus
ctttcttctttgtggtaaacagaaagggagttagagagagagaacaatggcgtcgaactcgctcatgagctgcggcatcgccgccgtctacccttctcttctttcttcttcaaagtctaagttcgtctccgccggagttcctctccccaacgccgggaacgttggccgtgtcagaatggctgctcactggatgcccggcgagccaagaccagcttacctcgacggttctgctcctggggactttgggtttgacccacttggacttggagaggttccagagaaccttgagaggtacaaagaatcagagctcatccactgtagatgggctatgctcgctgttccagggattttggtaccagaggctttgggatatgggaactgggttaaggctcaggaatgggcagcagtacctggaggacaagccacttacttggggaacccagtcccttggggtactttgcccacaatcttggctatagagttcttagctattgcctttgttgagcaccaaaggagtatggagaaggaccctgagaaaaagaagtacccgggaggtgcatttgaccctctcggatactccaaagacccaaagaagttcgaggagttgaaagttaaagagatcaagaacgggcggcttgcactgttggcgtttgtaggcttctgtgtgcaacaatcggcctacccaggcacaggaccattggagaacttggctactcacttggccgatccatggcacaaaaacattggcg

SEQ ID NO: 1224 - DNA, 922 bp, Arachis hypogaea
gccatttccttgattgactatttttgagtgagagagaatggcgtctaacacactgatgagttctactatatcagctttcccgtctcttctttcttcctcaaagtcaagatttgccacttcaattccaatctcatgctttggaagcaatgtgtcttctcgcttctccatgactgctgactggatgccaggccagcctagacccccttaccttgacggttcagctccaggtgactttggatttgaccctcttcgtcttggagcagtaccagagaatcttgagagattcaaggagtcagaacttatccactgcagatgggctatgcttgctgttccaggtatcttggtaccagaggcattgggcttaggaaattgggtgcaagctcaggaatgggctgcgaagcccggagggcaagcaacctacctcggaaaccctgttccatggggcacccttcccacaattttggtgattgaattcctttctattgcctttgtggagcatcaaagaagcatggagaaagaccccgagaagaagaaataccctggtggtgcctttgatcctctgggatactctaaggatcctaagaagttccacgaatacaaaatcaaagaaatcaagaatggacgtcttgctttgttggcttttgtgggattctgtgtgcaacaatcagcataccctggcactggaccattggagaacttggccactcacttggctgatccatggcacaacaacattggaaatatcatcattcccttttgaattcaaagatttctctgctcttttgtgctgtacttgtaattagaatttaatttgatatgatatgatatgtttcagaagtcacaactcatacttcgtgatgaaacttttaagctcaaagagaatgataatcaaataaaaagaagcgagagatggtgataattg

SEQ ID NO: 1225 - DNA, 958 bp, Musa acuminata
gggaagcagtggtatcaacgcagagtggccattacggccgggggacccacacatttctcctcgcgcatcagcaagacagagcgaggagaaatggcgtctgctgctctgagaagctgcgccgttctcttcccgagcctcctctcctcctccaagtcgcagttcaacggctccgtctccctcccctgcgccaatggcgcgtcccgcttctccatgtccgccgagtggatgcccggccagcctcgccccccttacctcgacggctccgcccctggcgacttcggcttcgacccgcttcgcctcggggaagtcccggagaacctggagaggtacaaggagtcggagctcatccactgccgttgggcaatgcttgctgtgccggggatcttggtgccggaagccctgggcctgggcaactgggtgaaggcgcaggagtgggcggcggtgcccggcgggcaggccacctacctcggcaacccggtcccgtggggcacgctcccgaccatccttgtcatcgagttcatcgccatcgccttcgtcgagcaccaacgcagcatggagaaggaccccgagaagaagaagtaccccggtggagccttcgaccccctgggcttctccaaggaccccgccaagttccaggagtacaagatcaaggagatcaaaaatggtcgtcttgctttgttggccttcgtcgggttctgcgtgcagcagtcggcgtacccgggaacggggcccttggagaacttagccactcacttggcggatccatggcacaacaacataggcgacatcgtcatccccagatcggtgttgccatgatcatggtgggcttcgttcatcttcccactctgtataattccatgtactgaatgcatgcttgtgctcccttccatccgtgtaattgctgatacatttccattacacatgcaatatcttgttgtactccaaaggaagttcatgg

SEQ ID NO: 1226 - DNA, 887 bp, Juglans hindsii x Juglans regia
  misc_feature (187)..(187): n is a, c, g, or t
  misc_feature (199)..(199): n is a, c, g, or t
  misc_feature (229)..(229): n is a, c, g, or t
  misc_feature (232)..(233): n is a, c, g, or t
  misc_feature (325)..(325): n is a, c, g, or t
  misc_feature (385)..(385): n is a, c, g, or t
  misc_feature (467)..(467): n is a, c, g, or t
  misc_feature (649)..(649): n is a, c, g, or t
  misc_feature (682)..(682): n is a, c, g, or t
  misc_feature (795)..(795): n is a, c, g, or t
  misc_feature (824)..(825): n is a, c, g, or t
ccgagagcatggcttcaacacattgacgatgagctatggcatcgccaccaccaccttcccatctgtcctttcttcgtccaagtccaaatttgccaccgctctcccacttcccggtgttggggccgccaatgcctcgtcccgcttcaccatgacggccgagtggatgccgggccagcctcgacctccncacctcgacggntcagcacctggtgacttcggatttgacccnctnnggctcggtacggtcccagagaaccttgaaagattcaaggagtctgaactcattcactgtagatgggccatgcttgccgttccaggaatcctngtaccagaggcattggggttggggaactgggtgaaggctcaggagtgggctgccgttccnggaggtcaagccacctacttgggctacccagtgccatggggcactctccctaccatcttggtcattgaattcctcgccattncctttgtggagcaccaacgcagcatggagaaagatccggagaagaagaagtatcctggcggtgcttttgatcccttgggctactctaaggaccccgaaaagttcaaggaatacaaagtcaaggagataaaaaacggccggcttgctctgttggcttttgtgggattctgcgttcaacaatcngcttaccctggcacaggaccattggagaacctngccacccacttggctgatccatggcacaacaacattggggatatccttattcccagatcagtttccccctgaagcatggaaattttaatcatacttctcactgtaaaagtccntgtaacatgagcctgtattaatgaatctnnatccatctcctatctttggtctgtgtatttaagtttagaagtataaattgagttgccactac

SEQ ID NO: 1227 - DNA, 939 bp, Juglans hindsii x Juglans regia
  misc_feature (126)..(126): n is a, c, g, or t
  misc_feature (165)..(165): n is a, c, g, or t
  misc_feature (175)..(175): n is a, c, g, or t
  misc_feature (240)..(240): n is a, c, g, or t
  misc_feature (252)..(252): n is a, c, g, or t
  misc_feature (879)..(879): n is a, c, g, or t
tggttctcaactctgtgacagagactcagagagatcgagcatggcttccacacattgatgagctatggcatagccaccagtacggcattcccatcagtcctctcttcctcaaagtccaaattcgcngccgctctcccacttcctagtgttggtgccaatgcgtcntcccgctttnccatgtccgccgagtggatgccgggccagcctcgacctccacacctcgatggctctgcacccggngacttcggattngatccactggggcttggtgcagtcccagagaaccttgaaagattcaaggaatctgaacttattcactgcagatgggctatgcttgccgttcctggaatcctagtaccagaggccttggggttgggcaactgggtgcaagctcaagagtgggctgctgttccaggaggtcaagccacctacttgggaaacccagtaccatggggtacactccctaccatcttggtcattgaattcctcgccatcgcctttgtagagcaccaacgcagcatggagaaagaccccgagaaaaagaagtaccctggcggtgcttttgatcccttgggctactccaaggaccccgagaagctcaaggaatacaaggtcaaagagataaaaaatggccggcttgcactgttggcttttgtgggtttctgtgttcaacaatcagcttacccaggcacgggaccactggagaacttggctactcacttggctgacccatggcacaacaacattggggatatcatcatccccagatccctctatccttgaatcatgcaagtatgatcatacttccaatctaagaaatcgtgatgtaagactaaagaggctaactcatgttgattatgaatctggatttcgtatctntggtctatatgtgtaaatcaattttaagaagggattatctgctgcctgcatgacttccac

SEQ ID NO: 1228 - DNA, 1002 bp, Carica papaya
aacctcacccgctccattcctctatccaaacccagattcctcttgggaaaaattcaaacactcatggcttccaactcgttgacgagctgcggcgtggccgccgccgccttccccgctctcctctcctcctccaaatcgaagtttactgccgcagttccgctccccagcgccaccagcaatggcggccacggccgtgtagtcatgtcagctgactggatgcctggccagccccggccgccttaccttgacggctcagctcctggcgactttgggtttgacccgcttcggctcggtgcggttccagagaacctggagagatacaaggaatctgagctcattcattgcagatgggctatgcttgctgttccagggatcctggtacctgaggccttgggtttgggtaactgggtaaaggctcaagagtgggctgcaacccctggtggtcaagccacttacctgggcaacccagttccatggggcaccctccctaccattttggtcattgagttcctgagcattgcctttgtggagcaccagaggagcatggagaaggaccctgagaagaagaagtaccctggtggtgcttttgaccctctgggttactctaaggaccccaaaaagtttgaggagtacaaagtcaaggagatcaaaaatggtcggcttgcattgctggcattcgtgggattctgtgtgcaacaaacagcatatccaggcacaggaccgttggagaacttggcaactcacttggctgatccatggcacaacaatattggggacatcgtcatccccagatcaattttgccttgaatgattgattggattgggactcttaatcagtgtcaaattacccactgtgtaaaacttctcatgtgaaaatctgtaaggaatcaccaacccatgtatccactcatgtgttccatgtaattaaagaacctagaactgatgaatttgctgctgtgactctctccactagttgaaagttaaaatgttgtagaagatagc

SEQ ID NO: 1229 - DNA, 904 bp, Eschscholzia californica
ccaccactcctcttcttcattcaccaccaccacccaaccaccattaccctccccttttctccccctccttggcaaatcagacttcttttcaaagatggcatcaaacactttgaggagttgcggaatagcaacagtttttccatctgttctttcttcatctaaatcgaaattcgccgcctccatctcgttccctagtgtctactccaatggctcgtctcggctaaccatgtcagcggagtggatgcctggcgagcctcgtccaccttacctcgacggttcagcacctggtgactttggttttgatcctcttagactaggagaagtccctgaaaacctcgaaaggtttaaggaatctgaactcattcactgcagatgggcaatgcttgctgttccagggatcttggttccagaggcattaggtttgggcaattgggtgaaggctcaagaatgggctgcactaccagatgggcaagcaacctacttgggcaacccagtcccatggggcacacttccaactatcttggtcattgaattcctctcaattgccttcgtcgaacaccaacgaagcatggagaaagatcctgaaaagaaaaagtatccaggcggagccttcgacccattgggctattcgaaggatccagtcaagttcaaggaatacaagatcaaagaaatcaaaaatggtcgcctcgccttgttagccttcgtgggcttctgtgttcaacaatcggcttacccgggaacaggcccgttggagaatttggctacccatttggctgatccatggcacaacaacatcgggaacatcgtgatcccttgaggactttaaatcttgaaattttaccccaaactcactgtaaaactccatgtaatcatttattatgagtctaaattgcatatcttgttt

SEQ ID NO: 1230 - DNA, 818 bp, Mimulus guttatus
ggccgccgtcgtccgcccgtcggtcctctcatcttcgaagtcgagattcgccgcctcaattccgatggccacgagcggcgccaccacctctcggtacacaatgtccgccgagtggatgcccggggagcctcgcccaccctacctcgatggatctgcacctggagactttggatttgatccacttggtctgggtgaagtgccagcaaatctagaaaggtacaaggagtctgagctcattcactgcagatgggctatgcttgctgtgcctggaatcctagtcccggaggcgttggggttgggcaactgggtaaaggcacaagaatgggcggcactaccgggcgggcaagcgacttatttgggcaacccggttccgtggggaaccctacccaccattttggctattgaattcttggcaattgcatttgtggagcaccaaaggagcatggaaaaggacccggaaaagaagaagtacccgggtggggctttcgacccgttgggttactccaaggacccgaagaagcttcaagagctcaaagtcaaggaaattaaaaatggtcgtctagcattgttggcatttgttggattctgtattcagcaaacggcatacccgggtaccggcccgttggagaacttggcaacccatttggccgacccatggcacaacaacattggagatgtacttattcctaaataaattactaaattaaatatgtgtttttttgtctccaaattaaattcaacccattattgtaaagctccttgtaacattaattattattattattgtttatgtgtgtattggacacggtatatttgtg

SEQ ID NO: 1231 - DNA, 784 bp, Rosa hybrid cultivar
  misc_feature (290)..(290): n is a, c, g, or t
  misc_feature (432)..(432): n is a, c, g, or t
  misc_feature (530)..(530): n is a, c, g, or t
  misc_feature (620)..(620): n is a, c, g, or t
gacctccatattcaataaccagtctaagtctctttggccacaacagaaatcttgcagaccaggagttgaatcaattaaaatggcttctaacactttgatgagctgtggcattgccaccacagccttcccttcagtcctatcttcctccaagtctaaattcgccactgcagtccagctccctagtgttggtgtcaatgcctcctccaggttctccatgtcagccgactggatgcccggccagccccggcctccttatcttgatggatccgctccaggtgactttggattcnacccgcttagactaggagaagtaccagagaacttagagaggttcaaggaatctgaactcattcactgcagatgggctatgcttgctgttccaggaattctagtaccagaagcattggggttggggaactgggtatttgcacnagaatgggcagcaattccaggaggccaagccacttacctaggcaatccagttccatgggggactttgcctacaatattggtcatcgagttcctctccnttgctttcgtagagcaccaacgcagcatggaaaaggacccggagaagaagaagtaccccggtggagcttttgaccccttgggttactccnaggaccctaagaagttcgaggaatacaaagtcaaagagatcaaaaatggtcggctcgcattgttggctttcgtgggattcgtagttcaacaatcggcgtaccctggcaccggaccattggagaatttggctactcacttggctgacccatggcacaaacacatt

SEQ ID NO: 1232 - DNA, 986 bp, Medicago truncatula
atgttatgtttcatttcattcacataataacattattccaaaactagtagacacttaacacttgtttgtgtgacaagaatggcttgtaacacattgatgagttctgctatctcagcatttccatcacttctttcttcctcaaaatcaagattttcaacttcacttccacttccttgtactgcttctacaaatgcttcttctagattcaccatgacttctgattggatgcctggccagcctagaccatcttaccttgatggttcagctccaggtgactttgggtttgatcctctacgtcttggtgaagtacctgagaatcttgagagattcaaagagtctgaactcattcactgcagatgggccatgcttgctgttccagggattttggtaccagaggcattgggattaggcaactgggtgaaagcacaagaatgggctgcacttcctggaggacaagcaacctacctaggcaaccctgttccatggggcaccctacccaccattttggtcattgagttcctttctattgcttttgttgagcaccaaaggagtatggagaaagaccctgaaaagaagaaataccctggtggtgcttttgatcctttgggatactctaaagaccctaaaaagttccatgaatacaaaatcaaagaagttaagaatggacgtcttgctttgttggcatttgttggaatcgttgttcaacaaacagcatatccaggaactggacctttggagaatttggctactcacttggctgatccatggcacaacaacattggaaatgtccttattccaccacaatagatatctccctcaaatcaatctttgttatattagcagctacttgtaaaactccaccaaatacattattttgtcatgaatcagatctctctatggtgttgttttcctgtctttgtaattaaattttcaaatattaagatacctcttggcatcaaaggagttaagatatatctatggttatt

SEQ ID NO: 1233 - DNA, 729 bp, Brassica napus
  misc_feature (588)..(588): n is a, c, g, or t
ttctttgtagtaaacagaaaagcagagagacatcagaagaaacaatggcgtctaactcgctcatgagctgcggcatcgccgccgtctacccttcccttctttcttcttcaaagtctaaattcgtctcctccggagttgctctccccaacgttgggaacgttggccgcgtcagaatggctgctcactggatgcccggcgagccacgtccagcttacctcgatggttctgctccaggtgattttgggtttgacccgcttggacttggagaggttccagagaaccttgagagatacaaagaatcagagctcatccattgcagatgggcaatgctcgctgttccagggattttggtaccagaggctttggggtacggaaactgggtcaaagctcaagaatgggcagcagtgcctggaggacaagccacttacttggggaacccggtcccatggggtactttgcccacaatcttggctatagagttcttagctattgcctttgttgagcaccagaggagcatggagaaagaccctgagaaaaagaagtaccctggaggcgcatttgaccctcttggatactccaaggacccgnagaagtttgaagagctgaaagtcaaggagatcaagaacgggcgtcttgcgttgttggcgtttgtaggattctgtgtgcagcaatcggcctacccaggcacaggaccattggagaacctggctactcacttggcggatccat

SEQ ID NO: 1234 - DNA, 740 bp, Acacia harpophylla
attctcaggtctcaactctcactcacaccatctctctctctgagaatcaatggcttccagcacattgatgagctatggcattgccactgcctcctctttcccttcccgcctttcttcctctaaatccaaattcgtggccgctatcccactccccggcgtcgcctcgacttctcgcttcaccatgaccgctgactggatgcccggccagccccgacctccttacctcgacggttcagcacccggtgacttcgggttcgaccctcttcgtcttggggaagtgccggagaatcttgagagatacaaagaatctgagctcattcactgcagatgggccatgcttgctgtgccagggatattggtaccagaggcattgggattagggaactgggtggaagcacagagatgggcagcagttccagggggacaagcaacatacctagggaacccagttccatggggcaccctccccaccattttggtcattgagttccttgccattgcctttgtggagcaccaacgcagcatggagaaagaccctgagaagaagaagtaccctggtggagcctttgatcctcttggctactccaaagaccctgtcaagttcgaagaatacaaagtcaaagaaataaaaaatgggcgtttggcgctgttggcatttgtggggatatgtgtgcagcaatcagcatacccaggaacagggccattggagaacttggcaactcacttggctgatccatggc

SEQ ID NO: 1235 - DNA, 1188 bp, Amborella trichopoda
cagaggagggggagcaccacaaatgcagtacccagatatgggcaaagccacgtggttggtgtagagggcagggctcttcacttatccaataggaagccaaagagcagattacagagccaatagaatgcgactttcggatttgcccccacctccacttatactctctcttctttttccattccactgctactgctactgctactgcttcagatctcagcatcagccatcacagttgagttggtagagagagatggcgagtttaggaagatgttgtcaattggcagccatgccatcagtgttatcttccaccaagtcggcattcaccccatctctctccttcccctctctcaattcatcctcctctcgcttcaccatgtctgctgaatggatgcctggccagccccgccctccacatcttgatggctcagcccctggtgattttggctttgacccacttggtctgggtgaggtaccggagaacctggagaggttcaaggagtctgagctcattcactgcagatgggccatgcttgcagtcccagggatcttgattccagaggcactggggctggggaactgggtcaaagcccaggagtgggctgccaccccaggagggcaggccacctaccttgggaaccctgtgccatggggcaccctccccaccatacttgtcatagagttcttgtccatcgcttttgtcgagcaccagaggagcatggagaaggacaccgagaagaagaagtaccccggaggagcttttgacccccttggctactccaaggaccccgtcaagttcgaagaatacaaggtcaaggaggttaagaacggtcgccttgcattgttggcgtttgtgggcttctgcgttcagcaatcggctcgtccaggaacagggccattggagaacctggcgacccacctggctgacccctggcacaacaacattggggatgtgatcatcccaagatcaatcttgccctaatcagagagaaagcggcagagcttttgtagaattattatgtccctgtgaccttggtggtgttatctgtctattcctctagtgtatatcttctctgtaatggactcatttcttaaattgttaaaaaggccttcatcattttgttaattgtttttctggacctggataaactgtctcctacttaaaagagaggtaaacagaggaattacttc

SEQ ID NO: 1236 - DNA, 2000 bp, Solanum phureja
ttatttggaaaataaaaaaaatgttggtctgtatttgagggctggaaagagtagtatataaatcttatacgaagctctctctctcaacacacaacttcactcatttctcgaatcactctctttctctctcttcccgaacttgtaggatttcaactcgaacatactcctcgccggagaacgaaataaacgtcgtcggtgttcaggtaattgaaggttctacctttgatccgttcaattcttttggctcgaagttgtagttggaacaaatcggaaatggcttctcaaccgaagaatgttggaattctcgccatggagatttactttcctcctacttgtcttcagcaggaagtattggaggctcatgatggagcaagcaaaggcaagtatacaattggtcttggacaagattgcatgggcttttgcactgaggttgaagatgtcatatcaatgagtttgacagctgttaattccctactggagaagtattctgttgatccgaagcaaattggtcggctagaggttggaagtgaaactgttattgataagagcaaatccatcaagacattcttaatgcaaatatttgagaaacatggaaatactgacattgaaggagttgactcaactaatgcctgctatgggggaactgctgcgttgttcaactgtgtaaattgggtggagagtgcttcatgggatggacgctatggtcttgtagtatgcacggatagcgcggtctatgcagaggggcctgctcggcctactggaggagctgcagctgttgctatgcttgttgggcctgatgctcctatagtatttgaaagcaagatcagggctagccatatgtcccatgtctatgatttttacaagcccatccttgacagtgaatatccagtggttgatggtaagctttcacaaacttgttatctcatggcacttgatgcttgctacaagagtttatgcaacaaatatgagaaattggaaggcaagcaattttcaatgacggatgcagcctactttgtgttccattcaccatacaacaagctcgtgcagaagagttttagtcgattgctgttcaatgattttctaaggaatgctagctctattgatgagtctgccaaaaaaatcctggccccctttgaatccttaaccggtgatgaaagctaccagagccgtgatcttgagaagacatcccaacaacttgctaaaccgctttatgatgagaaggtgcagcctaccacattgataccaaaacaagttggcaacatgtataccgcatctctttatgctgcttttgcatccctccttcacaataagcacaatacattggctggtcagcgggtaatcatgttttcctatgggagtggattgactgcgactatgttttcgctaaagtttaacgaaggtcaacatccttttagtttgtcaaacattgcaagcgtgatgaatgtcgcagagaagttggaatcgagacatgagttcactcctgaaaaattcatcgaaatattgaaactaatggagcacagatatggtgccaaggactttgtgaccagcaaggattgcagccttctcgcaccaggaacctactacctaacagaggttgattccaagtacagaagattttatgcaaagaaggctcacgagaatgggcaggtcaacggacactaagacaccaaacatggtccgtccttgcacggtgtaaggccatatagtaggctcgtgctgtttaagttattgttagcgcatagaagaataactagtgctctggcagattcgattgttattacatgtagtttcttttccagagtagtagatcctatgccttttttctttctttttttcagttcccgacgagttctaatgttgtgcatctccttgtcttcacctgtttgtgaaatgattgtaaaagtcatcaacctagtctttggttggaattcatttctcatctgtaataaactaatgtatttatgagaaaaatcatttcaatgggtgattgttgaaattta

SEQ ID NO: 1237 - DNA, 1559 bp, Solanum lycopersicum
ttgcccatagaatcagtcacacattttctctctgtcttcttctctgaaacatttttccgattttgaagaacaaatttgttggatccattgcgtttatactcaaaaataacaaataaaaatcatcagaaatggcagctcaacggaagaatgtcggaatcctcgccatggaaatttactttcctcctacttgcattcaacaggaaacgttggaagctcatgatggagcaagcaaagggaaatacacaattggtcttggacaagattgcatgggattttgtactgaggtggaagatgtaatatcaatgagtttgacagctgttacttctcttgtcgagaagtatgcgattgatccaaatcaagttggtagactggaagttggaagtgagactgttattgataaaagcaaatctattaagacgttcctgatgcaaatatttgagaaatgtggtaatactgacattgaaggagttgactcaactaatgcatgctatggtggaactgctgcattattcaactgtgtgaattgggtggagagcgcgtcatgggatggacgctatggacttgttgtatgcacagatagtgcggtctatgctgagggacctgctaggccaacgggaggcgcagctgccatagctatgctaattggccctgatgctcctattgtgtttgaaagcaagatcagggctagtcatatggctcatgtctatgatttttacaagcccatcctagacagcgaatatccagtggttgatggcaagctttcacaaacttgttatcttgtggcacttgattcttgctataagatattatgcaacaaatacgagaaattggaaggcaaacaattttcgatagctgatgcagcttactttgtgttccattcaccgtacaacaagcttgtacagaagagcttcgctcggttggtattcaatgactttacgaggaatgctagctccatcgatgaatctgctaaagaaaagctggccccattttcgtctctaagtcatgatgaaagctaccaaagccgtgatcttgagaaggcatcccagcaagttgcaaagccattttacgatgagaaggtgcaacctaccacattaataccaaaacaagttggcaacatgtatactgcctctctatatgctgcttttgcatcactccttcacaataaacacaaaacactggctggacaacgggtagttctgttctcctatggtagtggatcaactgcgacaatgttctccctcaagcttaatgaaggccaacatccttttagcttgtcaaacattgcaagtgtgatgaatgttaaagagaaattggaatcaagaaatgagttgactcctgaaaagtttgtcgaaattatgaaactaatggagcataggtacggggccaaggacttcgttacgagcaaggattgtagccttctagctccaggtacctactaccttacagaggttgattcaaagtatagaagattttatgccaagaaagctgctgagaatggactggccaatggtcattgaagataagtcctagctagcaacaagcttgtgttttttttttta

SEQ ID NO: 1238 - DNA, 1823 bp, Capsicum annuum
gcacgaggattcatctcattttcgtctcccatatttcctctctttttctatctttctgaaacatttttcctattttgaaggagaaattgtttggatcaattgagtttaattacttagagtaaagagaagaaaaagaaataatttagaaaatggcaggtcaacaaaagaatgtgggaatcctggctatggaaatttactttcctcctacttgcattcagcaggaaacgttggaagctcatgatggagcaagcaaagggaaatacacaattggtcttggacaagattgcatgggattttgcacagaggtggaagatgttatatcaatgagtttgacggctgttacttcccttctagagaagtatgctattgatccaaagcaagttggtagactggaagtcggaagtgagactgttattgataaaagcaaatccatcaagacgttcctgatgcaaatatttgagaaatgtgggaatactgacattgaaggagttgactcaactaatgcctgctatggtggaactgctgcattgttcaactgtgtgaattgggtggagagctcttcatgggatggacgctatggacttgttgtatgcacagatagtgcggtctatgctgagggacctgctaggccaactggaggagcagctgccattgctatgctaattggacctgatgcccctattgtctttgaaagcaagatcagggctagtcatatggctcatgtctatgatttttacaagcccatcttagacagtgaatatccagtagttgatggcaagctttcacaaacttgttatctcatggcccttgattcttgctacaagatcttatgcaacaaatacgagaaattggaaggcaaacagttttcgattgctgatgcagcttactttgtgttccattcaccatacaacaagcttgtacagaagagcttcgctcggttggcattcaatgactttatgaggaatgctagctccatcgatgaatatgctaaagctacgctggccccattttcgtctctaagtggtgatgaaagctaccaaagccgtgatcttgagaaggcatcccaactagttgctaaaccattttatgatgagaaggtgcaacctaccacattaattccaaaacaagttggcaacatgtacactgcttctctgtatgccgcttttgcatctctccttcacaataagcacagtgcattggctggaaagcgggtaattttgttttcctacggcagtggatcaactgctacaatgttctccgtcaggcttaatgaaggtcaacatccttttagcttgtcaaacattgccagtgtgatgaatgttgccgagaaattgaagtcaagaaacgagttcactcctgaaaaattcgtcgaaattatgaaactaatggagcacaggtatggggcgaaggacttcgtcacgagcaaggattgtagtcttctagctctaggaacctactatctcacagaggttgattccaagtacagaagattttatgccaagaaagctgctgagaatggattggccaatggtcattgaagatagtcctagaaagcagctaggtgtaatgccaagaatatggcttgtgttgatttagttgtttaacacaggaaataacgtcttaataagctctgtctatttaaatagtctgttcctgattagcttctctgcctttctttttgagtttctatgttgtttttaattaaagtttaagaatttgatgtttattgtattccctttagggataatttatagatgattgacaaatcaacaatgtaatcttgactgaaattcattgagcaaatttcacggcctctgtattca

SEQ ID NO: 1239 - DNA, 1893 bp, Solanum phureja
ttgcccatagaatcagtcacacatttctctctgtcttcttctctgaaacatttttcctattttgaaggaaaaattgtttggatccattgcgtttatactcaaaaataaaaaataaaaaatcatcagaaatggcagctcaacagaagaatgtcggaatcctcgccatggaaatttactttcctcctacttgcattcaacaggaaacgatggaagctcatgatggagcaagcaaagggaaatacacaattggtcttggacaagattgcatgggattttgtactgaggtggaagatgttatatcaatgagtttgacagctgtttcttcccttctcgaaaagtatgcgattgatccaaagaaagttggtagactggaagttggaagtgagactgttattgataaaagcaaatccatcaagacgttcctgatgcaaatatttgagaaatgcgggaatactgacattgaaggagttgactcaactaatgcatgctatggtggaactgctgcattgttcaactgcgtgaattgggtggagagcgcgtcatgggatggacgctatggacttgttgtatgcacagatagtgcggtctatgctgagggacctgctaggccaacgggaggcgcagctgccattgctatgctaattggccctgatgcccctattgtgtttgaaagcaagatcagggctagtcatatggctcatgtctatgatttttacaagcccatcctagacagcgaatatccagtcgttgatggcaagctttcacaaacttgttatcttgtggcacttgattcttgctacaagatcttatgcaacaaatacgagaaattggaaggcaatcagttttcgatagctgatgcagcttactttgtgttccattcaccgtacaacaagcttgtacagaagagctttgctcggttggtattcaatgactttacgaggaatgctagctccatcgatgaatctgctaaagaaaagctgtccccattttcgtctctaagtcatgatgaaagctaccaaagccgtgatcttgagaaggtatcccagcaagttgcaaaaccgttttacgatgagaaggtgcaacctaccacattaataccaaaacaagttggcaatatgtatactgcctctctatatgctgcttttgcatcactccttcacaataaacacaacacactggctggacaacgggtagttctgttctcctacggtagtggatcaaccgcaacaatgttctccctcaagcttaatgaaggccaacatccttttagcttgtcaaacattgcaagtgtgatgaatgttaaagagaaattgaaatcaagaaacgagttgactcctgaaaaattcgtcgaaattatgaaactaatggagcataggtacggtgccaaggacttcgttacgagcaaggattgtagccttctagctccaggaacctactaccttacagaggttgattccaagtatagaagattttatgccaagaaaggtgctgagaatggactggccaatggtcattgaagataagtccaagctagcaacaagccgtaatgccaacaatttggcttgtgttgttttagttttcaagttgtgctatttaaacttagtgagttttcagtttctctgtatttcttttttcaattaaagttttaagaattcagtgtttatggctgcgaagatggaatctgggacgtaggacttgtagtatctctccagatctggcaaaaacgtttgttttctctttggagataatttatagatgattgacaaccatcaatgtaatcttgatttaaattacgcattcgtggaatttggaacttcaaattgatgagcatgtaagatgattcggatatcaattttatgaaaaaagtcaagtaagagcatataagaattttat

SEQ ID NO: 1240 - DNA, 1914 bp, Solanum tuberosum
gtagcagtctccactctccggttagtataaatatgtgaaagccttacaagcacaaatcatcactcgccttcctctctattctgcaaaacgaaaaagtgtgtgttcgccggcgctcaattcgaggagatttagagtgagagaaaacggtgtgttcaccggcggttattccgatctgctcagtttaacatcgactcggagaagaaagagtacgcgtgtgtgtgtgtgttcgccggcggttatttcgatttgttcagtttaatactgtttgataatagtcgaagagaagaaatcggaaatcagaaaatggcagctcagccgaagaatgtcggaattctcgccgtcgagatttactttcctcctacttgcctacagcaggaagcattggaggctcatgatggagcaagcaaagggaaatacacaattggtcttggacaagattgtatgggcttttgcaccgaggtggaagatgttatatcaatgagtttgacagcagttacttcccttttggagaagtatgctattgatccaaagcaaattggtcgtctagaggttggaagtgaaaccgtaattgataagagcaaatccatcaagacattcctgatgcaaatatttgagacatgtggaaatactgacattgaaggagtcgactcaactaatgcatgctatgggggaactgccgcattgttcaactgtgtgaattgggtcgagagctcttcatgggatggtcgctatggactcgttgtatgcactgatagtgcggtctatgctgagggagctgctcggcctactggaggtgctgcagcaattgctatgctagtcgggccagatgctcctattgtgtttgaaagcaagattagggctagccatatggcccatgtctatgatttttacaagcccatcctcgacagtgaatatccagtggttgatggcaagctttcacaaacttgttatcttatggcacttgattcttgctacaagagcttatgcaacaaatacgaaaaattggagggcaagcagttttcgattgatgatgcagcctattttgttttccattcaccatacaacaagcttgtacagaagagcactgctcggttgatgttcaatgactttacaaggaacgctagttccattgatgagtctactaaagaaaagctggcaccattttcatccctaactggtgatgagagttatcaaagccgtgatcttgagaagacatcctggcaagtggcaaaaccattttatgacgagaaggtaaaaccgaccacattagtaccaaaacaagttggcaacatgtacaccgcgtctctctatgctgcttttgcatccctccttcacaacaagcacagctcattggctggacagcgggtagtcttgttctcttacgggagtgggttgactgcaacaatgttctcattaaaacttcacgaaggtcaacatccttttaacttgtcaaacattgcagttgtgatgaacgttgaagagaaattgaagtcgaggcatgagttcactcctgaaaatttcatcgaaacgatgaaaataatggagcacaggtatgggggtaaggactttgtgacgagcaaagattgcagccttctagctccaggtacttactacctcacagaagtcgattcgaagtacagaagattctatgccaagaaatgtactgagaatggacttgccaatggtcattgaagataagtcctagtatgatgtaacttccatgaaattggcttgtactcttttaattattgtcagcacatagaagaataataattacttcataataacatatagtactagtttgtttctactttccaacaaattcaatattgtttcttgtattctcatctgtttgagagatgatttaaaaaatcatcaatgtaatgtagtcttatatatgaattgagaaaaact

SEQ ID NO: 1241 - DNA, 1913 bp, Solanum tuberosum
gtagcagtctccactctccggttagtataaatatgtgaaagccttacaagcaccaaatcatcactcgccttcctctctattctgcaaaacgaaaaagtgtgtgttcgccggcgctcaattcgaggagatttagagtgagagaaaacggtgtgttcaccggcggttattccgatctgctcagtttaacatcgactcggagaagaaagagtacgcgtgtgtgtgtgttcgccggcggttatttcgatttgttcagtttaatactgtttgataatagtcgaagagaagaaatcggaaatcagaaaatggcagctcagccgaagaatgtcggaattctcgccgtcgagatttactttcctcctacttgcctacagcaggaagcattggaggctcatgatggagcaagcaaagggaaatacacaattggtcttggacaagattgtatgggcttttgcaccgaggtggaagatgttatatcaatgagtttgacagcagttacttcccttttggagaagtatgctattgatccaaagcaaattggtcgtctagaggttggaagtgaaaccgtaattgataagagcaaatccatcaagacattcctgatgcaaatatttgagacatgtggaaatactgacattgaaggagtcgactcaactaatgcatgctatgggggaactgccgcattgttcaactgtgtgaattgggtcgagagctcttcatgggatggtcgctatggactcgttgtatgcactgatagtgcggtctatgctgagggagctgctcggcctactggaggtgctgcagcaattgctatgctagtcgggccagatgctcctattgtgtttgaaagcaagattagggctagccatatggcccatgtctatgatttttacaagcccatcctcgacagtgaatatccagtggttgatggcaagctttcacaaacttgttatcttatggcacttgattcttgctacaagagcttatgcaacaaatacgaaaaattggagggcaagcagttttcgattgatgatgcagcctattttgttttccattcaccatacaacaagcttgtacagaagagcactgctcggttgatgttcaatgactttacaaggaacgctagttccattgatgagtctactaaagaaaagctggcaccattttcatccctaactggtgatgagagttatcaaagccgtgatcttgagaagacatcctggcaagtggcaaaaccattttatgacgagaaggtaaaaccgaccacattagtaccaaaacaagttggcaacatgtacaccgcgtctctctatgctgcttttgcatccctccttcacaacaagcacagctcattggctggacagcgggtagtcttgttctcttacgggagtgggttgactgcaacaatgttctcattaaaacttcacgaaggtcaacatccttttaacttgtcaaacattgcagttgtgatgaacgttgaagagaaattgaagtcgaggcatgagttcactcctgaaaatttcatcgaaacgatgaaaataatggagcacaggtatgggggtaaggactttgtgacgagcaaagattgcagccttctagctccaggtacttactacctcacagaagtcgattcgaagtacagaagattctatgccaagaaatgtactgagaatggacttgccaatggtcattgaagataagtcctagtatgatgtaacttccatgaaattggcttgtactcttttaattattgtcagcacatagaagaataataattacttcataataacatatagtactagtttgtttctactttccaacaaattcaatattgtttcttgtattctcatctgtttgagagatgatttaaaaaatcatcaatgtaatgtagtcttatatatgaattgagaaaaact

SEQ ID NO: 1242 - DNA, 1795 bp, Solanum lycopersicum
ggcggaatatcaaaatggaaaatttcttaacagtctccactctccagttttgtataaatatgtgaaagcctgctaagcataaaccatcactcgcctttctctctcttctgcaaaacgaaaaaaaaaaagtgtgtgttcgccggcgcttaattcgaggagatttagagcgagagaaaacgttgtgttcgccggcgtttattccgatctgttcagtttaacagaagaagaaaaaatcggaaatcggagaatggcagctcaaccgaagaatgtcggaattctcgccgtcgagatttactttcctcctacttgcctacagcaggaagcattggaggctcatgatggagcaagcaaagggaaatacacaattggtcttggacaagattgtatgggcttttgcactgaggtggaagatgttatatcaatgagtttgacagcagttacttcccttttggagaagtatgctattgatccaaagcaaattggtcgtctagaggttggaagtgaaaccgtaattgataagagcaaatccatcaagacattcctgatgcaaatatttgagaaatctggaaatactgacattgaaggagtcgactcaactaatgcatgctatgggggaactgccgcattgttcaactgtgtgaattgggtcgaaagctcttcatgggatggtcgctacggactcgttgtgtgcactgatagtgcggtctatgctgagggagctgctcggcctactggaggtgcagcagcaattgctatgctagtcgggccagatgctcctattgtgttcgaaagcaagattagggctagccatatggcccatgtctatgatttttacaagcccatactcgacagtgaatatccagtggttgatggcaaactttcacaaacttgttatcttatggcacttgactcttgctacaagagcttatgcaacaaatacgaaaaattggagggcaagcagttttcaattgatgatgcagcctattttgttttccattcaccatacaacaagcttgtacagaagagcactgctcggttgatgttcaatgactttacaaggaacgctagttccattgatgagtctactaaagaaaagttggcaccattttcatccctaactggtgatgagagttatcaaagccgtgatcttgagaagacatcctggcaagtagcaaaaccattttatgacgagaaggtaaaaccggccacattaataccaaaacaagttggcaacatgtacaccgcgtctctctatgctgcttttgcatccctccttcacaataagcacagctcattggctggacagagggtagtattgttctcttacgggagtggattgactgcaacaatgttctcattaaagcttcacgaaggtcaacatccttttaacttgtcaaacatcgcaactgtgatgaacattgaagagaaactgaagtcgaggcatgagttcactcctgaaaatttcatcgaaactatgaagataatggagcacaggtacgggggtaaggactttgtgacgagcaaggattgcagccttctagctcctggtacgtactatctaacagaagtcgattcgaagtacagaagattctatgcaaagaaatgtgctgagaatggacttgccaatggtcattgaatataagtcctagtatgatataacttccatgaattttgcttgtactcttttaattatataattgcttcataataacatatagtttctttctacttcccaacaaattcaatatttgtttcttgtattctcatcaatgtgtagccttatatatgaattgag

SEQ ID NO: 1243 - DNA, 1939 bp, Solanum phureja
gcggaatatcaaaatggaaaatttcttagcagtctccactctccggttagtataaatatgtgaaagccttataagcacaaatcatcactcgcctttctctctcttctgcaaaacaaaaaagtgtgtgttcgccggcgctcaattcgaggagatttagagtgagagaaaacggtgtgttcaccggcggttattccgatctgctcagtttaacatcgactcggagaagaaagagtacgtgtgtgtgtgtgtgttcgccggcggttatttcgatttgttcagtttaatactgtttgataatagtcgaagagaagaaatcggaaatcagaaaatggcagctcagccgaagaatgtcggaattctcgccgtcgagatttactttcctcctacttgcctacagcaggaagcattggaggctcatgatggagcaagcaaagggaaatacacaattggtcttggacaagattgtatgggcttttgcaccgaggtggaagatgttatatcaatgagtttgacagcagttacttcccttttggagaagtatgctattgatccaaagcaaattggtcgtctagaggttggaagtgaaaccgtaattgataagagcaaatccatcaagacattcctgatgcaaatatttgagacatgtggaaatactgacattgaaggagtcgactcaactaatgcatgctatgggggaactgccgcattgttcaactgtgtgaattgggtcgagagctcttcatgggatggtcgctatggactcgttgtatgcactgatagtgcggtctatgctgagggagctgctcggcctactggaggtgctgcagcaattgctatgctagtcgggccagatgctcctattgtgttcgaaagcaagattagggctagccatatggcccatgtctatgatttttacaagcccatcctcgacagtgaatatccagtggttgatggcaagctttcacaaacttgttatcttatggcacttgattcttgctacaagagcttatgtaacaaatacgaaaaattggacggcaagcagttttcgattgatgatgcagcctattttgttttccattcaccatacaacaagcttgtacagaagagcactgctcggttgatgttcaatgactttacaaggaacgctagttccattgatgagtctactaaagaaaagctggcaccattttcatccctaactggtgatgagagttatcaaagccgtgatcttgagaagacatcctggcaagtggcaaaaccattttatgacaagaaggtaaaaccgaccacattagtaccaaaacaagttggcaacatgtacaccgcgtctctctatgctgcttttgcatccctccttcacaacaagcacagctcattggctggacagcgagtagtcttgttctcttacgggagtgggttgactgcaacaatgttctcattaaaacttcacgaaggtcaacatccttttaacttgtcaaacattgcagttgtgatgaacgttgaagagaaattgaagtcgaggcatgagttcactcctgaaaatttcatcgaaacgatgaaaataatggagcacaggtatgggggtaaggactttgtgacgagcaaagattgcagccttctagctccaggtacttactacctcacagaagtcgattcgaagtacagaagattctatgccaagaaatgtactgagaatggacttgccaatggtcattgaagataagtcctagtatgatgtaacttccatgaaattggcttgtactcttttaattattgtcagcacatagaagaataataattacttcataataacatatagtactagtttgtttctactttccaacaaattcaatattgtttcttgtattctcatctgtttgagagatgatttaaaaaatcatcaatgtaatgtagtcttatatatgaattgagaaaaact

SEQ ID NO: 1244 - DNA, 1826 bp, Triphysaria pusilla
agcttacccagcaacaattaatcgagccacccatttcccctcacttttcttgctgcacaccactttgagatttcatttcagaaaacttctcattaaatcttttacttaaccgatctgtttttcttccttgaaaatcaaaacagagatggccaagaatgttggaatactcgccatggagatttacttcccccccacttgcatccagcaggaagtgttggaggctcatgatggagcaagcaaagggaagtacacaattgggcttggccaagattgcatggctttttgtgacgaggtcgaagatgtcatttcgatgagtatgacagctgtcacatcactcctagaaaagtacggtgttgatccgaagcagattgggcgccttgaagttggtagtgagaccgtactcgataaaagcaaatccattaagacgttcttgatgccaatctttgagaaatgcggaaataccgacatagaaggtgtcgactcaacgaatgcatgctatggtggtacggctgctctctttaactgtgtcaattgggtggaaagcagttcatgggatggacgatatgggctcgttgtctgcacagacagtgcggtctatgcagagggaccagctaggccaactggaggagctgcagccgttgccatgctgataggacctaatgctcctatctctttcgaaagcaagctaagggcgagccatatgtctcatgtttatgatttttacaaacctgacctcgccagtgaatatccagttgttgatggcaagctttctcagacttgttacctcatggcgctcgattcttgttacaaaagcttgtgtgacaagtacaagaagcaggagggcaagcagttttcagtttctgatgctgagtactttgtatttcattctccatataacaagctagtacagaagagctttgctagattgttatacaatgattttttgagtagtgccagttccattgatgaggctgctaaagagaagatggcacctttttcatcgttaaccattgacgaaagttaccaaagtcgcgatctcgagaaggtgtctcaacaagttgcaaagccgttttacgacgctaaggtgcagccgtctacacttatcccgaaacaagtggggaacatgtacactgcatctctctatgctgcgtttgcatccctccttcacaacaaaaatagcactctggctgggcaaagggtgatattgttttcctacggcagtggtttatcagccaccatattttctctccgttttaatgaggggcagcatccttttagtctgtctaacattgcatccgtcatgaatgtttcagagaagttaaaatcgaggcatgagtttgcaccagaaaaattcgtcgagatcatgaagctaatggagcacagatatggtaacaaggactttgtgacgagcaaggattgcagtcttcttgcatcaggcacattctatctcactgaagtggattctaagtaccgaagattctatgccaggaaagctgctgagaatggtgtcactcccaacagcaactgatcacaacccgacccgaccagaatatggatgccatgaagttatcatgctcttagttgtttggcgcgtattaaaataattgtatttcgttgtttaatacaagcgtcgagtttgtttggccttctatatttgtagttttttttctttcagttttccttgtctttggaaagagtattgtagatgaccaataatataccatgagtgtgttatacacatcaatgaagtgattagaggaacttgccctagtggctcctacatacttaaaccggagcagatcgtgtatactactccctccgttcct

SEQ ID NO: 1245 - DNA, 1795 bp, Gossypium hirsutum
tagctgatatcgaattcggcacgaggcgaatttcggggatcaaatactctttcacaaaaaggagagaatataagtaattaattaacacaactttttttcgttgttgttgaaaaagctcatcttttttttgatagttagagtgagcaatggctaagaatgtgggaattcttgctatggaaatctacttccctcctacctgtgttcaacaggaagcattggaggctcatgatggtgctagtaaggggaaatacaccattggacttggacaagattgcatggccttttgtacagaagtggaagatgttatctctatgagtttaacagctgttacttcactccttgcaaaatataagattgaccccaaacaaatcggccgtcttgaagttggtagtgagactgtgatcgacaagagcaagtccattaagaccttcttgatgcaaatctttgagaaatctggaaacactgacatcgaaggggttgactcaactaatgcatgctatggagggactgcagctctatttaactgtgtcaattgggttgaaagtagttcatgggatggacgatatggtcttgttgtttgtactgacagtgcggtctatgcagaaggacctgcccggccgactggaggagcagcggcaattgccatgctaatagggcctgatgctcctattgcttttgaaagcaaattacgtggaagtcatatgtcccatgcctatgacttttacaagcctaaccttgctagtgaatatccggttgtcgatgggaaactttctcaaacatgctatctcatggctctcgatacttgctacaaatatttctgtcacaagtacgagaaactagagggcaaacagttttctctttctgatgctgcgtacttcgtattccattctccttataacaagctcgtgcagaaaagtttttctcgtttgttgttcaatgacttcttgaggaatgccagttctgtcgatgaaattaccaaggaaaaactggctccattttcaactttgaccggtgacgaaagctaccaaagccgggatcttgagaaggcatcccaacaagcttcaaagtccctttacgatgccaaggtgcaaccaactaccttgataccaaagcaagttggcaacatgtatactgcatctctttatgctgcctttgcatcccttattcacatcaaacacagtgaattggcaggaaagcgggtgattttattctcttacggaagtggtttaactgccacaatgttttcattgcgattccatgaaggtcaacatccctttagcctatcgaacattgcatcggtgatgaatgtaggtgggaaattgaagtcaaggcacgagtttccccctgagaagtttgttgagactatgaagctcatggagcataggtatggagccaaggatttcgtgacaagcaaagactgtagccttttgtctcccggaacatactacctcaccgaagttgattccatgtaccggagattctatgcaaagaaagacggggactttgctgcttgcgataacggttccattgccaacggtcattagtgaacagatttatcatgcccccaatgcaatgaagaaagcatttgtgttagatgtgtttgtgagtaccaaaatactgggttccatgtgtatgttaaaaagcaaaaatagtttgattcagcatcaatttcagcattaattttctttttcattttatcttgtaataagttatttttctagagccagatatgttaaaacccaaagctagttggcaatctctttgatgataatataagatatttttatttcaaaaa

SEQ ID NO: 1246 - DNA, 1749 bp, Gossypium hirsutum
caaatactctttcacaaaaaggagagaatataagtaattaattaacacaactttttttcgttgttgttgaaaaagctcatcttttttttgatagttagagtgagcaatggctaagaatgtgggaattcttgctatggaaatctacttccctcctacctgtgttcaacaggaagcattggaggctcatgatggtgctagtaaggggaaatacaccattggacttggacaagattgcatggccttttgtacagaagtggaagatgttatctctatgagtttaacagctgttacttcactccttgcaaaatataagattgaccccaaacaaatcggccgtcttgaagttggtagtgagactgtgatcgacaagagcaagtccattaagaccttcttgatgcaaatctttgagaaatctggaaacactgacatcgaaggggttgactcaactaatgcatgctatggagggactgcagctctatttaactgtgtcaattgggttgaaagtagttcatgggatggacgatatggtcttgttgtctgtactgacagtgcggtctatgcagaaggacctgcccggcctactggaggagcagcagcaattgctatgctaatagggcctgatgctcctattgcttttgaaagcaaattacgtggaagtcatatgtcccatgcctacgacttttacaagcctaaccttgctagtgaatatccggttgtcgatgggaaactttctcaaacatgctatctcatggctctcgatacttgctacaaatatttctgtcacaagtatgagaaactagagggcaaacagttttctctttctgatgctgcatacttcgtattccattctccttataacaagctcgtgcagaaaagtttttctcgtttgttgttcaatgacttcttgaggaatgccagttctgtcgatgaaattaccaaggaaaaactggctccattttcaactttgaccggtgacgaaagctaccaaagccgggatcttgagaaggcatcccaacaagcttcaaagtccctttacgatgccaaggtgcaaccaactaccttgataccaaagcaagttggcaacatgtatactgcatctctttatgctgcctttgcatcccttattcacatcaaacacagtgaattggcaggaaagcgggtgattttattctcttacggaagtggtttaactgccacaatgttttcattgcgattccatgaaggtcaacatccctttagcctatcgaacattgcatcggtgatgaatgtaggtgggaaattgaagtcaaggcacgagtttccccctgagaagtttgttgagactatgaagctcatggagcataggtatggagccaaggatttcgtgacaagcaaagactgtagccttttgtctcccggaacatactacctcaccgaagttgattccatgtaccggagattctacgcaaagaaagacggggactttgctgcttgcgataatggttccattgccaacggtcattagtgaacagatttatcatgcccccaatgcaatgaagaaagcatttgtgttagatgtgtttgtgagtaccaaaatactgggttccatgtgtatgttaaaaaagcaaaaatagtttgattcagcatcaatttcagcttaattttcttttcattttatcttgtaataagttatttttctagagccagatatgttaaaacccaaagctagttggcaatctctttgatgataatataagatatttttatttc

SEQ ID NO: 1247 - DNA, 1912 bp, Triphysaria pusilla
aattaagccacccattttgcccaactcactcccaaatataacctcatttcttgctgcacgcatctctgcattagcctattttctctgatttttatacttgcaaaacaaaacaacacaaggcgtccttgtttgagatttcatttcaattatctactttttcttttcgctcaatcgatcgatttcttcattaaaatttgaaagagaaatggccaagaatgtgggaatactcgccatggaaatttactttccccccacttgcattcagcaggaagtgctggaggctcatgatggagcaagcaaaggtaagtacacaattgggcttggccaggattgcatggcattttgtgacgatgtcgaagatgtcatttcgatgagtatgacagctgtcacgtcactcctagaaaagtacgatgttgatccgaagcagattgggcgccttgaagttgggagtgagaccgtactcgataaaagcaaatccattaagacgttcttgatgccaatctttgagaaatgtggaaatactgacatagaaggtgttgactcaacgaatgcatgctatggtggtacggctgctttatttaattgtgtcaattgggtggaaagcagttcatgggatggacgatatgggcttgttgtctgcacagacagtgcggtttacgcagagggaccagctaggccaactggaggagctgcggctgttgccatgctgataggaccgaacgctcctatctctttcgaaggcaagctaagggcgagccatatgtctcacgtttatgatttttacaaacctgaccttgccagtgaatatccagttgttgatggcaagctttctcagacatgttacctcatggcgctcgattcttgttataaaatcttgtgtgacaagtataagaagcaggagggcaagcagttctcagttgatgaggctgcgtactttgtatttcattctccatataacaagctagtacagaagagctttgctagattgttattcaatgattttttgagtagcgccagttccattgatgaggccgctaaagaaaagctggcacctttttcatcgttaaccatggacgaaagctaccaaagtcgcgatctcgagaaggcgtctcaacaagttgcgaagccgtttttcgacactaaggtgcagccatctacacttattccaaaacaagtggggaacatgtacactgcatctctctatgctgcgtttgcgtccctccttcacaacaaaaatagcactctggctgggcaacgggtgatattgttttcctatggcagtggtctatcggccaccatgttctctctccgttttaatgaggggcagcatccgtttagcctgtctaacattgcagctgtcatgaatgtttcggagaagttgaaagcgaggcatgagtttgcaccagaaaaattcgtcgagatcatgaaggtaatggagcacagatatggtaacaaggactttgtgacgagcaaggattacagtcttcttgcaccaggcacgtactatctcactgaagtggattctaagtatcgaagattttatgctaggaaagcttctgagaacggtgttactgccaatggccactgagcccggatggccactgagcccggcccgacccaacccaaccccaatatgaatgccaagaagttgtcttgttcttagttgtttggaaaataattgtatttcattgtttgatacaagcgtctagtgattttgaaagattaaaatggtatccatagtttgttgtcttttttattttttattttagtttttcttctctttggaaagattattgtagatgaccaatatcccatggttgtattctacacattaatgaagtgataagaggaaattgccctttgttgccaactctatatctgagttgttataccaggcaaaaaaaaaaaaaaa

SEQ ID NO: 1248 - DNA, 1849 bp, Theobroma cacao
  misc_feature (559)..(559): n is a, c, g, or t
cggggaccaacgtttctcttgcgagtttcagggatcgaatatttactcttcagaaagagagaaagaagaagagaggaaaaaaagaaaagcttctgttttgtttcgataaaaaagggttgtctttttttgctcttgttgctgctgttgttgttgtagctgatctttgtttgatagttggagcgagaaatggcaaagaatgtgggaatccttgctatggatatctacttccctcctacctgtgttcgacaggaagcattggaggctcatgatggcgcaagcaaaggaaaatacaccattggacttggtcaagattgcatggccttctgtacggaggtggaagatgttatctcaatgagtttgacagttgttacttcactccttgaaaagtataagattgaccctaaacaaattggccgtcttgaagttggcagtgagactgtgatagataagagcaaatccattaagaccttcctgatgcaaatctttgagaaatgtggaaacactgacattgaaggggtcgactcaactaatgcatgctatggagggactgcagctttantcaactgtgtcaattgggtggaaagtagttcatgggatggacgatatggtcttgttgtttgtactgacagtgcggtctatgcagaaggacctgcccggcctactggaggagcggctgcaattgctatgctagtagggcctgatgctcctattgcttttgaaagcaaattaagggggagtcatatgtctcatgtctatgacttttataagcccaaccttgctagtgaatatccggttgttgatgggaaactttctcagacatgctatctcatggctcttgattcttgctataaatatttctgtcacaagtatgagaaactagtgggcaaacaattttccctttctgatgctgagtattttgtattccattctccatataacaagcttgtgcagaaaagcttttctcgtttgttgttcaacgacttcctgaggaatgccagttctgttgatgacattgctaaagaaaagttgggaccattctcaactttgactggtgatgaaagctaccaaagcagggatcttgagaaggcatcccaacaagtttcaaagcccctctatgatgccaaggtccaaccaaccactttgataccaaagcaagttggcaacatgtacaccgcgtctctttatgctgcatttgtatcccttattcacaacaaacatagtgaattggctggaaagcgggtgatattattctcgtatgggagtggtctgacagcaacaatgttttcattgcgactcaatgaaggtcaacatccctttagcctatcgaacattgcaacagtgatgaatgttgctggaaaattgaagtcaaggcatgagtttccacctgagaagtttgttgagactatgaagctcatggagcacaggtatggagccaaggactttgtgacaagcaaggactgtagccttttgtctcccggaacatactacctcacggaagttgattccatgtaccggagattctatgcaaagaaggatggggactttactgcctgtgagaatggttctctttccaatggtcactgaaggaacagatttatcatccctaatgccaggaaggtggctgtcgttttaggtgtgttgccagtgccaagaactgggtcccatgtgtatgtttaaagcaaaatagttcattcagcagcaaatccttttttcgtattttaagcttaatttcttttttctccccttctttgtaataagtttcttccagagccagttacttgtgttaaaaacaaaagtagttggcaatttattgatgattaattatacaatatatttttgtttctgcata

SEQ ID NO: 1249 - DNA, 1904 bp, Mimulus guttatus
caaaaatcaattcttttcttcttcttcctcccctataaattgtcaccattcccccaacggcatttacataacccaaaatcatccattttctctctcttctttctctctcctctctgttttctagcttgcgcacgcacccctgcttttgcgaatttcctggattgagtattaacagggcagcaaattttgggatttttttcaggataattcatttttcgtttttgcgtatctgatctactttttttttttcgagtgaaaaaataaaaattaaaaattcagagatggcaaagaatgtaggaattctcgccatggaagtgtacttcccccccacctgcatccagcaggaagtgttggaggctcatgatggagccagcaaagggaagtacacaatcgggctcggacaagattgcatggcgttttgcgacgaggttgaagatgtcatttccatgagtatgacagctgtcacttcactcctagagaagtatggagtcgacccaaagcagattgggcgtctcgaagttggaagtgagaccgtactcgataaaagcaaatccatcaagacattcttgatgccaatttttgagaaatgtggaaacaccgacatagaaggagtcgactcaaccaacgcgtgctatgggggtacagctgcacttttcaactgcatcaattgggtcgaaagtaattcttgggatggtcgatatgggcttgttgtctgcaccgatagtgcggtttacgccgaggggcccgctaggccaaccggaggagctgcagctattgccatgctagtgggaccggacgctcctattgctttcgaaagcaagcttagggctagccacatgtctcatgtttacgatttttacaagcccgatcttgccagtgaatatcccgttgttgatggcaagctttctcagacttgttacctcatggcactcgattcttgttataaaagcttatgtgacaagtacgagaagatggagggtaagcagttttcgatcaacgatgctgactactttgtgtttcattctccctataacaagcttgtacagaagagcttttctaggttgttattcaacgactttacgagggctgctagctcaattgacgaggctgctaaagagaagctgtcaccattttcctcgttatccaacgacgaaagctaccaaagtcgcgaccttgaaaaggcatcacaacaagtggcgaagccgttttacgatgcgaaagtacagccgtcgacacttatcccgaaacaagtgggcaatatgtacactgcttcgatctatgctgcatttgcatcactcctccacaacaaaaacacaactctggctggtcagagggtgatattattttcatacggaagtggtttagcagctacaatgttctctgtccgtattaatgagggacaacatcctttcagcctctctaacattgcagccataatgaacgtttccgacaagttgaagaaaagacacgagttcccaccggaaaaatttgccgacataatgaagctaatggagcacagatatggaggaaaggactttgtgacaaccaaggactgtagtcttcttgcaccgggcacttattacctaactgaagttgattcgaagtaccgtagattctatgcgagaaagcccgttgagaatggtactgccattacaaacgggcattgaagatagtccgagaataaaacgatgcccgtttgagtttaatttgtttggcacattattgttatttcgtagcgtattcgaatttccgtttttttttctcgttttttttttttttagtttgaaaagatgattgtggatgacaatgaagatgtcattggtgtagtattctacatcttttttaatgaaattgattgatcaagaaggtcccttttgtggctttttaaatacttttgtcaattc

SEQ ID NO: 1250 - DNA, 1950 bp, Mimulus guttatus
gggggctgaaaaatgtgaaaatgcgaacaaaatgtgccaaaaatcaattcttttcttcttcttcctcccctataaattgtcaccattcccccaacggcatttacataacccaaaatcatccattttctctctcttctttctctctcctctctgttttctagcttgcgcacgcacccctgcttttgcgaatttcctggattgagtattaacagggcagcaaattttgggatttttttcaggataattcatttttcgtttttgcgtatctgatctactttttttttttcgagtgaaaaaataaaaattaaaaattcagagatggcaaagaatgtaggaattctcgccatggaagtgtacttcccccccacctgcatccagcaggaagtgttggaggctcatgatggagccagcaaagggaagtacacaatcgggctcggacaagattgcatggcgttttgcgacgaggttgaagatgtcatttccatgagtatgacagctgtcacttcactcctagagaagtatggagtcgacccaaagcagattgggcgtctcgaagttggaagtgagaccgtactcgataaaagcaaatccatcaagacattcttgatgccaatttttgagaaatgtggaaacaccgacatagaaggagtcgactcaaccaacgcgtgctatgggggtacagctgcacttttcaactgcatcaattgggtcgaaagtaattcttgggatggtcgatatgggcttgttgtctgcaccgatagtgcggtttacgccgaggggcccgctaggccaaccggaggagctgcagctattgccatgctagtgggaccggacgctcctattgctttcgaaagcaagcttagggctagccacatgtctcatgtttacgatttttacaagcccgatcttgccagtgaatatcccgttgttgatggcaagctttctcagacttgttacctcatggcactcgattcttgttataaaagcttatgtgacaagtacgagaagatggagggtaagcagttttcgatcaacgatgctgactactttgtgtttcattctccctataacaagcttgtacagaagagcttttctaggttgttattcaacgactttacgagggctgctagctcaattgacgaggctgctaaagagaagctgtcaccattttcctcgttatccaacgacgaaagctaccaaagtcgcgaccttgaaaaggcatcacaacaagtggcgaagccgttttacgatgcgaaagtacagccgtcgacacttatcccgaaacaagtgggcaatatgtacactgcttcgatctatgctgcatttgcatcactcctccacaacaaaaacacaactctggctggtcagagggtgatattattttcatacggaagtggtttagcagctacaatgttctctgtccgtattaatgagggacaacatcctttcagcctctctaacattgcagccataatgaacgtttccgacaagttgaagaaaagacacgagttcccaccggaaaaatttgccgacataatgaagctaatggagcacagatatggaggaaaggactttgtgacaaccaaggactgtagtcttcttgcaccgggcacttattacctaactgaagttgattcgaagtaccgtagattctatgcgagaaagcccgttgagaatggtactgccattacaaacgggcattgaagatagtccgagaataaaacgatgcccgtttgagtttaatttgtttggcacattattgttatttcgtagcgtattcgaatttccgtttttttttctcgttttttttttttagtttgaaaagatgattgtggatgacaatgaagatgtcattggtgtagtattctacatcttttttaatgaaattgattgatcaagaaggtcccttttgtggctttttaaatacttttgtcaattcttgatatatga

SEQ ID NO: 1251 - DNA, 1691 bp, Manihot esculenta
cacgctcatctctccttctctcagctgcttccaagtacccctcccttcaaatctctctacagagtttgatttctttttagttttgcggctgttgtttggaggaggattcggagaggcgaagcaaaaatggcgaagaatgtgggaattctcgctgtggacatctactttcctcctacctgtgttaaccaggaagctctggaggctcatgatggtgccagcaaagggaaatacaccattggacttggacaggattgcatggcattttgtactgaggtggaagatgtcatctcaatgagtttgactgctgttgcttcactccttgacaagtatgatattgaccctaagcaaatcggtcgtctggaagttggcagtgaaactgtgatcgacaagagcaaatctatcaaaaccttcttgatgcaaattttcgagaaacatggaaacactgacattgaaggcgtcgactcaactaatgcatgttatggggggactgcagctttattcaactgtgtcaattgggttgagagcagttcctgggatggacgctatggacttgtagtgtgtactgacagtgcggtctatgcagagggtccagcccgaccaactggaggagctgcagccattgccatgctaataggtccagatgctcctattgcttttgaaagcaaatttagggggagccatatgtctcacgcttatgatttttacaagcccaacctggctagtgaatacccagttgtggatggcaagctttctcagacatgctaccttatggctcttgattcttgctacaaacatttctgtgccaagtatgagaaattggagggcaaacaattctctatttctgatgctgaatattttgtatttcattctccttacaacaagcttgtacagaaaagctttggacgtttggtgttcaatgattttgtgaggaatgccagctctattgatgagactgctaaagaaaagctggccccattttcaactttatctggtgatgaaagctaccaaaaccgagatcttgaaaaggcatcccaacaagttgccaaggccctttatgatgcaaaggtgcaaccaaccaccttgataccaaagcaagttggcaatatgtacactgcatctttatatgctgcatttgcatccctcctgcacaataaacatactgaattggcaggcaagcgggttatactgttctcttatggcagtggtttgacagccacaatgttctcactgcgactaaatgaagggcaacatccctttagcttgtcaaacattgcatctgtgatgaatgttgcaggaaaattgaaggcaagacatgagtttgccccagagaagtttgtagacatcttgaagctaatggagcacagatatggagctaaggactttgtgacaagcaaggattgcagcctcttagcttctggaacatactatctcacagaagttgacaccatgtatcggagattctatgcccagaaggccgttggcaacacagttgagaatggttcgctagctaatggtcattcatagaacatggaagtgtcatgtaagatgtcaggaatttagcttgtatgcttttagatattcagtcctgcggacgtttgtgtttccttcaactttgtattctaaagaaaatagtttgttcagcggcaattttttttcctccttaataaatccctcttaatgtctcttcactt

SEQ ID NO: 1252 - DNA, 1861 bp, Catharanthus roseus
cagtcactactcactcgcctctctcccccaaacaaatttctctctctcttctctctccctgcacgagttttcgggatttccatctttctcttcaatctttgattctccagatagagagagagagagagaaagagaaaagaacaggaaaaaacgagaaccaggggagacccctttgtttgttccattttacttagttgatccgttgccggaatcatcatcttcgtcgttcgtctttcagaaaagtataaacttttttgaaaaaaaatggcggcccaacagaaaaatgttggaattcttgcaatggaaatctacttccctccaacttgcatcaagcaggaaattctggaggcctatgatggagcaagtaaagggaaatacacaattgggcttggacaagattgcatggggttttgtactgaggtagaagacgtcatctcaatgagtatgacggcagttacatcccttctccagaagtacaatatagatccaaagcaaattggtcgtctggaagttggaagtgagactgttttagacaagagcaaatccatcaagacattcttgatgcaagtttttgaggaatctggaaatactgacattgaaggtgttgattcaagtaatgcatgctatgggggaacggcagctctgttgaactgtgtcaactgggttgagaatagttcctgggatggacgctatggacttgttgtgtgtaaagacagtgcggtttatgctgaggggccagctcgcccaactggaggagcagcagctattgctatgctcattgggcctgatgctcctattgcctttgaaagcaagctaaggggtagtcacatggctcatgcctatgatttttacaagcctaaccttgccagtgaatacccagttgtggatggcaagctttcacaaacttgttaccttatggcacttgattcgtgcctacaagactttctgccgcaagtatgagaaattcgagggaaagcagttttcaatcacagatgctagctattttgtatttcattctccatacaacaagcttgtacagaagagttttgctagattgtgtttcattgactttttgaggaatgccagttccatcgatgaggctgctaaagaaaagctggcacctttttcatctttaactggggatgaaagctaccaaagccgtgaccttgaaaaggtatcccagcaagttgcgaagccattatatgatgagaaggtgcaaccaactactttaattccaaagcaagtcggcaacatgtacacggcctctctctatgctgcatttgcatccctaattcacaataagcatagcaccctggccggacagagggtaatactgttctcctatggaagtggattgactgctaccatgttctcactgcgccttcgtgagtgcagaactccttttagcctatcaaacattgcaagcgtgatgaatgtcgcggaaaagttgaagtcgaggcatgagttccctcctgagaaatttgttgaaacaatgcacctgatggagcagagatatggagggaaggacttcgtaacgagcaaggattgtagccttctagctccggggacttactatttgacagaagttgattcaatgtaccgcagattctatgcaaagaaggctatggagaatggctccttggcaaacggtcattgactatggtgtttttcagcaatgaggccatgaagaagaaattggctatggtgttttcttttttttcctaagttatttttggatgtggattaataattattatggttttcataaagctgtagaatataaaatatctagtgttatatttcagtagacaagtattatataataggtattgcagttcaattcaattaatcttttgcataa

SEQ ID NO: 1253 - DNA, 2007 bp, Mimulus guttatus
gggggctgaaaaatgtgaaaatgcgaacaaaatgtgcccaaaaatcaattctttacatcttcttcttcccctataaattgtcaccattcccccaacggcatttacataacccaaaatcaatccattttctctctcttctttctctctcctctctgttttctagcttgcgcacgcacccctgcttttgcgaatttcctggattgagtattaacagtgcagcaatttttgggatttttttcaggataattcatttttcgtttttgcgtatctgatctacttttttttttcgagtgaaaataaaaattaaaaattcagagatggcaaagaatgtaggaattctcgccatggaagtgtactttccccccacctgcatccagcaggaggtgttggaggctcatgatggagccagcaaagggaagtacacaatcgggctcggacaagattgcatggcgttttgcgacgaggtcgaagatgtcatttccatgagtatgacagctgtgacttcactcctagagaagtacggagtcgacccaaagcagattgggcgtctcgaagttggaagtgagaccgtactcgataaaagcaaatccatcaagacattcttgatgccaatctttgagaaatgtggaaacaccgacatagaaggagtcgactcgaccaatgcgtgctatgggggtaccgctgcactattcaactgcatcaattgggtcgaaagtaattcttgggatggtcgatatgggcttgttgtctgcacagatagtgcggtttacgccgagggacccgctaggccaaccggaggagctgcagctattgccatgctagtgggaccggacgctcctattgctttcgaaagcaagcttagagctagccatatgtctcatgtttacgatttttacaagcccgatctcgccagtgaatatcccgttgttgatggcaagctttctcagacttgttacctcatggcactcgattcttgttataaaagcttatgtgacaagtatgagaagatggagggtaagcagttttcgatcaacgatgctgactactttgtatttcattctccttacaacaagcttgtacagaagagcttttctaggttgttattcaacgactttacgaggggtgctagctcgattgacgaggctgctaaagagaagctgtcaccattttcctcgttatccaacgacgaaagctaccaaagtcgcgaccttgaaaaggcatcacaacaagtggcgaagccattttacgatgcgaaagtgcagccatcgacactcatcccgaaacaagtgggcaatatgtacactgcttcgatctatgctgcatttgcatcactcctccacaacaaaaatacaactctggctggtcagagggtgatattattttcatacggaagtggtttagcagctacaatgttctctgtccgtattaacgagggacaacatcctttcagcctctctaacattgaagccataatgaacgtttcggacaagttgaagaaaagacacgagtttccaccggaaaaatttgccgacataatgaagctaatggagcacagatatggaggaaaggactttgtgacaaccaaagactgtagtcttcttgcaccgggcacttattacctaactgaagttgattccaagtaccgtagattctatgcgagaaagcccgttgagaatggtactgccattacaaacgggcattgaagatagtccgagaataaaacgatgcccgtttgagtttaatttgtttggcacatttattgttatttcgtagcgtattcgaatttccgtttctttttttttctcggtttttttagtttgaaaagatgattgtggatgacaatgaagatgtcattggtgtagtattattctacatcttttttttttaatgaaattgattgatgaagaaggtccctttgtggcttttaaatacttttgtcaattcttgatatgatgagtgtactactgtaaaaaggttcacaatgttttgatattatatttgaaaacc

SEQ ID NO: 1254 - DNA, 1714 bp, Salvia sclarea
acaccattcagccacccattctctctctacctctctgattcctgagctctgcgactactgtgtgtgctgtttaactgatccgctatttccttcatttcgtcaactcaagaagtcgagatggccaagaatgtcgggatcctcgccatggaaatctacttccctcccacttgcatccagcaggaggtattggaagctcacgatggagcaagcaaagggaagtacacaattgggcttggccaagattgcatggcattttgttcggaggttgaagatgtcatttcgatgagcatgacagcggttacttcgcttctagggaagtacaatgttgatccgaagcagattggacgtcttgaagttggaagtgagaccgtactcgacaagagcaaatccattaagacattcttgatgccgatcttcgagaaatgtggcaatattgacatcgaaggtgttgactcaagcaatgcttgctatggtgggactgcagcactatttaactgtgtcaattgggtggaaagtagttcttgggatggaagatatgggcttgttgtctgcacagacagtgcggtatatgccgagggaccagctagacctactggtggggctgcagctattgccatgctaataggaccaaatgcacccattgcttttgaaagcaagcttagggcgaatcacatggctcatgtttatgatttttacaagcccgaccttgccagtgaatatccagttgttgatggcaagctttctcagacttgttaccttatggcactggatgcttgttacaaaggcttctgccaaaagtttgagaagcaggagggcaagcagttctcgatcttggatgccgactactttgtatttcattctccatacaacaagcttgtacagaaaagcttctctagattgttgttcaatgacttttcgagaaatgccagctccatcgatgaggctgctaaagaaaagctggcaccattttcatcattaagcaacgaggaaagctaccaaagtcgtgatcttgagaaggcatctcaacaagtcgctaaacctttctttgataccaaggtgcaaccatctactctcgtcccaaaacaagtgggaaacatgtatactgcatcgctctatgctgcatttgcttccctcatccacaacaaaagtagcactttggctgggcagagggtcatattgttttcctacggcagtggtctgtcagccaccatgttctctcttcgtttcactgagggagaacaccctttcagcctgtccaacattgcatctgttatgaacgtttcagagaagttgaagtcgaggcacgagttcccaccagagaaattcgtcgaactgatgcagctcatggagcacagatatggaggcaaagacttcatcacaagcaaggactgcagccttcttgcaccaggtacatactatctcactgaagtcgactccaaataccgaagattttatgccaagaaggccattgcgaatggcacagttgcgaacggccactgaagatgtgatatgccataaagttggctcttcttctgtctagttgattcagcacatagaaaaataatctaatctattttcattgtttgatacaagcatttgagttggtttgacagatgaattattatctgtagtttctttatcattgtttttctctctcttggattctggaaaaggaccattttagatgggtgtattctattctacatcttaatga

SEQ ID NO: 1255 - DNA, 1420 bp, Solanum lycopersicum
aggaagcattggaggctcatgatggagcaagcaaagggaaatacacaattggtcttggacaagattgtatgggcttttgcactgaggtggaagatgttatatcaatgagtttgacagcagttacttcccttttggagaagtatgctattgatccaaagcaaattggtcgtctagaggttggaagtgaaaccgtaattgataagagcaaatccatcaagacattcctgatgcaaatatttgagaaatctggaaatactgacattgaaggagtcgactcaactaatgcatgctatgggggaactgccgcattgttcaactgtgtgaattgggtcgaaagctcttcatgggatggtcgctacggactcgttgtgtgcactgatagtgcggtctatgctgagggagctgctcggcctactggaggtgcagcagcaattgctatgctagtcgggccagatgctcctattgtgttcgaaagcaagattagggctagccatatggcccatgtctatgatttttacaagcccatactcgacagtgaatatccagtggttgatggcaaactttcacaaacttgttatcttatggcacttgactcttgctacaagagcttatgcaacaaatacgaaaaattggagggcaagcagttttcaattgatgatgcagcctattttgttttccattcaccatacaacaagcttgtacagaagagcactgctcggttgatgttcaatgactttacaaggaacgctagttccattgatgagtctactaaagaaaagttggcaccattttcatccctaactggtgatgagagttatcaaagccgtgatcttgagaagacatcctggcaagtagcaaaaccattttatgacgagaaggtaaaaccggccacattaataccaaaacaagttggcaacatgtacaccgcgtctctctatgctgcttttgcatccctccttcacaataagcacagctcattggctggacagagggtagtattgttctcttacgggagtggattgactgcaacaatgttctcattaaagcttcacgaaggtcaacatccttttaacttgtcaaacatcgcaactgtgatgaacattgaagagaaactgaagtcgaggcatgagttcactcctgaaaatttcatcgaaactatgaagataatggagcacaggtacgggggtaaggactttgtgacgagcaaggattgcagccttctagctcctggtacgtactatctaacagaagtcgattcgaagtacagaagattctatgcaaagaaatgtgctgagaatggacttgccaatggtcattgaatataagtcctagtatgatataacttccatgaattttgcttgtactcttttaattatataattgcttcataataacatatagtttctttctacttcccaac

SEQ ID NO: 1256 - DNA, 1851 bp, Ricinus communis
gacagacaagactcaagagaacaccgcacagcaaagcaaagcacagcgcaacacaacacattacagaattttgaaaattcgctatataaactgagcaaacaaacttcatgtgagccccagccccagcccccccactctctcttctcgttctctctctccctttctactttctttttctctaactcgaagcatctctcagcagcaggcagagagagataaagctggtgcttggttctgtttggttttgatttcttttgattcgatttctcgtttactagaaaaagaaatggcaaagaatgttggaattctcgctttggatatctatttccctcctacctgtgttcaacaggaagcattggaggcgcatgatggagcaagtaaaggaaaatatacgattggacttggacaagattgcatgggattttgtactgaggttgaagatgtcatctccatgagtttgacagctgttacttctctccttgacaactataatattgatcctaaacaaattggtcgtttggaagttggtagtgaaactgtgattgacaagagcaaatctattaagactttcttgatgcaaatttttgagaaacatgggaatactgacattgaaggtgttgactcatctaatgcttgctatggaggaactgcagctttattcaattgtgtcaattgggttgagagttcgtcatgggacggacgctatggacttgtagtttgtaccgatagtgcggtttacgcagaaggtcctgctcggcctactggtggagctgcagccattgctatgctaataggtccagatgcacctattgcttttgagagcaaatatagggggagccatatgtctcatgcatatgatttttacaagcccaacctagccagtgaatatccggttgtggatggcaagctttctcaaacatgctacctcatggctcttgattcttgctacaagcatttctgtgccaagtatgagaaatttgagggcaaacaattctctatttccgatgctgagtattttgtatttcattctccttataacaagcttgtacagaaaagttttgctcgtttagtgttcaatgactttgtgaggaatgccagctctattgacgaggcagctaaagaaaagcttgcaccattttcaactttaactggtgatgaaagctaccaaaatcgtgatcttgaaaaggtatctcaacaagttgctaagcccctgtatgatgcaaaggtgcaaccaaccactttgataccaaagcaagttggcaacatgtatactgcatctctatatgcagcatttgcctcccttcttcataataaaaattctaaattggcaggcaagcgagtgatactgttttcgtacgggagtggtttgacagcgacaatgttctcattgagactgcatgaaggccagcatccctttagcttgtcaaacattgcaactgtgatgaatgtgacagacaaattgaagtcaaggcatgagttctccccggagaagtttgtggagaccatgaagttaatggagcaccgatatggggctaaagactttgtgacaagccaggattgcagcctcttggctcctggaacatactatctgacagaagttgataccatgtatcgaagattctacgccaagaaattggttgacaatacctgtgagaatggtttgatcgctgatggtcactgataacaaatggaagtcatgtaatactccaggaattcagctattatgtttttagttattgttttgtcgtaaggacatctgtgttccctgtattctacagcaaatagtttattcagaagcaagtgttagtgcaattttttgttttccctcaataaaattcctcttattgtctc

SEQ ID NO: 1257 - DNA, 1782 bp, Populus trichocarpa
ggctcctcatccttctccccttttaagcatatttgttcatattttacaagcgaccaattaagccgaatctctccttttccctagcaatacttcaagaaagagagagtttggttgttctgggctctcttttttttaagtttcttgatttctagacttgtttgtttcctgaggaatttaaagaaaattcaagaatggcaaagaatgtgggaatcctcgctgtggatatttacttccctcctacctgtgttcaacaggaagccctggaggcccacgatggtgcaagcaaagggaaatacacaattggacttggacaagattgcatgggattttgtacagaagtggaagatgttatctcaatgagtttgacagctgtgagttcacttcttgagaagtacaatgttgatccaaaacaaattggtcgcttagaagttggcagtgagaccgttattgacaagagcaaatccattaagaccttcttgatgcaaatcttcgagaaatgtggaaacactgacattgaaggcgttgactcaactaatgcatgctatggaggaactgcagctttattcaactgtgtcaattgggttgagagttgctcatgggatggacgatatgggcttgttgtgtgtactgacagtgcggtctatgcagaagggcctgctcgaccaactggaggagctgctgccattgccatgctagtcggtccagatgcacctattacttttgaaagcaaatttagggggagtcacatgtctcatgtctatgatttctataagcccaaccttgccagtgaatatccggttgtggatggcaagctttcccaaacatgctacctcatggcccttgattcctgctacaaacaattttgtgccaagtacgagaaatcaacaggcaaacaattctctatttctgatgctgcctattttgtattccattctccatataacaagcttgtacagaaaagttttgctcgtttggtgttcgatgactctgtgagaaatgccagctctattgatgaggctgctaaagagaaactagcaccattttcaactttatctggtgatgaaagctaccaaaaccgggatcttgagaaggtatcccagcaagttgcaaagcctctttatgacgcaaaggtgcaaccaaccactttgatacccaagcaagttggcaacatgtatactgcatctctctatgcggcatttgtatcccttcttcacaataaaagtagtgaattggcgggcaagagggttatattgttctcatatggaagtggttcgacagccacaatgttctcattgaaattacatgaaggtcaaaagccatttagcttgtcaaacattgcaactgtgatgaatgtctcaacgaagttgaagtcaaggcatgagttttctgcagtgaaatttgtcgaaactataaatctaatggagcacaggtacggaggcaaggactttgtgacgagcaaggattgtagcctcttggctccaggaacgtactatctgacggaagtcgactctatgtaccgaagattttatgccaagaagcctgtggatggtgcttgcgagaatggttcacttgtcaatggtcactaagccactacagctgcaatgggccaaggattcggctcttacttttagataggtgttgttgtcaagtcctaagaagaatattcatgcttcctttaaggttcgtattttaaaatcaaatagttggttgattagcaagcaagggttccgagtgtaattttcattccacctaataaaatctctctctatgagagttttgtta

SEQ ID NO: 1258 - DNA, 1791 bp, Populus trichocarpa
cttgttgagaggctcctcatccttctccccttttaagcatatttgttcatattttacaagcgaccaattaagccgaatctctccttttccctagcaatacttcaagaaagagagagtttggtgttctgggctctatttttttgaagtttcttgatttctagacttgtttgtttcctgaggaatttaaagaaaattcaagaatggcaaagaatgtgggaatcctcgctgtggatatttacttccctcctacctgtgttcaacaggaagccctggaggcccacgatggtgcaagcaaagggaaatacacaattggacttggacaagattgcatgggattttgtacagaagtggaagatgttatctcaatgagtttgacagttgtgagttcacttcttgagaagtacaatgttgatccaaaacaaattggtcgcttagaagttggcagtgagaccgttattgacaagagcaaatccattaagaccttcttgatgcaaatcttcgagaaatgtggaaacactgacattgaaggcgttgactcaactaatgcatgctatggaggaactgcagctttattcaactgtgtcaattgggttgagagttgctcatgggatggacgatatgggcttgttgtgtgtactgacagtgcggtctatgcagaagggcctgctcgaccaactggaggagctgctgccattgccatgctagtcggtccggatgcacctattacttttgaaagcaaatttagggggagtcacatgtctcatgtctatgatttctataagcccaaccttgccagtgaatatccggttgtggatggcaagctttcccaaacatgctacctcatggcccttgattcctgctacaaacaattttgtgccaagtacgagaaatcaacaggcaaacaattctctatttctgatgctgcctattttgtattccattctccatataacaagcttgtacagaaaagttttgctcgtttggtgttcgatgactctgtgagaaatgccagctctattgatgaggctgctaaagagaaactagcaccattttcaactttatctggtgatgaaagctaccaaaaccgggatcttgagaaggtatcccagcaagttgcaaagcctctttatgacgcaaaggtgcaaccaaccactttgatacccaagcaagttggcaacatgtatactgcatctctctatgcggcatttatatcccttcttcacaataaaagtagtgaattggcgggcaagagggttatattgttctcatatggaagtggttcgacagccacaatgttctcattgaaattacatgaaggtcaaaagccatttagcttgtcaaacattgcaaccgtgatgaatgtctcaacgaagttgaagtcaaggcatgagttttctgcagtgaaatttgtcgaaactataaatctaatggagcacaggtacggaggcaaggactttgtgacgagcaaggattgtagcctcttggctccaggaacgtactatctgacggaagtcgactctatgtaccgaagattttatgccaagaagcctgtggatggtgcttgcgagaatggttcacttgtcaatggtcactaagccactacagctgcaatgggccaaggattcggctcttacttttagataggtgttgttgtcaagtcctaagaagaatattcatgcttcctttaaggttcgtattttaaaatcaaatagttggttgattagcaagcaagggttccgagtgtaattttcattccacctaataaaatctctctctatgagagttttgtta

SEQ ID NO: 1259 - DNA, 1379 bp, Gossypium hirsutum
  misc_feature (1286)..(1286): n is a, c, g, or t
gagtgagcaatggctaagaatgtgggaattcttgctatggatatctacttccctcctacctgtgttcaacaggaagcattggaggctcatgatggtgctagtaaggggaaatacaccattggacttggacaagattgcatggccttttgtacagaagtggaagatgttatctctatgagtttaacagctgttacttcactccttgcaaagtataagattgaccccaaacaaattggccgtcttgaagttggtagtgagactgtgatcgacaagagcaagtccattaagaccttcttgatgcaaatctttgagaaatctggaaacactgacatcgaaggggttgactcaactaatgcatgctatggagggactgcagctttatttaactgtgtcaattgggttgaaagtagttcatgggatggacgatatggtcttgttgtctgtactgacagtgcggtctatgcagaaggacctgcccggcctactggaggagcagcagcaattgctatgctaatagggcctgatgctcctattgcttttgaaagcaaattacgtggaagtcatatgtcccatgcctacgacttttacaagcctaaccttgctagtgaatatccggttgtcgatgggaaactttctcaaacatgctatctcatggctctcgatacttgctacaaatatttctgtcacaagtatgagaaactagagggcaaacagttctctctttctgatgctgcatacttcgtattccattctccgtataacaagcttgtgcagaaaagcttttctcgtttgttgttcaacgacttcttgaggaatgccagttctgtcgatgaaattaccaaggaaaaactggctccattctcaactttgaccggtgacgaaagctaccaaagccgggatcttgagaaggcatcccaacaagcttcaaagtccctttatgatgccaaggtgcaaccaactaccttgataccaaagcaagttggcaacatgtatactgcatctctttatgctgcctttgcatcccttattcacaacaaaaacagtgaattggcaggaaagcgggtgattttattctcttacggaagtggtttaactgccacaatattttcattgcgattccatgaaggtcaacacccgtttagcctatcgaacattgcatcggtgatgaatgtagccgggaaattgaagtcaaggctttccccctgagaagtttgttgagactatgaagctcatggagcataggtacggagccaaggatttcgtgacaagcaaagactgtagccttntgtctcccggacatactacctcaccgagttgattccatgtaccggaattctacgcaaaagaagacggggactttgctgcttgcgataatggtt

SEQ ID NO: 1260 - DNA, 1925 bp, Populus trichocarpa
gcaagtctcctcaccctgctctcaaataatcatttttatcatattttacaggagaacaagtaagccaagcctctttgtttttagcaatacattgagaaagagagtggttttgggttcttggtttttggttgaagtttctcgatttgtagaattgtttgttccttaaggaatttaaagaaaatcctagaatgacaaagaatgtggggattctcgctattgatatctacttccctcctacctgtgttcaacaggaagccttagagacccacgatggtgcaagcaaagggaaatacacaattggacttggacaagattgcttgggattttgtacagaagtggaagatgttatctcaatgagtttgacagttgttagttcacttctcgagaagtacaatgttgatccaaaacaaattggtcgcctagaagttggcagtgagaccgttattgacaagagcaaatccatcaagaccttcttgatgcaaatatttgagaaatgtggaaataccgacattgaaggggttgactcaactaatgcatgctatggaggaactgcagctttattcaactgtgtcaattgggtcgagagtagctcatgggatggacgctatgggcttgttgtgtgtactgacagtgcggtctacgcagaaggacctgcccggcctactggaggagctgctgccattgccatgttaatcggtccagatgcacctattgtttttgaaagcaaatttagggggagtcacatgtctcatgtctatgatttctataagcccaaccttgctagtgaatatccagttgtggatggcaagctttctcaaacatgctacctcatggcccttgattcctgctacaaaacattctgtgcaaagtatgagaaatcaacaggcaaacaattctctctttctgatgctgcctattttgtattccattctccttataacaagcttgtacagaaaagctttgctcggttggtgttcaatgactctgtgaggaaagccagctcaattgatgagggtgctaaagagaaactggcaccattttcaactttatctggtgatgaaagctaccaaagccgggatcttgagaaggtatcccaacaagttgcaaagcctctttttgaagcaaaggtgcaaccaaccactttgatacccaagcaagttggcaacatgtataccgcatctctctatgcagcatttgcatcccttcttcacaataaaaatagtgaattggcaggcaagcgggttatactgttctcatatggaagtggtttgacagccacgatgttctcattgcaactacatgaaggtcaacaaccgtttagcttgtcaaacattgccactgtgatgaatgttccaacaaagttgaagtcaaggcacgagttttctcccgagaaatttgtcgaaactatgcacctaatggagcacaggtacggagcaaaagactttgtgacaagcaaggattgtagtcttttggctccaggaacatactatcttacagaagtcgactacatgtaccgaagattttatgccaagaagcccatagacggtgctagtgagaattgttcgctcaccaatggtcactgatcctggtgaaccagctacagttgtcataagccaggaatccggctcttaacttttagatgttgttatcaagcccaaagaagaatattcatgcttccttaagtttgtattttaaagcaaatagttcgttcatcagcaagcaagtgttctcagtatattttgttggttatcttttagttcgttcatcagcaagcaaatagttcgcttacctggcctctgtaggcttattcgtaatttcattttggttctttttatttttggtgtgattattatgtgatctaaggggaaatttagtattttaaaaaataaaagaaataaaagttggcatatgtgttgaacgtgtaa

SEQ ID NO: 1261 - DNA, 1929 bp, Populus trichocarpa
gcaagtctcctcaccctgctctcaaataatcatttttatcatattttacaggagaacaagtaagccaagcctctttgtttttagcaatacattgagaaagagagtggttttgggttcttggtttttggttgaagtttctcgatttgtagaattgtttgttccttaaggaatttaaagaaaatcctagaatgacaaagaatgtggggattctcgctattgatatctacttccctcctacctgtgttcaacaggaagccttagagacccacgatggtgcaagcaaagggaaatacacaattggacttggacaagattgcttgggattttgtacagaagtggaagatgttatctcaatgagtttgacagttgttagttcacttctcgagaagtacaatgttgatccaaaacaaattggtcgcctagaagttggcagtgagaccgttattgacaagagcaaatccatcaagaccttcttgatgcaaatatttgagaaatgtggaaataccgacattgaaggggttgactcaactaatgcatgctatggaggaactgcagctttattcaactgtgtcaattgggtcgagagtagctcatgggatggacgctatgggcttgttgtgtgtactgacagtgcggtctacgcagaaggacctgcccggcctactggaggagctgctgccattgccatgttaatcggtccagatgcacctattgtttttgaaagcaaatttagggggagtcacatgtctcatgtctatgatttctataagcccaaccttgctagtgaatatccagttgtggatggcaagctttctcaaacatgctacctcatggcccttgattcctgctacaaaacattctgtgcaaagtatgagaaatcaacaggcaaacaattctctctttctgatgctgcctattttgtattccattctccttataacaagcttgtacagaaaagctttgctcggttggtgttcaatgactctgtgaggaaagccagctcaattgatgagggtgctaaagagaaactggcaccattttcaactttatctggtgatgaaagctaccaaagccgggatcttgagaaggtatcccaacaagttgcaaagcctctttttgaagcaaaggtgcaaccaaccactttgatacccaagcaagttggcaacatgtataccgcatctctctatgcagcatttgcatcccttcttcacaataaaaatagtgaattggcaggcaagcgggttatactgttctcatatggaagtggtttgacagccacgatgttctcattgcaactacatgaaggtcaacaaccgtttagcttgtcaaacattgccactgtgatgaatgttccaacaaagttgaagtcaaggcacgagttttctcccgagaaatttgtcgaaactatgcacctaatggagcacaggtacggagcaaaagactttgtgacaagcaaggattgtagtcttttggctccaggaacatactatcttacagaagtcgactacatgtaccgaagattttatgccaagaagcccatagacggtgctagtgagaattgttcgctcaccaatggtcactgatcctggtgaaccagctacagttgtcataagccaggaatccggctcttaacttttagatgttgttatcaagcccaaagaagaatattcatgcttccttaagtttgtattttaaagcaaatagttcgttcatcagcaagcaagtgttctcagtatattttgttggttatcttttagttcgttcatcagcaagcaaatagttcgcttacctggcctctgtaggcttattcgtaatttcattttggttctttttatttttggtgtgattattatgtgatctaaggggaaatttagtatttaaaaaaataaaagaaataaaagttggcatatgtgttgaacgtgtcagtaa

SEQ ID NO: 1262 - DNA, 1882 bp, Actinidia deliciosa
ctcgctctcgcttgtgcgattttgcaggattccctcacctctctctctatatctatctatctatctatctatctatctatatatatattccccccctctctctctctacagaggagctagtgaggggaaatcggtggttctttcgatctgtttgtttctcgagaatttgaagttacaaagccgagaaagggagaaatagagatggcctcgcagccgaagaatgttggaatcctcgccatggaaatctacttccctcctacttgtgtccagcaggaagcaatggaggttcatgatggggcaagcaaagggaagtacacaattgggcttggacaagattgcatggcattttgcactgaggtggaagatgtcatctccatgagtttgactgctgttacttccctccttgagaagtatggcattgatccggcacaaattggtcggcttgaagtggggagtgagactgttatcgacaagagcaagtccataaagactttcctgatgcaaatctttgaggaaagtggaaacactgacattgaaggtgtggactcaactaatgcttgctacggaggaactgcagctttgttcaactgtgtcaattgggtggagagcagttcatgggatggacgatatggacttgtggtctgcacagacagtgcggtctatgcagagggaccagctcggcctactggaggagcagctgctattgttatgcttatagggcctgatgctcctatagcatttgaaagcaaattcaggggaagccatatgtctcatgtctacgatttttacaagcctgaccttgcaagtgaatatccggtggttgatggaaagctctcacagacttgctatctcatggcacttgattcttgttacaaacggttttgtcacaagtatgaaaaattggaaggcaagcaattttctgtagttgatgctgactattttgtgtttcattctccatacaacaagcttgttcagaagagttttgccaggttgcttttcaatgatttctcgaggaatgcaagctctattgatgaggctgctaaacaaaagctagcaccattttcaactctaaccggagatgaaagctaccagagccgtgatcttgagaaggcaacccagcaagttgcaaagcctttttacgatacaaaggtgcaaccagccacatgggtaccaaagcaagttggcaacatgtatactgcatctctttacgcggcatttgtatcgcttattcacaacaagcatagctcactggcaggtcagcgggtagtaatgttctcgtatggcagcggtttaagtgccactatgttttccttccaaatccgtgagggtcaacatccttttagcttgtcaaacattgcaaccgtgatgaatgttggcggaaagatgaagtctaggcatgagttcccaccagaaaaatttgtcgaaacaatgaagctgatggagcacaggtatggggccaaggactttgtgaccagcaaggactgcagcctcctatctccaggcgcttactacctcaccgaagttgactccatgtaccgaagattctacgcaaagaaggctggagccatcaccaccagtactggttgcgagaacggttcagtggccaacggtcactgataattttctactaaacgttatgccaaaagttggttcaactggtttttagaagaataattctgcttcttgggtatgttccgtgtagcaaatagtttgtttagcagaagtgttgcctgtttatttgtactcaaatctctctccgctcaaatgtttagagcatcaatcatttactcgtttctgtcccttgcgcctattattcgatggtgtaacattctcaatattttccaaatataaatgaaaatatttttttagcaaaaaaaaaaaa

SEQ ID NO: 1263 - DNA, 1758 bp, Gossypium hirsutum
acgagcggccagtatcaacgcagagtacatggggacagtttctcaccaacgttgctctcagctgagtttcggggaaacaaaaaggaagcatcatgtcttaatccagaaaaaatatcccttttcgttttaatctttgttgtagctaatccatcatcgttcgcgtgagagaaaaatggctaagaatgtaggaattcttgctatggatatttacttccctcctacctttgttcaacaggaagccttggaggctcatgatggcgtgagcaaaggaaaatacaccattggacttggacaagattgtttggccttctgtactgaggtcgaagatgtgatctcaatgagtttgacagttgttacttcactccttgagaagtataagattgaccctaaacaaattggccgtcttgaagttggcagcgagaccgtgatagacaagagcaagtccattaagactttcctaatgcaaatttttgagaaatgtggaaacactgacattgaaggggtcgattcaactaatgcatgttatggagggactgcagctctgttcaactgtgtcaattgggtggaaagtagttcatgggatggacgatatggcattgttgtttgtactgacagcgcggtctatgctgaaggaccagcccggccaactggaggagcagctgcaattgctatgctaatagggcctgatgctcctattgcatttgaaagcaaatttagggggagtcacatgtcccatgcctacgacttttacaagcccaaccttgctagtgaatatccggttgttgatggaaaactctctcaaacgtgctatctcatggctcttgatacttgctataaatacttctgtcacaagtacgagaaacaagagggcaagcaattttccctttccgatgctgactactttgtatttcattctccatataataagcttgtgcaaaaagctttgctcgtttggtgttcaatgactttgtgaggaatgccagttctgttgatgacattgctaaagaaaagttggctccattttcaactttgaccggtgatgaaagctaccaaagcagggatcttgagaaggcatcccaacaagtttcaaagcccctttacgatgccaaggtgcaaccaaccaccttgataccaaagcaagttggcaacatgtacacagcatctctgtacgctgcgtttgcatctcttcttcacaacaaaaacagtgaactggcaggaaagcgggtaatattattctcatacggaagtggactgactgccacaatgttttcattgcgactccatgaaggtcaacatccttttagcctatcgaacattgcgacggtgatgaatattgctggaaaattgaagtctaggcatgatttgcccctgagaagttcgtcgagactatgcacctcatggagcataggtatggagctaaagactttgtgactagcaaagactgtagccttttgtctcccggaacatactacctcaccgaagtcgattctaagtaccggagattctacgcaaagaaggacgggaactgtactggtaatgagaatggttctgttgtcaatggtcactgaagaagaacagatttaccaagaactgggttcccatttgtaagttgaaaacgacatagttccaagtagcagcaaatccctttttcaaccctattttcatttttcaatcttgtttgtaataagttcattgtaaacccagttttacctatgttgaaacaaatagttggcaatatattggtgaatttacatgaga

SEQ ID NO: 1264 - DNA, 1858 bp, Actinidia deliciosa
ctctctctctgtgcgattttgcaggattccctctcctctctctaaatattccctctctttctcgccagaggagctaagtgaggggaaatcggtgattctttcgatctgtttgtttctcgagaatttgaagtaacagagccgagaaagggagaaacagagatggcctcgcaaccgaagaatgttggaattctcgccatggaaatctacttccctcctacttgtgtccagcaggaagaaatggaggttcatgatggcgcaagcaaagggaaatacacaattgggcttggacaagattgcatggcattttgtacagacgtggaagatgtcatctccatgagtttgactgttgttacttccctccttgagaagtatggcgttgatccggcacaaattggtcggcttgaagtggggagtgagactgttattgacaagagcaagtccataaagactttcctgatgcaaatctttgaggaaagtggaaatactgacattgaaggtgtggactcaactaatgcttgctacggaggaactgcagctttgctcaactgtgtcaattgggtggagagctgttcatgggatggacgatatggacttgtggtctgcacagacagtgcggtctatgcagagggaccagctcggcctactggaggagcagctgctattgctatgcttatagggcctgatgctcctatagcatttgaaagcaaattcaggggaagccatatgtctcatgtctacgatttttacaagcccaaccttgcaagtgaatacccggtggttgatggaaagctctcacagacttgctatctcatggcacttgattcttgttacaaacgattttgtcacaagtatgaaaaattggaaggcaagcaattttcagttgttgatgctgactattttgtgtttcattccccatacaacaagcttgttcagaagagctttgccaggttgcttttcaatgatttctcgaggaatgcaagctctgttgatgaggctgctaaagaaaagctagcaccattctcaactctaactggagatgaaagctaccagagccgtgatcttgaaaaggcaacccagcaagttgcgaagcctttttatgatgcaaaggtgaaaccagccacattggtaccaaagcaagttggcaacatgtataccgcatctctctacgcagcgtttgtgtcgcttattcacaacaagcatacctcactggcaggtcagcgggtggttatgttctcgtatggcagcggtttaagtgccactatgttttccttccaaatccgtgagggtcaacatccttttagcttgtcaaacattgcaaccgtgatgaatgttggtggaaaaatgaagtctaggcatgagttcccgccagaaaaatttgtggaaacaatgaagctgatggagcacaggtacggggccaaagactttgtgaccagcaaggactgcagccttctagctccaggcacctactacctcaccgaagtcgactccatgtaccgaagattctacacaaagaaggctggaaccgacaccaccaatactggttgcgagaacggatcagtggccaacggtcattgttgatcagtggctacgaaacgttatgccagaatttggttcaaccagtttttagaagaataaatgtgcttcttgggcatgttctgtgtagcaaatagtttgtttagctgaagtgttacctgcttatttgtactcaaattcatctctctctctctccctgctcaaatgtttagagcatcaatcatagaaactcgtttctgtcccttacgcctattattcgatgagtgtaacattctcaatattttctaaatataaatgaaaatattattgagctaaaaaaaaaaaa

SEQ ID NO: 1265 - DNA, 1979 bp, Citrus sinensis
ggaaataatcaagaaacagaacaaactttttaatttatctatttttgttttgttaaaaaaaacacgaatactgaattttttttttaaaaaaatgataaaatttcactataaatacggaagaagaattacagatgcgagcatcgccaattttctctccgaatatcgaggcctgtctttctttctgtctctgaacggctagctgggctacgttttacaaactcaagccaacagcagagcaagaaagaaagcaaagcaacgcaaaacacattttcgttgttgtgctgttttcttgatacatatatatatttacatatatttttcatctgggcattttctgtttttgaaaaccagataaaaacaatggcaaagaatgttggaatcctcgctatggacatctacttccctcctacttgcgtccagcaggaagctttggaggctcatgatggtgcaagcaaaggaaaatatacaatcgggcttggacaggagtgcatggcattttgttcagaggtggaagatgtcatctcaatgagcttgacagctgttactaacctcctagagaagtataagattgatccaaaacaaattggtcgtctcgaagtaggaagcgaaactgtgatagacaagagcaaatccattaagacttttttgatgcaaatttttgagaaatttggaaatactgacattgaaggtgttgactcgaccaatgcctgctacggaggaactgctgcattatttaactgtgtgaattgggtggagagtagttcatgggacgggcgctatgggctcgttgtgtgtaccgacagtgcggtttatgcagaaggaccagcaagacccactggaggagcagctgctgttgtcatgttagtagggcctgatgcccctgttgcttttgaaagcaaattaagggggagtcatatgtctcatgcctatgatttctacaagccaaaccttgctagtgaatatccggttgttgatgggaaactttctcagacatgctacctcatggctcttgatacttgttacaaatgtttatgcagcaagtacgagaaactggagggaaaacaattttctctttctaatgctgattatttcatgttccattctccatataacaagcttgtacagaaaagctttgctcgtttgttattcaatgactttatgaggaatgccagttctgtcgacgaggctgccaaagaaaagctgggaccattttcaaccttgtctggtgatgaaagctaccaaagccgggatcttgagaaggtttcccaacaacttgcaaagcccctttatgacgcaaaggtccaaccatccactttaataccgaagcaagttggtaacatgtacacagcatctctgtatgcagcattggcttcccttattcacaacaaacacagtgaattggatggcaagcgagtggttttgttctcgtatggaagtggtttgactgcaacgatgttctcattgaaactcagtgaaggtcatcatcccttcagcttgtcaaacatcctatctgttatgaatgttgcagggaagttgaaatcaaggcatgagtttcccccagagaagtttgtggaagtcatgaagctaatggagcatagatatggagccaaagactttgtaacaagcaaagacagtagccttttggctccaggaacatactatctcactgaagttgactccatgtaccggagattctatgccaagaagcctgcagatgttaccaactgcgagaatgggtcacttgcaaatggtcactaagggtgatcaaattattatttgtatcgccagaatttgattcatcctgttcaattgttgtttttaattaagcagattggtgttgccagtacttaaaaaatatccgtgcttccttgagtttgtgatgcaaaagcaaatagtagttgttcgtctgcaggcatgcgatcagtggtgaattgttttctttgtaataaaagtttccgaaatgccttgatttagcaaaa

SEQ ID NO: 1266 - DNA, 1894 bp, Fragaria vesca
  misc_feature (1464)..(1464): n is a, c, g, or t
  misc_feature (1504)..(1504): n is a, c, g, or t
  misc_feature (1570)..(1571): n is a, c, g, or t
  misc_feature (1588)..(1588): n is a, c, g, or t
  misc_feature (1605)..(1605): n is a, c, g, or t
  misc_feature (1646)..(1646): n is a, c, g, or t
ctttgagagtcacactgctatataaacccagccaaccccctcccaaaacgtaaaccacttctcattttccgacgactctcatttctctctgctagcctcttccagctcacagagtccaagcgcgcatttggatctttagacttcgccggagatatggccaagaacgttggaattctcgccgtcgacatctacttcccccctagctgcatccagcaggaagccttggaggcacatgatggagcaagcaaggggaaatacactattggacttggacaagactgcatggcgttttgttccgaagtggaagatgtcatctccatgagtttgacagtggtcacaaaccttcttgagaagtatggggttgatccaaaacaaattggtcgcctggaagttggcagcgagactgtgatagacaaaagcaaatccatcaagaccttcctgatgcaaatttttgagaaacatggaaatactgacattgaaggtgtcgactcaactaatgcatgctatggaggaactgctgctctattcaactgtgtcaattgggtggagagtagctcatgggatggtcgctatggacttgttgtgtgcaccgacagtgcggtctatgcagaaggaccagcacggccaaccggtggagcagctgctattgccatgcttattggacctgatgctcctattgcttttgaaagcaaaattagggggagtcatatgtctcacgtctatgacttttacaagcctgaccttgcgagtgaatatccggttgttgatgggaaactatctcaaacatgttatctcatggcccttgattcttgctataagcaattatgtaaaaagtatgagaaaattgaaggcaaacaattttccatctccgacgccgagtactttgtatttcattccccatacaacaagctcgtacaaaaaagctttgctcgtttggtgttccaagactccctcaggaatgcctgttccattgatgaggctgctaaagaaaagtttgcaccattcgccagcctatctagtgatgagagctatgcaagccgggatcttgaaaaggtagcccagcaagttgctaagcccctatatgacgccaaggtgcaacccacaactctggtaccaaagcaagttggaaacatgtacactgcatctctttatgctgcatttgcttccctccttcacaacaaacacgactcattggatggcaagcgtgtgatactgttctcatatggaagtggttcaactgcaaccatgttctcgttgcaactccgtgccggtcaacatccgttcagcttgaaaaacattgcagctgtgatgaatgttggagagaagttggagtcaagacatgagttcgctccagagaagttttgtgaaatcatgaagatcatggagcacaggtatggaggcaaagactttgtgaccaacaaggacattagccttctacttccaggcacattctacctcactgangtcgactctaagtatcgtagattctacgcccagaaggatngtgctgagaatggtgtggttgccaatggtcactgattcgtcgaaatatcgcaagtctcctagattnncagttgtaactcgaatnccctgcactctattaantctgtatgttaagagcaaatagtttgtttggcagcaagtgntgtcaaattaaattattttttttcttttttattaataaattgttcaataattgtttagaattaagtcgaaaaagagtgttgtgacttgggagcatctccatgccgatgatgacgatatttgtaccgagtcaaagtccttgacatttagccatgtctctataccttcttgtacttgtactgtaaagctctttactaaattgattggaacccctgccatacaatgaaattatgaatgtgcaagtttgagt

SEQ ID NO: 1267 - DNA, 1787 bp, Gossypium hirsutum
accatcgattctctgccgatacttgctggatcaatatcaactcatcagaaagagaaaaagaatagatttttttcaatcaataaagaagaagacttcctttttgtattgttgacatagcggttctctgtttactttggagtgagaatggcaaagaatgtgggagttctagctatggaaatctacttccctcctacctgtgttcaacaggaagcattggagactcgtgatggtgcaagcaaaggaaaatacaccattggacttggacaagattgcatggccttttgtaccgaggtcgaagatgttatctcaatgagtttgactgctgttacttcactccttgaaaagtatacgattgaccctaagcaaattggccgtttcgaagttgggagtgagactgtgatagacaagagcaagtccattaagactttcctaatgcaaatctttgagaaatgtggtaacactgacattgaaggggtggactcaacgaatgcttgttatggagggactgcagctctattcaactgtgtcaattgggtggaaagtagttcatgggatggacgatatggtcttgttgtttgtactgacagtgcggtctatgcagaaggacctgctcggccaactggaggagcagctgcaattgctatgctagtagggcctgatgctcctattgtttttgaaagcaaatttaggggcagtcatatgtctcatgcctatgacttttacaaacccaaccttgctagtgaatatcctgttgttgatgggaaactttctcaaacgtgctatctcatggctcttgatacttgctataagtatttctgttacaagtatgagaaactagagggcaaacaattttccatttctgatgctgactacattgttttccattctccatataacaagcttgtgcagaaaagctttgctcgtttgttgttcaatgacttcatgaggaatgccagttctgttgatgacattgctaaagaaaaattgagtccattttcaaatttgactggtgatgaaagctaccagagcagggatcttgagaaggtatcccaacaagtttcaaagtccctttatgatgcaaaggtgcaaccaaccaccttgataccaaagcaagttggcaatatgtataccgcatctctttatgctgcatttgcatcccttattcacaacaaacatagtgaattggctggaaagcgggtaatattgttctcgtatggaagtggtctgacttccacaatgttttcattgcgactccatgaaggtcaacatccctttagcctatcaaacattgcaacggtaatgaatgttgctgggaaattgaagtggaggcatgagttccctcctgagaagtttgttcagacaatgaagctgatggagcatagatatggagccaaggattttgtgacgagcaaggactgcggccttttgtctccaggaacgtactacctcaccgaagttgattctatgtaccggagattctattcaaagaaggatggggactatactgtctgtgagaatggatctcttgctaacggacattgaagaaccgagaggaagacggctttggcttggctaagatgcgttacctcgtgtgtatgttaaagaaaaaaaatgttacatttagcagtaaatccgttttttcagcttattctcgttttttccaccctagcttctaataagttatgtaaaccagtttacttgtgttaaaacagagtagttggcaagttcttgaagatttaataagattttatttacattcatacaaaaagaaaaaagtaccgactgcg

SEQ ID NO: 1268 - DNA, 1696 bp, Cucumis melo
cttccagaaatggctaacaatgtcggaattctcgctatagatatctacttccctcctacctatgttcagcaggaagcattggaagctcatgatggtgcaagcaaggggaaatacactattgggcttggacaggattgcatggcattctgtactgaggttgaagatgtcatctcaatgagcttgacagttgtcaattctcttcttgaaaagtatggaattgatccgaaacaaattggccggctagaagtaggcagtgagactgttatagataaaagcaaatcaattaagactttcctgatgcaaatatttgagaagcatggaaataccgatatcgaaggtgttgattcaaccaatgcgtgctatgggggtacagctgctctcttcaactgtgtcaactgggtagagagcagctcctgggatgggcgttatggtctcgtggtgtgcacagatagtgcggtctacgctgaaggaccagctcgtcctactggtggggctgcagctattgccatgctgataggacctgatgctcctattgcttttgaaagcaagttgaggggaagccatatgtctcacgtttatgatttttacaagcctaacctagccagcgaatacccggttgttgatggtaagctctctcaaacatgttacctcatggccttggattcctgctacaaacaattatgtcataagtatgagaaactggaaggcaaacaattttccatttctaatgccgactatttcgtatttcattctccctataacaagcttgtgcagaagagctttgctcgattactctttaatgacttcaagagaaatgctagctcaatagacgtagctgctaaagaaaagctggccccattttcagccttgtctaacgatgaaagttaccagagtcgggatctcgaaaagataactcaacaacttgcaaagcctctttatgatgcaaaggtccaaccctccactttgataccaaagcaagttggaaacatgtatactgcctctctctacgcagcatttatatcacttcttcacaacaagaataactcgctggtaggaaatagggtggtattgttctcttatgggagcgggtcaactgcaacgatgttctcattgaaactcaatgaaggtcaaaatccctttagtttgtccaacatttcagctatcttgaacgtggataaaaagttgaaatcaaggcacgagttggtacccgagaaatttgtcgaaataatgcagctgatggagcatcggtacggggccaaggacttcgtgacgagcaaggactgcagcctgctatcaacaggcacctactatctcactgaagttgattcgttgtacaggagattctacgccaagaaggaaggcggaagtgaaaagattgagaatggtgtggttgctaatggccactgaaatcataacaacaaataaacaagtggactgaagccaaatgctgtgctcttcatttgattattgtaagtgtcaacaagaatttttctttatcataagttatttacaagctaagctaagctatagaaggcagtacgttcacaacttgtagttttctgtcgttctttcttccctttttttttctcccttcctgttaggaaaattgtctcaataattggttgcttttatttattcacaagataaaatgtaatgttgttgatgatgtaatgtagagactccttccccccccccc

SEQ ID NO: 1269 - DNA, 1966 bp, Gossypium hirsutum
  misc_feature (1412)..(1412): n is a, c, g, or t
  misc_feature (1601)..(1601): n is a, c, g, or t
  misc_feature (1631)..(1631): n is a, c, g, or t
acagttcctcaccaacgttgctctcagctgagtttcggggaaacaaaaaggaagcatcattttcttaatccaagaaaaaatatcccttttcgttttaatctttgttgtagctaatccatcatcgttcgcgtgagagaaaaatggctaagaatgtgggaattattgctatggatatttacttccctcctacctttgttcaacaggaagccttggaggctcatgatggcgtgagcaaaggaaaatacaccattggacttggacaagattgtttggccttctgtactgaggtcgaagatgttatctcaatgagtttgacagttgttacttcactccttgagaagtataagattgaccctaaacaaattggccgtcttgaagttggcagcgagactgtgatagacaagagcaagtccattaagactttcctaatgcaaatttttgagaaatgtggaaacactgacattgaaggggtcgattcaactaatgcatgttatggagggactgcagctctgttcaactgtgtcaattgggtggaaagtagttcatgggatggacgatatggcattgttgtttgtactgacagcgcggtctatgctgaaggaccagcccggccaactggaggagcagctgcaattgctatgctaatagggcctgatgctcctattgcttttgaaagcaaatttagggggagtcacatgtcccatgcctacgacttttacaagcccaaccttgctagtgaatatccggttgttgatggaaaactctctcaaacgtgctatctcatggctcttgatacttgctataaatacttctgtcacaagtacgagaaacaagagggcaagcaattttccctttccgatgctgactactttgtatttcattctccatataataagcttgtgcaaaaaagctttgctcgtttggtgttcaatgactttgtgaggaatgccagttctgttgatgacattgctaaagaaaagttggctccattttcaactttgaccggtgatgaaagctaccaaagcagggatcttgagaaggcatcccaacaagtttcaaagcccctttacgatgccaaggtgcaaccaaccaccttgataccaaagcaagttggcaacatgtacacagcatctctgtacgctgcgtttgcatctcttcttcacaacaaaaacagtgaactggcaggaaagcgggtaatattattctcatacggaagtggactgactgccacaatgttttcattgcgactccatgaaggtcaacatccttttagcctatcgaacattgcgacggtgatgaatattgctggaaaattgaagtctaggcatgagtttgcccctgagaagttcgtcgagactatgcacctcatggagcataggtatggagataaagactttgtgactagcaaagantgtagccttttgtctcccggaacatactacctcaccgaagtcgattctaagtaccggagattctatgcaaagaaggacgggaactgtactggtaatgagaatggttctgttgtcaatggtcactgaagaagaacagatttaccaagaactgggttcccatttgtaagttgaaaacgacatagttccaantagcagcaaatccctttttcaaccctattntcatttttcaatcttgtttgtaataagttaattgtaaacccagttttacctatgttgaaacaaatagttggcaatatattggtggaaaaaaaaaaaaaaaaaaaattccaagagtactttctaaaaggcgccccgcggggcccttccaattttcccccccgggggggggaacccaggtaaagtgggaccccatttcccccctataagggagtccaaattaaaaatttacctgggccggccgttttaccaacgccccgggaacggggaaaaacccctggggcttttcccccaacttttaatttcccctttgcccaccaaaccccccccttttcccc

SEQ ID NO: 1270 - DNA, 1514 bp, Cucumis sativus
atctttctctgctgttcgccaggatttcctcttctcttctctctctctcaaattttttcattctctcccatttcttcttcgtttgagcttccagaaatggctaacaatgtcggaattctcgctatagatatctacttccctcctacctatgttcagcaggaagcattggaagctcatgatggtgcaagcaaggggaaatacactattggacttggacaggattgcatggcattctgtactgaggttgaagatgttatctcaatgagcttgacagttgtcaattctcttcttgaaaagtacggaattgatccgaaacaaattggccggctagaagtaggcagtgagactgttatagataaaagcaaatcaattaagactttcctgatgcaaatatttgagaagcatggaaataccgatatcgaaggtgttgattcaaccaatgcgtgctatgggggtacagctgctctattcaactgtgtcaactgggtagagagcagctcctgggatgggcgttatggtcttgtggtgtgcacagatagtgcggtctatgctgaaggaccagctcgtcctactggtggggctgcagctattgccatgctgataggacctgatgctcctattgcttttgaaagcaagttgaggggaagccatatgtctcacgtttatgatttttacaagcctaacctagccagcgaatacccggttgttgatggtaagctctctcaaacatgttacctcatggccttggattcctgctacaaacaattatgtcacaagtatgagaaactggagggcggcaaacaattttctctttctaatgctgactattttgtgtttcattctccctataacaagcttgtgcagaagagctttgctcgattactctttaatgatttcaagagaaatgctagctcaatagacgaagctgctaaagaaaagctagccccattttcaaccttgtctaacgatgagagttaccagagtcgggatctcgaaaagataactcaacagcttgcaaagcctctttatgatgcaaaggtccagccctccactttgataccaaagcaagttggaaacatgtatactgcctctctctacgcagcatttatatcacttcttcacaacaagaataaatcactggtaggaaatagggtggtattgttctcttatggaagcgggtcaactgcaacgatgttctccttgaaactcaatgaaggccaaaatccctttagtttgtccaacatttcagctatcttgaacgtggataaaaagttgaaatcaaggcacgagttggtacccgagaaatttgtcgaaataatgcagctgatggagcatcggtacggggcgaaggacttcgtgacgagcaaggactgcagcctgctatcatcaggcacctactatcttactgaagttgattcgttatacaggagattctacgccaagaaggaaggcggaagtgaaaagattgagaatggtgtggttgctaatggccactgaaataataacaacaaata

SEQ ID NO: 1271 - DNA, 1903 bp, Castanea mollissima
cgattttgaagctcttcctttctctctcctaaactcttcccttttcctaacgaatcgagcgagcgagagagagagagaagagagaggcgaatttgctgttctgatcttctgagttttattgagaatcaaatcgtttcaaagtttgcttgtgaagtgaaaggcaaaaatggcaaagaatgttggaattctcgccatggatatctacttccctcctacctgtattcagcaggaagtattggaggctcatgatggtgcaagtaaagggaaatacactattggactcgggcaagattgcatggcattttgtactgaggtggaagatgtcatctcaatgagtttgacagtggttacctccctccttgagaaatatggggttgatcccaaacaaattggtcgtctggaagtaggcagtgagactgtaatagacaagagcaagtccattaagaccttcctgatgggaatctttgagaaatgtggaaataccgacattgaaggcgttgactcaactaatgcatgctatggaggaactgcagctttactcaactgtgtcaattgggttgagagcagttcatgggatggacgctatggacttgttgtgtgcactgacagtgcggtctacgcagaagggccagcccgaccaactggaggtgcagcagctatcgccatcctaataggacctgatgctcctatttcttttgaaagcaaagttagggggtctcatatggctcatgtctatgatttttacaagccaaaccttgctagtgaatatccggttgttgatggcaagctttctcaaacatgctatctcatagctcttgattcttgctacaaacaaatgtgtaacaagtatgagaaacttgaaggaaaacaattttctctttctgatgctgactattttgtttttcattctccatataacaagcttgtacaaaaaagttttgctcgtttgttgtatgatgacttcttgagaaatgccagctccatcgatgaggctgccaaagaaaagctggcaccatttttgacgttatctggtgacgaaagctaccagagccgggatcttgaaaaggtaacccagcaacttgcaaagtccctatatgatgcaaaggtgcagccaaccactttgataccaaagcaagttggcaacatgtacactgcatctctctatgcagcttttgcatcccttcttcacaataagaatagtgcattggtgggcaagcgagtgatactgttctcatatggaagtggctcaagtgctacaatgttttcattgcaactccgtgaaggtcaacatccctttagcttgtcaaacattgccaatgtgatggatgttgcaaggaagttgaaatcaaggcatgagttcccaccagaaaaatttgttgaaactatgcacctaatggagcaaaggtatggagccaaggactttgtgacaagccaggacattagccttttatctccaggcacatactatctcactgaagttgactccaaatatcggagattctatgcaaagaaggctggggactatacaactggcaccgcctgtaagaatggttctcttgttaatggtctgtgagatgaacataatacagcatgcaatgccaggaagttggcttttgtgttcctaattcttagttgttatgtgttctttacttcttagttgttagaagtaagaagaatatcattccataagtttgtattctaaagaaattagtgtgttgagtagtaagtgttgtaaggttaatttatttttcctcttcctttcccccattttcattgaaggttatctcaataatcattaccttcattcaaaccaaaatgccttctccctggataatgaaaatgtaacaaatgctgaagatgataattatcttttcaccttcccaacttggtgtacctatatgtg

SEQ ID NO: 1272 - DNA, 1990 bp, Cajanus cajan
ggggggtggtgggtgttcacgaagtctgcattttcgccctatggcttgggaagcatgagatgaaagaggggatctgcttaaggctggtgcacctcaccacagcagaatctttggaggggttggtgggtgctgtgtttcttagttgtattgtattcctatatatataggattatatgcaagagagactttacttcctttggaacacaaatggcaaagaatgttgggattctcgccattgacatctacttccctcccgcatgcgttcagcaggcagcattggagactcatgatggtgtcagtaaagggaagtataccattggacttggacaagattgcatgtcattctgtaccgaagttgaagatgttatctcaatgagtttgactgtggttacttcccttcttgagaagtatgagattgatcctaaacaaattggtcgtctggaagttggaagcgagactgtgatagacaaaagcaaatccatcaagacattcctaatgcaaatctttgagaaatatggaaacactgacattgagggtgttgattcaactaacgcatgctatggaggaactgctgctctgttcaattgtgtcaattgggtggagagcaattcatgggatggacgctatggacttgttgtctgcactgacagtgcagtctatgctgaaggacctgctcgacctactggaggagctgctgctattgccatgctaattggtcctgatgctcccatttcttttgaaagcaaattgagaggaagtcatatgtctcatgcttatgatttttacaagcctaatcttgctagtgaatatccagttgtcgatggaaagctttcacaaacttgttacctcatggctcttgattcttgctataagcatttgtgccataagtatgagaaatttgagggaaaacaattttctctttctgatgctgaatactttgtatttcactctccttataacaagcttgtacagaagagttttgctcggttgttttttgatgatttcttgaggaatgccagctctgtggatgaggttgccagagaaaagctgggaccttttgcaactttatctggtgatgagagctaccaaagtcgggatcttgaaaaggcatcccagcaagttgcgaagcctctatatgatgagaaggtacaaccaactactttgattccaaaacaagttggcaacatgtacactgcgtctctctatgcagcatttgcatcccttattcacaacaaacatagcacattggcaggtaatagggtgatattattctcatatggtagtggcttaactgccacaatgttttctttgcgatttcaagacggtgaaggcccatttagcttgtcaaacattgctagagtgatgaatgttgatggaaaattgaaatcaagacacgaggttcatccggaggagtttattgaaaccctgaagctaatggagcataggtatggtgcgaaggagtttgtgacaagcaagaacgatagccttttatctcctggcacattctatctcacagaagttgactccatgtatcggaggttctatgcaacgaaagctagagaaagcagtttgacttccgctgtgaacggtttggtcgctaatggccactgatgttgagcatgtacaactagctgtcaacttagcctaaaattaaggggtattgttatttcgataacataatggaagattggaaggtaaatcgtttctggggtggcaactgttctcagttcaaatacttcattgtactctttaaagatgtgtttactcaaagtctatatattatcattttcggtgtatttttttgcattttaatgaatgcaaattagtctttgaataaaaaaataatttttagggatattcatcgagatcttttctaatatttatcctaagtgtctttcttgtcttatatctgttttacatggtttaaaaccattgagaactcttcatcagtgtctccagtttttcaggagttaaattactttaatcaaat

SEQ ID NO: 1273 - DNA, 2060 bp, Quercus alba
ggggagagagagagagaggcagagaggtcctatataaacccggagcagcttcatgttagcctcaccctcccattttctctgcgatttcgaagctcttcctttctctctctcttctaacctcttcctcttcctcttcccttttgtaacgaatctagcgagagaagagagaggcgaatttgttgttcggatcttcttctttttttgagaagtcaaatcgtttcaaagtttgcttctgtgaagtgaaaggcaaatatggcaaagaatgttggaattctcgccatggatatctacttccctcttacctgtattcagcaggaagtattggaggctcatgatggtgcaagtaaagggaaatacactatcggactcgggcaagattgcatggcattttgtactgaggtggaagatgtcatctcaatgagcttgacagtggttacctccctccttgagaaatatggagttgatcccaaacaaattggtcgtctggaagtaggcagtgagactgtaatagacaagagcaagtccattaagaccttcctgatgggaatctttgagaaatgtggaaatactgacattgaaggcgttgactcaactaatgcatgctatgggggaactgcagctttattcaactgtgtcaattgggttgagagcagttcatgggatggacgctatggacttgttgtgtgcactgacagtgcggtctatgcagaaggaccagcccgacctactggaggagcagcagctatcgccatcctaataggacctgatgctcctatttcttttgaaagcaaagttagggggtctcatatggctcatgtctatgatttttacaagccaaaccttgctagtgaatatccggttgttgatggcaagctttctcaaacatgctatctcatggctcttgattcttgctacaaacaaatgtgtaacaagtatgagaaactggaagggaaacaattttctctttctgatgctgactattttgtttttcactctccatataacaagcttgtacaaaaaagttttgctcgtttgttgtatgatgacttcttgagaaatgccagctccattgatgaggctgccaaagaaaagttgggaccattttcgaccttatctggtgacgaaagctacaagagccgggatcttgaaaaggtaacccagcaacttgcgaagtccctatacgatgcaaaggtgcagccaaccactttgctaccaaagcaagttggcaacatgtacactgcatctctctatgcagcttttgcatcccttattcacaataagaatagtgcattggcgggcaagcgagtgatactgttctcatatgggagtggctcaagtgctacaatgttttcattgcaactccgtgaaggtcaacatccctttagcttgtcaaacattgccaatgtgatggatgttgcaaggaagttgaagtcaaggcacgagttcccaccagacaaatttgtcgaaacaatgcacctcatggagcacaggtatggagctaaggactttgtgacaagcaaggacattagccttttatctccaggcacatactatcttactgaagttgactccatgtatcggagattctatgcaaagaaggacggggatagtacaactggcaccccctgtgagaatggttctcttgttaatggtcagtgagatgaacataatacagcatgtagccaagaagttggcttttgtgttcttaattcttagttgttatgtgttctttacttcttagttgttagaagtaagaacatcgttccgtaagtttgtattctaaagaaattagtgtgttgagtagcaagtgttgtaaggttaatttatttttcctcttccttttccccattttcattgaaggttatctcaataatcattaccttcattcaaaccaaaatgtcttctccctggataatgaaaatgtaacaaatgctgaagatgataatcatcttttcaccttctcaaattggtgtacctataatgtgctgcttgcttgtgttgttttcacgacccttatgaagagaaaaatgttgcaagtgcaatcaattataacaggttta

SEQ ID NO: 1274 - DNA, 1825 bp, Vitis vinifera
aactcaccaagtctgcatttggagggatctctcctgcctctctatatatttcaacggcaacttatgacccatccttacacacctctctgctggtttccaggattctcctttcgctccctctctttctctctctagattgagagagaaataatttctccttttttttcatttaccaactttctcgagaaactgagctcggagaaaatgacgaaaaatgtgggaattctcgccatggacatctacttccctcctacctgtgttcagcaggaagctctggaagttcatgatggtgcaagtaagggaaagtacactattggacttggacaagactgtatggcattctgttcggaggtggaagatgtcatctcaatgagtttgacagttgttacctccctcctcgagaaatatgggattgacccaaaacaaattggtcggctggaagtaggcagcgagactgtgatagacaaaagcaaatccattaagactttcctgatgcaaattttcgaggaatgtggaaataatgacatcgaaggtgttgattcaagtaatgcatgctatgggggaactgcagctttattcaactgtgtcaactgggtggagagtagttcatgggatggacgctatggacttgttgtttgcacagacagtgcggtttatgcagaaggaccagctaggcctactggaggagcagctgctattgctatgctagtagggcctgatgctcctattgcatttgaaagcaaattgaggggaagtcatatgtcacatgcatatgatttttacaagcctaatcttgctagtgaatatccggttgtcgatgggaagctttcacagacttgttatctgatggcacttgattcttgctataaacttttgtgttccaagtatgagaaattggagggcaagcaattttccattgctgatgctgactacttcgtatttcactctccatataataagcttgtacagaaaagttttgctcgattagtgttcaatgatgtcgtgagaaatgccagttctgtcgatgaagctggtaaacaaaagctggaacctttttcaagtttatccggtgatgagagctaccaaaaccgggatcttgaaaaggcatcccaacaagttgcaaagccactatatgatgcaaaggtgcaaccatctactttgctacccaagcaagttggcaacatgtacactgcatctctctatgcagcatttgtatctgttcttcacaataaacatagtgagttgagtggcaaacgggttgtaatgttctcatatggaagtggtttaactgcaacaatgttctcatttcaacttcgtgatggtcaacatccctttagcttgtcaaacattgcaactgtgatggatgttgctggaaagttgaaggcaaggcatgagtttcctccagaaaaatttgtcgaaatcttgaagttaatggaacataggtatggggccaaggactttgtgacgagtaaggactgtagccttttacctccaggcacccactatcttactgaagttgattccatgtaccggagattctacagcaagaaggctgggagctgcacctgtgagaatggttcactggccaatggtcactgataacaaacaacagatgtaatgccaggaggttggctgaaatgtttttatatgttgttgtctgcaactagagaaaatctatgctccatagctttgtttcataaagcaactagcttgttccacctttaagtgttgtcacttttaattgtcttcagtggaattctttttatctgtgacccttcacctctcttttatctcatttaagtctgctttagcttcatttttgccc

SEQ ID NO: 1275 - DNA, 1677 bp, Glycine max
atggcaaagaatgtggggattctcgctatcgacatctacttccctcccacctgtattcagcaggaattgctggaggctcatgatggtgccagtaaagggaaatatactattggacttggtcaagattgcatggcgttttgtacagaagtagaagatgtcatctcgatgagtttgacagtagtttcttcccttcttgaaaagtatgcgattgatcctaaacaaattggtcgtctggaagtaggcagtgagactgtgattgacaaaagcaaatccatcaaaactttcatcatgcaaatctttgagaaatatggaaataccgatattgagggcgttgattcaactaatgcatgctatggaggaactgctgctttgttcaattgtgtcaattgggtggagagcagctcatgggatggacgctatggacttgttgtctgcactgacagtgctgtctatgctgaaggacctgctcggcctactggtggagccgctgctgttgccatgctaattggtcctgatgctcccatttcttttgaaagcaaattgaggggaagtcatatggctcatgcctatgatttttacaagcctaatcttgccagtgaatatccagtggttgatgggaagctttctcaaacttgttaccttatggcccttgattcttgctataatcacttaagtcacaaatatgagaaacaagagggaaaacaattttctatttctgatgcagaatactttgtatttcactctccatacaacaagcttgtacaaaaaagttttgctcgtttggtgttcaatgacttcttgaaaaatgccagttttgtggatgaggctgccaaagaaaagctggaaccttttgcaacattatctggtgatgagagctatcaaagccgggatctagaaaaggcatcccagcaagttgcaaagcctcaatacgatgcaaaggtgcagccaaccaccttgataccgaaacaagttggcaacatgtacaccgcatctctttatgcagcctttatttcacttattcacaacaagcatagcacattggatggtaagagggtaatattgttctcgtatggaagtggcttaacttccacaatgttctctttgctattacgtgaaggtcaacatccatttagcctgtcaaacattgataaaatgatggatgttgctgggaaattgaagtcaagacatgagtttccaccagagaaatttgttgaaaccatgaagctaatggaacataggtatggtggcaaggagtttgtaacaagcaaggacaccagccttttatctccaggcacattctatctcactgaagttgactccatgtataggagattctatgcaaagaaaactagtgaaaatggtttggtcaccaatggtcactgacgttttacttagagaacgtgtaatacctggaaaccaggaattcaactgtgcttagcatttagaaggctgttctcgtttggattagtttcttcttaagggaagacaaacgaacaattatgaaatctgtaggagccaggtgttgttagttcaaaaattttccgaaactcttcaagtttaaatgattccaccaaaaattgtttctagcaattatgcttttgaatatgtagagcactgtgaaggattggacgttataagtttgagtactcggtattctgttaacgaagggggtcgcag

SEQ ID NO: 1276 - DNA, 1924 bp, Prunus persica
gagagagcgagagagcgaggtctcttccctatatatacccagcgaagcctcccaaacgtaaagcacctccactcctccacacatctctctctccctctctctgcgaattccttggattctgtgcgagactcccatttctcgctctcgttctcttcctaagctcagcttgaccaacagctagagacagcggaaggcatttcgggatctcccagatattttggtgagggatttcatttgaagtgactcgcgaggaagaagaagaagaagaagcaccggagaaagaaatggccaagaacgttggaattctcgccgccgatatctacttccctcctacctgtattcagcaggaagccttggaggctcacgatggtgcaagcaaaggaaagtacactatcggacttggacaagattgcatggcattttgttcagaggtggaagatgtcatctccatgagtttgacagtggttacctcccttcttgagaaatatgggattgatccaaaacaaattggtcggctggaagtaggcagcgaaactgtcatagacaaaagcaaatctattaagaccttcctgatgacagtttttgagaaacatggaaatactgacattgaaggtgtcgactcaactaatgcatgctatgggggtactgcagctttattcaactgtgtgaattgggtggagagtagctcgtgggatggacgctatgggcttgtcgtgtgcactgacagtgcggtctatgcagaaggaccggcccgaccaactggtggagcagctgctattgctttgctgattggacctgatgctcctattgcttttgaaagcaaaattaggggaagtcatatggctcacgtctatgatttttacaaacctgaccttgctagtgaatatccggttgttgatggaaaactttctcaaacatgttatctgaaggctcttgattcttgctacaaggaattatgtaaaaagtatgagaaattggaaggcaaacaattttctctggctgatgctgagtatttcgtatttcattctccttataacaagcttgtacaaaaaagctttgcccgtttggtattcaatgactccgtgaggaatgccagctccattgatgaggccgctaaagaaaagctggccccatttgcgagcctccctggtgatgagagctaccaaagccgggatcttgaaaaggtatcccagcaagttgcaaagcccctatatgacgctaaggtgcaaccaacaactttggtgccaaagcaagttgggaacatgtacactgcatctctttatgcggcatttgtatcactcctccataataagcacagctcattggatggcaagcgggtgatactcttctcttatggaagtggctcaactgctactatgttctcgttgcgcctcaatgccggtcaacatccctttagcttggagaacattgcagcagtgttgaatgttggagaaaagttgaagtcaagacatgagttccctcccgagaagtttgttgaagttatgaagatcatggagcataggtatggaggcaaagactttgtgacaaaccaggacattagccttctacttccaggcacatactatcttactgaagttgactctaagtaccgtagattctacgccaagaaggaaggaggcagtactgccgccgtcacctccaatgagaatggtgtggttgccaacggtcactgatgaacatatccaagtctgtaaatgccaagaagtaggcatttatgttattagatgtcagttgtaactcgtaaagcagaacatcatacatctccggcttccattaagtttgtacgttaaaagcaaatagtttgtttcgcagcaagtgttgacaggttaaaattgttattattattattattttttctttttgataataaattgttcaataaaaattagtttcgcgattgtta

SEQ ID NO: 1277 - DNA, 1880 bp, Malus domestica
ctataaaatacagcgaagcctcccatttgtacagcacctccaaacctccacacatctctctctctctactctttctctctctaaactcagctcgacgagggattttgattcgtcggagtgactcgaacgaacgccggagaaaatggccaagaacgtcggaattctcgccgtcgacatctacttcccccctacctgtattcagcaggaagccttggaggctcatgatggtgccagcaaggggaagtacacaatcggacttggacaagattgcatggcgttttgttcagaggtggaggatgtcatctcaatgagtttgacagtggttacctcccttcttgagaaatatgggattgatccaaaacaaattggtcgcctggaagtaggcagtgagaccgtgatcgacaaaagcaaatctattaagaccttcctgatgacaatttttgagaaacacggtaacactgacattgaaggtgttgactcaactaatgcttgttatggaggaactgcagctttattcaactgtgtcaattgggtggagagtagctcatgggatgggcgctatggacttgtcgtgtgcactgacagcgcggtctacgcagagggaccggcacgaccaactggtggagcagctgccattgccatgctgattggacctgatgctcctcttgcttttgagagcaaaattaggggaagtcatatggctcacgtatatgatttttacaagcccgaccttgctagtgaatatccagttgttgacggaaagctttctcagacttgttatctgaaggctcttgattcttgctacaaggaattatgtaaaaagtatgagaaattggaaggtaaacaattttctatcgctgatgctgagtactttgtatttcattctccctataacaagcttgtacaaaaaagctttgctcgtttggtgttcaatgactccgtaaggaatgcaagctccatcgatgaggcgggtaaagaaaagctggctccatttgctgaccttcctggtgatgatagctacaatagccgggatcttgaaaaggcatcccagcaagtcgctaagcccctatacgacgctaaggttgtaccaacaactttggtaccaaagcaagttggaaacatgtacactgcatctctttatgcggcatttgtatccctcctccacaacaagcacagctccttggatggcaagcgggtgatactgttctcttatggaagtggctcaactgcaaccatgttctcattgcgtctcaatgctggtcaacagccctttagcttggagaacatcgcagccgtgatgaatgttggagagaagttgaaggcaagacatgagttccctcccgagaagtttgttgaagtgatgaagatcatggagcacaggtatggaggcaaagactttgtgaccaaccaggacattagccttctacttccaggcacatactatcttaccgaagtcgactctaagtaccgtagattctatgccaagaaggatgcggccgccaccaccaatgccaacggtgtggttgccaacggtcactgatggacgtaattcaagccggtcacatggttaagttgagatttatgttgctagatgccagttgtaactcgtaaaacagaacatgctggcctccctaagtttgtatgttaaaagccaatagtttgattggcagctaagtattgtcagcttaaaaaattgtttttgtttcttcttatttttctttttaataaaattgttgaatgataatgattgtccacgattgttgaaaaccaagatcataggcccatgatcacaagcccatgtctcgtagcttggttttctacttgtacttgcaaaagcattcttgaaaaagtacacacgaaatgattgctgcattcctgga

SEQ ID NO: 1278 - DNA, 1440 bp, Phaseolus coccineus
  misc_feature (715)..(716): n is a, c, g, or t
catctctctctctctactctttctctctctaaactcagctcgacgagggattttgattcgtcggagtgactcgaacgaacgccggagaaaatggccaagaacgtcggaattctcgccgtcgacatctacttcccccctacctgtattcagcaggaagccttggaggctcatgatggtgccagcaaggggaagtacacaatcggacttggacaagattgcatggcgttttgttcagaggtggaggatgtcatctcaatgagtttgacagtggttacctcccttcttgagaaatatgggattgatccaaaacaaattggtcgcctggaagtaggcagtgagactgtgatcgacaaaagcaaatctattaagaccttcctgatgacaatttttgagaaacacggtaacactgacattgaaggtgttgactcaactaatgcttgttatggaggaactgcagctttattcaactgtgtcaattgggtggagagtagctcatgggatgggcgctatggacttgtcgtgtgcactgacagcgcggtctacgcagagggaccggcacgaccaactggtggagcagctgccattgccatgctgattggacctgatgctcctcttgcttttgagagcaaaattaggggaagtcatatggctcacgtatatgatttttacaagcccgaccttgctagtgaatatccggttgttgacggaaagcttnntcagacttgttatctaaaggctcttgattcttgctacaaggaattatgtaaaaagtatgagaaattggaaggtaaacaattttccatcactgatgctgagtactttgtatttcattctccctataacaagctcgtacaaaaaagctttgctcgtttggtgttcaatgactccgtaaggaatgcaagctccatcgatgaggcgggtaaagaaaagctggctccatttgctgaccttcctggtgatgatagctacaatagccgggatcttgaaaaggcatcccagcaagtcgctaagcccctatacgacgctaaggttgtaccaacaactttggtaccaaagcaagttggaaacatgtacactgcatctctttatgcggcatttgtatccctcctccacaacaagcacagctccttggatggcaagcgtgtgatactgttctcttatggaagtggctcaactgcaaccatgttctcattgcgtctcaatgctggtcaacagccctttagcttggagaacatcgcagccgtgatgaatgttggagagaagttgaaggcaagacatgagttccctcccgagaagtttgttgaagtgatgaagatcatggagcacaggtatggaggcaaagactttgtgaccaaccaggacattagccttctacttccaggcacatactatcttaccgaagtcgactctaagtaccgtagattctatgccaagaaggat

SEQ ID NO: 1279 - DNA, 1844 bp, Prunus persica
  misc_feature (795)..(795): n is a, c, g, or t
  misc_feature (849)..(849): n is a, c, g, or t
  misc_feature (853)..(853): n is a, c, g, or t
  misc_feature (864)..(864): n is a, c, g, or t
ctcctccacacatctctctctccctctctctgcgaattccttggattctgtgcgagactcccatttctcgctctcgttctcttcctaagctcagcttgaccaacagctagagacagcggaaggcatttcgggatctcccagatattttggtgagggatttcatttgaagtgactcgcgaggaagaagaagaagaagaagcaccggagaaagaaatggccaagaacgttggaattctcgccgccgatatctacttccctcctacctgtattcagcaggaagccttggaggctcacgatggtgcaagcaaaggaaagtacactatcggacttggacaagattgcatggcattttgttcagaggtggaagatgtcatctccatgagtttgacagtggttacctcccttcttgagaaatatgggattgatccaaaacaaattggtcggctggaagtaggcagcgaaactgtcatagacaaaagcaaatctattaagaccttcctgatgacagtttttgagaaacatggaaatactgacattgaaggtgtcgactcaactaatgcatgctatgggggtactgcagctttattcaactgtgtgaattgggtggagagtagctcgtgggatggacgctatgggcttgtcgtgtgcactgacagtgcggtctatgcagaaggaccggcccgaccaactggtggagcagctgctattgctttgctgattggacctgatgctcctattgcttttgaaagcaaaattaggggaagtcatatggctcacgtctatgatttttacaancctgaccttgctagtgaatatccggttgttgatggaaaactttctcaaacatgntatntgaaggctctngattcttgctacaaggaattatgtaaaaagtatgagaaattggaaggcaaacaattttctctggctgatgccgagtatttcgtatttcattctccttataacaagctgtacaaaaagctttgcccgttggtattcaatgactccgtgaggaatgccagctccattgatgaggccgctacagaaaagctggccccatttgcgagcctacctggtgatgagagctaccaaagccgggatcttgaaaaggtatcccagcaagttgcaaagcccctatatgacgctaaggtgcaaccaacaactttggtaccaaagcaagttgggaacatgtacactgcatctctttatgcggcatttgtatcgctcctccataataagcacaactcattggatggcaagcgggtgatactcttctcttatggaagtggctctactgctactatgttctcattgcgcctaaatgccggtcaacatccctttagcttggggaacattgcagcagtgttgaatgttggagaaaagttgaagtcaagacatgagttccctcccgagaagtttgttgaagttatgaagatcatggagcacaggtatggaggcaaagactttgtgacaaaccaggacattagccttctacttccaggcacatactatcttactgaagtcgactctaagtaccggagattctatgccaagaaggaaggaggcagtactgctgccgtcacctccaatgagaatggagtggttgccaacggtcactgatgaacatatccaagtctgtaaatgccaaataggcatttatgttattagatgtcagttgtaactcgtaaagcagaacatcttacatctccagcttccattaagtttgtatgttaaaagcaaatagtttgtttcgcagcaagcgttgacaggttaaaattgttatttttttccgttttgataataaattgttcaataaaaattagtttcgcgattgttaaaaacca

SEQ ID NO: 1280 - DNA, 1852 bp, Arachis hypogaea
gatgtgacatccaacactcttcacacctcatcactcctcactctctctctctttggatccgttgagcagagatggctaagaatgtgggtattctcgccatggacatctacttccctcccacctgcgttcaacaggaagcattggaggctcatgatggtgccagtaaaggcaaatacaccattggacttggtcaagattgcatggcattctgcactgaggttgaagatgtcatctccatgagtttgacagttgttacttcccttcttgacaagtatgggattgatcctaaacaaattgggcgcctcgaagttggtagtgagaccgtcatagacaagagcaaatccatcaagacttttcttatgcagatttttgagaaacatggaaatactgacatagaaggggttgattcaagtaacgcatgctatggaggaactgctgctttgttcaattgtgtcaactgggtggagagcaattcgtgggatggacgctatggacttgttgtctgcaccgacagtgctgtctatgccgaaggacctgctcggcctactggaggagctgctgctattgccatgcttgttggtcctgatgctcccattgcatttgaaagcaaattgagggcaagccacatgtctcatgcttacgatttttacaagcctaatcttgctagtgaatatccagttgttgatggaaaactttctcaaacttgctaccttatggctcttgattcatgctataaacaactcagtcacaaatatgagaagctcaatgggaagccattttctctttccgatgctgaatactttgtatttcactctccttataacaagcttgtacagaaaagttttgctcgtttgttgtttgatgacttcataagggatccaagttctgtggatgaagctgcccagcaaaaactggaaccttttgcaaatttatccggtgatgagagctaccaaagccgggatctcgaaaaggcttcccagcaagttgcaaagcctctatttgatgccaaggtgcaaccaactactttgataccaaaggaagttggcaacatgtacaccgcatctatatatgcagcatttgcatcccttattcataacagatatagcgtgttggctggtaagagggtgatgttattttcctatgggagtggcctaaccgccacaatgttttctttgcaattacgcgatgctcagcatccatttagcttatcaaacattgctgaagtaatggatgttgctggaaaattgaagtcaaggcatgagtttcctccagagaaattcgtggaaactctgaagctaaatgaacatagatatggtgctaaggagtatgtcacaagcaaggacacaagcctattatctccagggacattctatctcactgaagtggattccatgtatcgcagattctatgcaaagaaagctattgaaaatggttttgctcccacatcgaacggcgtcattgccaatggtcattgatattgaacccatagaaaggcctttgcactaaatggagaaagctaacatcggttagaacaaaagaaggggtattgtcattgtttgcattacttttgtaaggtaaatggttcaagaaggggtattgtcattgtttgcattacttttgtaaggtaaatggttcctgtcgtgacaaacgtcgagtcttgtcagttcaatcgttgtatccgttttagatgtgtagttaccataaagttctctttggttatttaaagtttagtgagacagagtattctgatttttatgaattcaaaataatgaacatatatgtaagttaacaaaactcttcggtcgtaattgtattcctataattaattaattatgaaggtactcctgaatat

SEQ ID NO: 1281 - DNA, 1807 bp, Arachis hypogaea
atgtgacatccaacactcttcacacctcatcactcctcactctctctctctttggatccgttgagcagagatggctaagaatgtgggtattctcgccatggacatctacttccctcccacctgcgttcaacaggaagcattggaggctcatgatggtgccagtaaaggcaaatacaccattggacttggtcaagattgcatggcattctgcactgaggttgaagatgtcatctccatgagtttgacagttgttacttcccttcttgacaagtatgggattgatcctaaacaaattgggcgcctcgaagttggtagtgagaccgtcatagacaagagcaaatccatcaagacttttcttatgcagatttttgagaaacatggaaatactgacatagaaggggttgattcaagtaacgcatgctatggaggaactgctgctttgttcaattgtgtcaactgggtggagagcaattcgtgggatggacgctatggacttgttgtctgcaccgacagtgctgtctatgccgaaggacctgctcggcctactggaggagctgctgctattgccatgcttgttggtcctgatgctcccattgcatttgaaagcaaattgagggcaagccacatgtctcatgcttacgatttttacaagcctaatcttgctagtgaatatccagttgttgatggaaaactttctcaaacttgctaccttatggctcttgattcatgctataaacaactcagtcacaaatatgagaagctcaatgggaagccattttctctttccgatgctgaatactttgtatttcactcaccttataacaagcttgtacagaaaagttttgctcgtttgttgtttgatgacttcataaaggatccaagttctgtggatgaagctgcccagcaaaaactggaaccttttgcaaatttatccggtgatgagagctaccaaagccgggatctcgaaaaggcttcccagcaagttgcaaagcctctatttgatgccaaggtgcaaccaactactttgataccaaaggaagttggcaacatgtacaccgcatctatatatgcagcatttgcatcccttattcataacagatatagcgtgttggctggtaagagggtgatattattttcctatgggagtggcctaaccgccacaatgttttctttgcaattacgcgatgctcagcatccatttagcttatcaaacattgctgaagtaatggatgttgctggaaaattgaagtcaaggcatgagtttcctccagagaaattcgtggaaactctgaagctaaatgaacatagatatggtgctaaggagtatgtcacaagcaaggacacaagcctattatctccagggacattctatctcactgaagtggattccatgtatcgcagattctatgcaaagaaagctattgaaaatggttttgctcccacatcgaagggcgtcattgccaatggtcattgatattgaacccatagaaaggcctttgcactaaatggagaaagctaacatcggttagaacaaaagaaggggtattgtcattgtttgcattacttttgtaaggtaaatggttcaagaaggggtattgtcattgtttgcattacttttgtaaggtaaatggttcctgtcgtgacaaacgtcgagtcttgtcagttcaatcgttgtatccgttttagatgtgtagttaccataaagttctctttggttatttaaagtttagtgagacagagtattctgatttttatgaattcaaaataatgaacatatatgtaagttaacaaaactcttcggtcgtta

SEQ ID NO: 1282 - DNA, 1750 bp, Artemisia annua
tggatcacctcgtcaaaaaaaacacagacataaacatattcaaattattctaataaatcccagatctttgtttttcttcatttgatcttgttttatttactttttaccaatagtaaaaaaatgggtccccaaaatgttggaattcttgctatggaaatctactttcctcctacttgtatccaacaggatactcttgaggattttgatggagtcagtaaaggaaaatacaccattggacttggacaagactgcatggctttttgttcagaagtggaagacgtcatctctatgggattaacagctgtcacttcactacttgagaaatacggggttgatccaaaacaaattggtcggctggaagtaggtagtgaaactgttatagacaagagcaaatccatcaagacttttcttatgaccatctttgaggattgtggaaatactgacattgaaggtgtcgattcaaccaatgcatgctatggtggaactgcagcattattaaactgtgtaaactgggttgaaagtaactcatgggatggacgctatggattggttgtctgcacagatagtgcggtctatgcagagggacccgctcgacctactggaggtgcagctgctattgcaatgctgataggtccagatgcccctattgcatttgaaagcaagttcagggcaagtcatatgtctcatgtttatgacttttacaagcctgaccttgcaagtgaatatccggttgttgatggaaagctttctcaaacttgttatcttatggcacttgagtcttgctacaagggatattgtcaaaagtatgagaaattgcaggggaaacagttttccattgctgacgctgactattttgtatttcattctccttataataagcttgtacagaagagctttgctcgattagtgtttagtgatgtcgctagaagtgcaagctctgttgatgagtctgccaaagagaaactaggacagttcacgtctttaactggtgacgagagctacaacaaccgtgatcttgaaaaggcatcccagcaagtcgctaaacctcattatgatgtgaaggttcagcctggaactttgatttgcaagcaagtcggtaacatgtacactgcttctatatacgctgccttcgcttccctcattcataacaagaatagctccctggatggtaatcgtgtgatgatgttctcatatggaagtgggctatctgccaccatgttttcattgcgtcttagtgagggtaaggctccttttagtttgtcaaatatcgcaaaggtgatgaatgtggacgaaaagctgaagaggaggaccgagctttcaccagaaaaatttgtcgaaatcatgaaggtgatggaacacagatacggaggcaaggactttgtaaccagcaaagacactactcttctagctcccgacacctattacctcaccgaagttgactccaagtaccgtagatactatgcgaagaagacctctgagttggctaatggtcaataaaagattcaagggtggaaaatgtagcaagtagagtcatcaacagtgtttggtttggtttaggggtgatactgtcagagaagataggagtacaataattatttgctttcatttgtggttgttatattaacctattcaatttcattaattatccattttataaagaaatgtgttattaagattataaaacgaacacatgttttgtggtcattattttggattaatcgtgcgaagaagaaaattacgaggattggta

SEQ ID NO: 1283 - DNA, 1767 bp, Medicago truncatula
aaacaaacaaacaaacaccttggcaactctctcttattcattgattgattcgaacaagagaaagaaagaaagaaagaggagtttttgaattgaatcaagaaatggcaccagcagcagcaaacaacgttggaattcttgctcttgacatctacttccctcctaactgcgttcaacaggaagcattggaggctcatgatggtgctagtaaagggaaatatacaattggacttggacaagattgcatgtcattttgctctgatgttgaagatgtcatctcaatgagtttgacagtggtttctacacttcttcagaagtatgagatcgatcctaaacagataggtcgtcttgaagtaggcagtgaaactgttatcgacaaaagcaaatccatcaagtcattcttgatgcagatatttgagaaatatggaaatactgacattgaaggtgttgattcaactaatgcttgctatggaggaactgccgctttgttcaattgtgtcaattgggtggagagcaattcatgggatggacgttatggacttgtcgtctgcactgacagcgcagtctatgctgaaggtcctgctcgacctaccggaggagctgctgctattgctatgctaattggtcctgatgcccctatttcttttgaaagcaaattgaggggaagtcatatggctcatgtttatgatttttacaaacctgaccttgctagtgaatatccggttgtcgacggaaagctttcacaaacatgttacctcatggctcttgatacttgctttaaaaatttctgtcaaaaatacgagaaacacgagggaaaacaattctctctttctgatgctgactattttgtattccactctccttataacaagcttgtgcaaaaaagttttgctcgtttggtcttcagtgacttcttgaggaatcccagctctaaggatgaggttaccaacgaaaagcttggaccttttacaactttatccgatgacgagagctaccaaagccgggatcttgaaaaggcatcgcaacaagttgcaaagcctctatatgatgagaaggtacaaccatctactttgataccaaagcaagttggtaacatgtacaccgcgtccatctatgcagcatttgcatcccttcttcacaacaaaaatagttcactggaaggtaagagggtgatattattctcatacggaagtggcttaactgccacaatgttttccttgcaattacgtgaaactaaacatccatttagtttgtcaaacattgcccgagtgatggatgttgctgaaaagttgaagtcaagacatgagtttcctccacagaagttcattgaaacactgaagcttatggaacataggtatggtgccaaggattatgtaacaagcaaggacagtagccttttggctccaggcacattctatctcaccgaagttgataccatgtatcgtagattctatacaacgaaatctagtgaaagcaatttgacccctgcagttaacggtttgtctgtcaatggtcactgatggttagcatctatgcacaaacaataaatggaattaagctccgcattgaatgaagttgaagggtagtcttgtttgtattagtattgcaagggaaagcaaatgttttctgcagttgctgttgctcagttcaaatattgtatgagtcaaaaaattgttctaatattgtattttaccctttaaaatgttactttgaagtcagaaatttatatttttaggttacttgtttcattttaatgattaaaaaaattcg

SEQ ID NO: 1284 - DNA, 1581 bp, Brassica rapa
gaacagattcatatattttctgatatacacagcttctctaaactctctctctctcaaagaccgaaccttcgatctcattctctggagaagaaagttcaatcctttttgattcaacaatggcgaagaacgtagggatattggctatggacatctatttccctcccacctgtgttcaacaggaagctttggaagctcatgatggagcaagcaaagggaaatacaccattggacttggtcaagattgtttagctttttgcactgagcttgaagatgttatctcaatgagtttcaatgcggtgacatctcttcttgaaaagtacaagattgaccccaagcaaattgggcgtcttgaagtaggcagtgagactgtcattgacaagagcaagtccatcaaaaccttcttgatgcaactctttgagaaatgtggaaacactgatgtagaaggtgttgactcgaccaatgcttgttatggtggaactgcggctttgctaaactgtgtcaattgggttgagagtaactcctgggatggacgctatggccttgtcatttgtactgacagtgcggtttatgcagaagggcccgcaaggcccactggaggagcagctgccattgctatgttgataggaccagatgctcctattgtttttgagagcaaattgagaggaagccacatggctcatgtctatgacttttacaagccaaatcttgctagcgagtacccggttgttgatggtaagctttcacagacatgctaccttatggcacttgactcttgctataaacatttatgcaacaagtttgagaaacttgagggcaaagagttctccatcaatgatgctgattactttgtcttccattctccatacaacaaacttgtgcagaaaagctttgctcgtctcttgtacaacgacttcttgagaaacgcaagctccattgatgaggctgccaaagaaagttcactccttattcctccttgtccctcgatgagagtaccaaagccgtgatcttgaaaaggtgtcacaacaactagcaaaaacgtattatgatgctaaagtgcaaccaacgactttagtaccaaaacaagtcggtaacatgtacactgcttctctctacgcagcatttgcttccctcgtccacaacaaacacagcgatttggcgggaaagcgggtggttatgttctcatatggaagtggttcaaccgcaacaatgttctcattgcgtctctgcgagaaccagtctcctttcagcttatcaaacatcgcttctgtaatggatgttggcggtaaattgaaggctagacatgagtatgcacctgagaagtttgtggagacaatgaagctaatggaacataggtacggagcaaaggagtttgtgacgagcaaggaaggcatcttagaccttttggctccggggacttattatctgaaagaggttgattcattgtaccggagattctatggcaagaaaggagacgatggatccataaccaatggacactgattcttgaaagcataaatcacttgaaagattgtgtctactcattgctctttatgtttactttccaaaattctagacgttttt

SEQ ID NO: 1285 - DNA, 1712 bp, Brassica napus
  misc_feature (706)..(706): n is a, c, g, or t
ggtgttctactatagattatacactgcaaatccattctataacagagatccacctctataacataacagagatctctagagtaaaatacagaggcatccattggagatgctctggaagaccgaaccttcgatctcattctctggagaagaaagttcaatccctttttgattaaacaatggcgaagaacgtagggatattggctatggacatctatttccctcccacctgtgttcaacaggaagctttggaagctcatgatggagcaagcaaagggaaatacaccattggacttggtcaagattgtttagctttttgcactgagcttgaagatgttatctcaatgagtttcaatgcggtgacatctcttcttgaaaagtacaagattgaccccaagcaaattgggcgtcttgaagtaggcagtgagactgtcattgacaagagcaagtccatcaaaaccttcttgatgcaactctttgagaaatgtggaaacactgatgtagaaggtgttgactcgaccaatgcttgctatggtggaactgcagctttgctaaactgtgtcaattgggttgagagtaactcctgggatggacgctatggccttgtcatttgtactgacagtgcggtttatgcagaaggacccgcaaggcccactggaggagcagctgccattgctatgttgataggaccagatgctcctattgtttntgagagcaaattgagaggaagccacatggctcatgtctatgacttttacaagccaaatcttgctagcgagtacccggttgttgatggtaagctttcacagacatgctaccttatggcacttgactcttgctataaacatttatgcaacaagtttgagaaacttgagggcaaagagttctccatcaatgatgctgattactttgtcttccattctcctacaacaaacttgtgcagaaaagctttgctcgtctcttgtacaacgacttcttgagaaacgcaagctccattgacgaggctgccaaagaaaagttcactccttattcctccttgtccctcgatgagagttaccaaagccgtgatcttgaaaaggtgtcacaacaactagcaaaaacgtattatgatgctaaagtgcaaccaacgactttagtaccaaaacaagtcggtaacatgtacactgcttctctctacgcagcattcgcttccctcgtccacaacaaacacagcgatttggcgggaaagcgggtggttatgttctcatatggaagtggttcaaccgcaacaatgttctcattgcgtctctgcgagaaccagactcctttcagcttatcaaacatcgcttctgtaatggatgttggcggtaaattgaaggctagacatgagtatgcacctgagaagtttgtggagacaatgaagctaatggaacataggtacggagcaaaggagtttgtgacgaccaaggaaggtatcttagaccttttggctccggggacttattatctgaaagaggttgattcattgtaccggagattctatggcaagaaaggagacgatggatccataaccaatggacactgattcttgaaagcataaatcacttgaaagattgtgtctactcatcgctctttatgttttactttccaaaattctagacgtttttataaggttcttgttactttgatttagggacagtttgcatgctcttgtttttatttatttgccattgatt

SEQ ID NO: 1286 - DNA, 2394 bp, Glycine max
ctgccaacctgcacactcttcactcgatcaaacagaaaatggcaaagaatgtggggatccttgccattgacatctacttccctcccgcttgcgttcagcaggaagcattggagactcatgatggtgccagtaaagggaagtataccattggtcttggacaagattgcatgtcattctgtaccgaagtagaagatgtcatctcaatgagtttgacagtggttacttctcttcttgagaaatatgagattgatcctaagctagttggtcgtctggaagttggaagcgagactgtgatagacaaaagcaaatccatcaagacattcctgatgcagatcttcgagaaatatggaaatactgacattgagggtgttgattcaactaatgcatgctatggaggaactgctgctctgtttaattgtgtcaattgggtggagagcaattcatgggatggacgctatggacttgttgtctgcactgacagtgcagtttatgctgaagggcctgctcgacctactggaggagctgctgctattgccatgctaattggtcctgatgctcccatttcttttgaaagcaaattgagaggaagtcatatgtctcatgtttatgatttttacaagcctaatcttgccagtgaatatccagttgttgatggaaagctttcacaaacttgttacctcatggctgttgattcttgctataagaatttctgtcacaagtatgagaaattcgagggaaaacaattttctctttctgatgctgaatactttgtatttcactctccttataacaagcttgtacagaagagttttgctcggttggttttcaatgacttcttaatgaattccagctctgtagatgaggttgccaaagaaaaactgggaccttttgcaactttatctggtgatgagagctaccaaagtcgggatcttgaaaaggcatcccagcaagtagcaaagcctctatatgatcagaaggtacaaccaactactctgattccaaagcaagttggaaacatgtacacggcgtctctttatgcagcatttgcctcccttattcacaacaaaaatagcacattggcaggtaagagggtgatattattctcatacggtagtggcttaactgccaccatgttttcgttgcaattacgagacagtcaacatccgtttagcttgtcaaacattgctagagtgatggatgtcgatggaaaattgaagtcaagacatgagtttcccccagaggagtttgttgaaaacctgaagctaatggagcataggtatggtggaaaggaatttgtgacaagcaaggacactagccttttatctccaggcacattctacctcactgaagttgactccatgtatcggagattctattcaaagaaaactaaagagagcagtttgactcccgctgagaacggtgtgattgctaatggcgttgctaatggcattgctaatggccactgatgttgagcatgtacaatcagctgtcaacttcgcctagaatgaagggtattgttatttgtgatagttctgtaggtaaattgtttctgggtgataagtattctcggttcaaatattttattgtactcttttaagatgtagctagttactcgagtccaaaatttatctttttctgttttttttttttttttttttttgcattttagtgaatggaaattagtctttgaataaaaaaagaagttgcaatagcttttattcaggccggttattatatgtatgaatcacatgatgtggttggactcaattaaaaatcaaatttttaggattatttatcataaaatctcttttaatagttttctttagggtgattcttggactttattttatctttttttacaggtacaagacttaaaaccatgtgaactctttgtcagttgaatcgattttttttttaatataaatttactcttatatctaaagttccaagtatatagttaatttttttatttctcaattaaaattatattatatttaaaagtatgtatttagaaataatattttatatattcctaataaacacatgaagattgcagtaaaaaaaattaaacacatgaaaattcttagcaaaaaaatccttattcttacactggtagttaccctaacatgcatgtttaatatagttaagttacacaaacatctatgttttccagaaccttttatttataacatttatttttgcacatcaccatatatttttcttaagtcaataaaagtcatatgtataggtgaatacaaataaattataaaagtaattacaaattttataacacttcatttttcttattcaaataattataaaagtaaatacaaataatgactatgaaactataagtggagttttttttagaataaactataagggaagttagtc

SEQ ID NO: 1287 - DNA, 1564 bp, Artemisia annua
aaaaaaaagatggcacctcaaaacgttggaattgtcgccatggaaatttacttccctcctacttgtatccaacaggataccctcgaaaattttgatggagtaagtaaaggaaaatacaccatcggtctcggacaggattgtatggcattttgctcagaggttgaagatgtcatctctatgggattgacagctgtcacttcactacttgaaaagtatgagattgacccaaaacaaattggtcggctggaagttggtagcgaaaccgtgatagacaagagcaaatccattaaaacttttctaatggacatctttgagaatgctggaaataccgacatcgaaggtgtggattcaaccaatgcatgctatggtggaactgcagcattattcaactgtgtaaactgggtggagagcagttcatgggatgggcgatatggattggtcgtctccacagacagtgcggtctatgctgatggaccagctcgacccacaggaggagcaggcgctgttgctatgctcataggccctgatgctcctattgcattcgaaagtaaatttagggcaagtcatatgtcgcatgtttatgacttctacaagcctgaccttgcaagtgaatatccggttgttgatggaaagttgtctcaaacttgttatctcatggcacttgattcttgctacaagggatactgtcagaagtacgagaaattgcaaggcaaacagttttcgatggccgatgctgactattttgtttttcatagtccttataacaagcttgtacagaagagctttgctcgtttggttttcgctgatgttgctagagatgccagctcggttgatgaatccgctaaagagaagcttggacagttcacgtctctaaaaggtgacgaaagctatcaaagccgtgatcttgagaaggcatcccagcaagttgcaaaacccgattatgataaaaaggttcagccagcaactttggtccccaagcaactgggaaacatgtacactgcgtctttatatgctgcctttgcttccctgattcacaataagagtagctctctggatggaaaccgtgtaatgatgttctcatatggaagtgggttgtctgccacaatgtggtcactacgtcttactgagggcaaagcaccttttagtttgtcaaacatcgcaaaggtcatgaatatcgaacataagttgaagacaaggacagagtttgcgccggaaaagtttgtagagctcatgcatttgatggagcacagatacggtggcaaggacttcgtcacaagtaaagacactagccatttagctccaggcacctattatctcactgaagttgactcaaagtacaggagattttatgcaaagaagacgactgaggtagccaacggtcattgaagattgaaaacccattagtcgacttaatgttgtattaagttaagctctacaagtattgttttaattaggggtgattgttgtgagaacacaaaataatttgcttccatttgagtttacttgagaaatgtctattatcaaggaatgtattttaaatattttattaataatattttgtttt

SEQ ID NO: 1288 - DNA, 1784 bp, Brassica napus
ggtgttctactatagattatacactgcaaatccattctataacagagatccacctctataacataacagagatctctagagtaaaatacagaggcatccattggagatgctctggaagaccgaaccttcgatctcattctctggagaagaaagttcaatccctttttgattaaacaatggcgaagaacgtagggatattggctatggacatctatttccctcccacctgtgttcaacaggaagctttggaagctcatgatggagcaagcaaagggaaatacaccattggacttggtcaagattgtttagctttttgcactgagcttgaagatgttatctcaatgagtttcaatgcggtgacatctcttcttgaaaagtacaagattgaccccaagcaaattgggcgtcttgaagtaggcagtgagactgtcattgacaagagcaagtccatcaaaaccttcttgatgcaactctttgagaaatgtggaaacactgatgtagaaggtgttgactcgaccaatgcttgctatggtggaactgcagctttgctaaactgtgtcaattgggttgagagtaactcctgggatggacgctatggccttgtcatttgtactgacagtgcggtttatgcagaaggacccgcaaggcccactggaggagcagctgccattgctatgttgataggaccagatgctcctattgtttgtgagagcaaattgagaggaagccacatggctcatgtctatgacttttacaagccaaatcttgctagcgagtacccggttgttgatggtaagctttcacagacatgctaccttatggcacttgactcttgctataaacatttatgcaacaagtttgagaaacttgagggcaaagagttctccatcaatgatgctgattactttgtcttccattctccatacaacaaacttgtgcagaaaagctttgctcgtctcttgtacaacgacttcttgagaaacgcaagctccattgacgaggctgccaaagaaaagttcactccttattcctccttgtccctcgatgagagttaccaaagccgtgatcttgaaaaggtgtcacaacaactagcaaaaacgtattatgatgctaaagtgcaaccaacgactttagtaccaaaacaagtcggtaacatgtacactgcttctctctacgcagcattcgcttccctcgtccacaacaaacacagcgatttggcgggaaagcgggtggttatgttctcatatggaagtggttcaaccgcaacaatgttctcattgcgtctctgcgagaaccagactcctttcagcttatcaaacatcgcttctgtaatggatgttggcggtaaattgaaggctagacatgagtatgcacctgagaagtttgtggagacaatgaagctaatggaacataggtacggagcaaaggagtttgtgacgaccaaggaaggtatcttagaccttttggctccggggacttattatctgaaagaggttgattcattgtaccggagattctatggcaagaaaggagacgatggatccataaccaatggacactgattcttgaaagcataaatcacttgaaagattgtgtctactcatcgctctttatgttttactttccaaaattctagacgtttttataaggttcttgttactttgatttagggacagtttgcatgctcttgtttttatttatttgccattgattctctgaagcttttttttttcttagtgtgttttttaaataagcctgttaattttaggaattattaagatgtt

SEQ ID NO: 1289 - DNA, 1830 bp, Panicum virgatum
cccccccccccaccccgaagcgcagccagccagagccgtccggaatccacgaggacagcgtcgtcgtcctcctcctccgccgccgccgccggccgcagcagaacagagcccacgcgcgctccgtccgggtggagcgcacgagcgcgggttcagggagcgaggggatcggggcggcgctcggcttgactgcgcgggatggcgggccgcaaggatgtcgggatcctcgccatggacatctacttcccgcccacctgcgtgcagcaggaggcgcttgaggcccatgacggcgcgagcaaagggaagtacaccatcggtcttgggcaagattgcatggccttttgcagtgaggtggaggatgtcatctcaatgagtttgaccgttgtcaattccctacttaaaaagtacaatgttgatccaaagcttattggccgtttggaggttggaagtgagacggttatagacaaaagtaaatccatcaaaacttggctgatgcaaatttttgagaaaagtggcaatactgacattgaaggagttgactccagcaatgcttgttacggtggaactgctgccctgctgaattgcgtgaattgggttgaaagtaactcctgggacggacgctatggtcttgtcgtttgcacagacagtgcggtttatgctgaagggccagctcgtccaactgggggtgcggctgcaattgcaatgctcattggtcctaatgcacctatttcatttgagagcaaatatagagcttctcacatggctcatgtctatgatttctacaagcctgatctcgcaagtgaatatccggttgttgatggtaaactatcccaaacatgctacttgatggccctagactcatgctacagacaattttgcaacaaatacgagaagattgtggggaaacaattctcgatttctgatgcagaatattttgtgttccattctccatacaacaagctcgtgcagaagagttttgctcgactttactacaatgacttcatgcgcaactgcagctctattgatgatgatgctaaagagaagcttcagccattttctaatctgactggtgaagagagctaccagagtcgcgacttggaaaaggcctcgcaacaagtcgcgaagcacttgtatgacatcaaagttcagccatcgactctgcttcccaaacaaattggcaacatgtatactgcatccctttatgctgcattggcatctgtactatataacaagcatgatagtctggatggacaaagaatcgtgatgttctcttacggcagtggcttgacatccactatgttttcgttgaggctaaacaatggccagcatcccttcagtttatcaaacattgcttcagtgcttggtgtcacagagaagcttcagtcaaggcatgagaccttacccgagaagttcattgacacattgaagctgatggagcaccggtacggtgcaaaggatttcgagaccagcagggacacgagcctgctgccgcctggcacattttacctgacccatgtggactccatgtaccggaggttctatgaccagaagcctgtagagggtggcaaagccaagtgctgcaacggcttcgcaaatggccactagtggcgtgccgtggactctaaggtcgcctcgcctgccttgttgctcatagactcatcgtgctatgtactctgatatgcttatggctagaatttccagcctagtgtgtttctgaaataatttattgtctgcagctgttctcctagatcagctagtttttgtaatatttttatctgaccggtgaaatcagtcttgatattcttgtttctgtagtttgttgttttttcgttc

SEQ ID NO: 1290 - DNA, 1762 bp, Tropaeolum majus
cggccgggggacgttctctctctgcgatttttttcctagcggtaatcttttctctcttcaatttcaatctctcacgaaagcttcgctttttctagagggggattacagcagaagagcgctactgactcgtttggaggtttctattgtattatagacatggcaaagaatgttggaattctcgcaatggatatctactttcctcctagttttgttaaacaggaagaactagaggcacatgatggcgccagcaaagggaaatacaccattggacttggacaagatggcttggccttttgtacagaggttgaagatgtcatctcaatgagtctaacagctgtttcttcactccttgagaagtacaaaattgatgcaaaagaaattggtcgtcttgaagtaggtagcgagaccgtgatagacaagagcaagtctattaagactttcctgatgcaaatctttgagaaaagtggaaacaccgacattgaaggagttgactcatctaatgcctgttacgggggaactgcggctttattaaactgtgtcaactgggttgagagtaattcatgggatggacgctatggactcgttgtgtgcactgacagtgcggtctatgccgaaggaccagcaaggcctactggaggagcagctgcaattgctatgctcattgggcctgatgctcctattgcttttgaaagcaaattcagaggaagccatatgtctcatgtatacgatttttacaagcccgaccttgctagtgaatatccggttgttgatggaaagctttcgcagacatgctaccttatggcccttgattcatgttacaaagttttctgcagcaaatatgagaagttggaggggaaacaattttccatttccgacgctgactactttgtcttccattctccttataacaagcttgttcagaaaagctttgctcgcttgttatataacgacttcatgaggaatgccagttctattgatgaggcagctaaagaaaagctggggccgttttcaactttatccggtgatgaaagctatcaaagccgcgatcttgaaaagttatctcaacaagttgcaaaacccttctacgattccaaggtgcaaccgagcactttggtaccgaagcaaatcggcaacatgtacacagcatctatctatgctgcatttgcatcccttattcacaacaaacacagtgaactggagggtaagcgtgtgataatgttctcatatggaagtggatctacagctacaatgttctcactgcaacttcgccagagtgaaaatccatttagcttgtcaaacattgcaactgtcttggatgttgctgggaagttgaaggcaagacatgaggttactcccgaaaagtttgtggaaaatttgaaactgatggagcataggtacggcggcaaggactttgtcacaagccaggatgtcagcttgttggctccaggcacatattacctcactgaagtagacaccaagtaccgaagattctacgccaagaaaaccagcactactacgtgtgagaataattccatagccaatggacactaatctcaaaacaagttccaccggatgtacgatttgttagcatcaacagatgtatctgtatcaagaagtcgattaagcagtaagtggtttttatgttgcatattattattattattattattattttttccaccttatctttgtaataacattcactttttaagtgatctactcttctttgtagctaaatggctatggttatcctgtattgatg

SEQ ID NO: 1291 - DNA, 1751 bp, Artemisia annua
  misc_feature (821)..(821): n is a, c, g, or t
  misc_feature (833)..(833): n is a, c, g, or t
tggatcacctcgtcaaaaaaaacacagacataaacatattcaaattattctaataaatcccagatctttgtttttcttcatttgatcttgttttatttactttttaccaatagtaaaaaaatgggtccccaaaatgttggaattcttgctatggaaatctactttcctcctacttgtatccaacaggatactcttgaggattttgatggagtcagtaaaggaaaatacaccattggacttggacaagactgcatggctttttgttcagaagtggaagacgtcatctctatgggattaacagctgtcacttcactacttgagaaatatggggttgatccaaaacaaattggtcggctggaagtaggtagtgaaactgttatagacaagagcaaatccatcaagacttttcttatgaccatctttgaggattgtggaaatactgacattgaaggtgtcgattcaaccaatgcttgctatggtggaactgcagcattattaaactgtgtaaactgggttgaaagtaactcatgggatggacgctatggattggttgtctgcacagatagtgcggtctatgcagagggacccgctcgacctactggaggtgcagctgctattgcaatgctgataggtccagatgcccctattgcatttgaaagcaagttcagggcaagtcatatgtctcatgtttatgacttttacaagcctgaccttgcaagtgaatatccggttgttgatggaaagctttctcaaacttgttatcttatggcacttgagtcttgctacaagggatattgtcaaaagtatgagaaattgcaggngaaacagttttncattgctgacgctgactattttgtatttcattctccttataataagcttgtacagaagagctttgctcgattagtgtttagtgatgtcgctagaagtgcaagctctgttgatgagtctgccaaagagaaactaggacagttcacgtctttaactggtgacgagagctacaacaaccgtgatcttgaaaaggcatcccagcaagtcgctaaacctcattatgatgtgaaggttcagcctggaactttgatttgcaagcaagttggtaacatgtacactgcttctatatacgctgccttcgcttccctcattcataacaagaatagctccctggatggtaatcgtgtgatgatgttctcatatggaagtgggctatctgccaccatgttttcattgcgtcttagtgagggtaaggctccttttagtttgtcaaatatagcaaaggtgatgaatgtggacgaaaagctgaagaggaggaccgagctttcaccagaaaaatttgtcgaaatcatgaaggtgatggaacacagatacggaggcaaggactttgtaaccagcaaagacactactcttctagctcccgacacctattacctcaccgaagttgactctaagtaccgtagatactatgcgaagaagacctctgagttggctaatggtcaataaaagattcaagggtggaaaatgtagcaagtagagtcatcaacagtgtttggtttggtttaggggtgatactgtcagagaagataggagtacaataattatttgctttcatttgtggttgttatattaacctattcaatttcattaattatccattttataaagaaatgtgttattagattataaaacgaacacatgttttgtggtcattattttggattaatcgtgcgaagaagaaaattacgaggattggtatc

SEQ ID NO: 1292 - DNA, 1660 bp, Arabidopsis lyrata
tctctctcaaagatcgaacctttcgatttcagtctctgaaaaataagttcttttcgttttcatcgaaacaatggcgaagaacgttgggattttggctatggatatctatttccctcccacttgtgttcaacaggaagcattggaagctcatgatggagcaagcaaagggaaatacactattggacttggccaagattgcttagctttttgcactgagcttgaagatgttatctctatgagtttcaatgcggtgacatcacttttcgagaagtataagattgaccctaaccaaatcgggcgtcttgaagtaggaagtgagactgtcattgataaaagcaaatccatcaagacattcttgatgcagctctttgagaaatgtggaaacactgatgttgaaggtgttgactcgaccaatgcttgctatggtggaactgcggctttgttgaattgtgtcaactgggttgagagtaactcatgggatggacgttatggcctcgtcatttgtactgacagcgcggtatatgcagaaggacccgcaaggcccactggaggagctgctgcgattgctatgttgataggacccgatgctcctatcgttttcgaaagcaaattgagaggaagccacatggctcatgtctatgacttttacaagcccaatcttgctagcgagtacccggttgttgatggtaagctttcacagacttgctaccttatggctcttgattcttgctataaacatttatgcaacaagttcaagaaaatcgagggcaaagagttttccatcaatgatgctgattactttgttttccattctccatacaataaacttgtacagaaaagctttgctcgtctcttgtacaacgacttcttgagaaacgccagctccattgacgaggctgccaaagaaaagttcaccccttattcatctttgtccctcgatgagagttaccaaagccgtgatcttgaaaaggtgtcacaacaaattgcgaaaccgttttatgatgccaaagtgcaaccgacgactttaataccaaaggaagtcggtaacatgtacactgcttctctctacgctgcatttgcttccctcatccacaataaacacaacgatttggcgggaaagcgggtggttatgttctcatatggtagtggctcaaccgcaacaatgttctcattacgcctcaacgacaatcagcctcctttcagcgtttcaaacatcgcatctgtaatggatgttggcggtaaattgaaggctagacatgagtatgcacctgagaagtttgtggagacaatgaagctaatggaacatagatacggagccaaggactttgtgacaagcaaggagggtataatagaccttttggcaccgggaacttattatctgaaagaggttgattccttgtaccggagattctatggcaagaaaggtgatgatggatccatagccaatggacactgattcttgaaaggaacaaatcataaaagtcacctaaaaaatgttatgttacttgcaccactttgatcgttttataagtttgttgttactttgatttagggacaaagaaggaatgtattctctgtttttatttactatttgatttactctctcatgcaaatgataatttggaacttgttggaatctattttgtttgtttgtgttctt

SEQ ID NO: 1293 - DNA, 1746 bp, Lactuca sativa
gactttccgagaaaagattctaacggcgtgaaatcagcaattgataacagaagttgagatcgttaattcatcctttcgactttcgatctgctgattatcgtagttgtgtttgtgattcagttaatctctgattaaaactgtattgaagatcgaagaagagtttgaaacagagatggctcctcaaaatgttggaattctcgccatggaaatctacttccctcctacttgtatcaaacaggataccctagaagattttgatggtgttagtaaaggaaaatacaccattggactcggacaagattgcatggcattttgttcagaggttgaagatgtcatctctatgggattgacagctgtcacatcactactagagaagtatgaaatcgacccaaaacaaatcggtcgccttgaagtcggtagtgaaactgtaatagacaagagcaaatccatcaagaccttcttgatgcaaatctttgaggaatgtggaaacacagacattgaaggtgtggattcaaccaatgcatgctatggtggaactgcagcattattcaactgtgtgaattgggtggaaagcagttcatgggatggaaggtatggattagttgtctccacagacagtgcggtttatgccgagggggctgcccgaccaacaggaggggcaggtgctgttgccatgctgattggacccgatgcaccaatcgcattcgaaagcaaatttagggcaagtcatatgtcacatgtttatgacttttacaaacccgaccttgcaagtgaatatccagttgttgatggaaaattgtcccaaacttgttatctcatggctcttgattcttgctacaaaggatactgtcaaaagtatgagaaacttcaagggaaacaattttcaatggtggatgctgattattttgtgtttcacagtccgtataacaagcttgtacagaagagttttgctcgtttggtgttcgatgatgttgccagaaatgtcagctctgttgatgagtctgctaaagagaagttaggtcaattcacgtctctaaagggcgacgagagctaccaaagccgtgatcttgaaaaggcagcccagcaagtggcaaaaccagattatgataaaaaagtgaagccagcaactttgatccccaagcaactgggaaacatgtacactgcatctatttatgctgcttttgcttcactcattcacaacaagagtgactctctggatggaaaccgtgtaatgatgttctcatacgggagtggattatccgctacaatgttttcgctacatcttagcgagggaaaaggaccttttagtttatcaaacatcgcaaaggtcctgaatattgaccataagttaaagaccaggacagaggttgtgccagaaaaatttgtcgaattgatgcacttgatggagcacagatatggtgggaaggactttgtgacaagcaaggacactagtcatttggctccaggcacttactatttgactgaagttgactccaagtacaggagattttatgccaagaagacaaccgagttggctaatggtcactgaagagtgagaaccgacacggagtcagttattattgaaagcttttagctctacaagtatggttttggtaaggggtgatgttgtaagagcacataataatctgcttctatttatttaagtttgttacttgagaactaatgtcaattcttaaggaatgtatttttaatctatcttattaataaaagtttatgattattggt

SEQ ID NO: 1294 - DNA, 1755 bp, Lactuca sativa
ctctctcgactttccgagaaaagattctaacggcgtgaaatcagcaattgataacagaagttgagatcgttaattcatcctttcgactttcgatctgctgattatcgtagttgtgtttgtgattcagttaatctctgattaaaactgtattgaagatcgaagaagagtttgaaacagagatggctcctcaaaatgttggaattctcgccatggaaatctacttccctcctacttgtatcaaacaggataccctagaagattttgatggtgttagtaaaggaaaatacaccattggactcggacaagattgcatggcattttgttcagaggttgaagatgtcatctctatgggattgacagctgtcacatcactactagagaagtatgaaatcgacccaaaacaaatcggtcgccttgaagtcggtagtgaaactgtaatagacaagagcaaatccatcaagaccttcttgatgcaaatctttgaggaatgtggaaacacagacattgaaggtgtggattcaaccaatgcatgctatggtggaactgcagcattattcaactgtgtgaattgggtggaaagcagttcatgggatggaaggtatggattagttgtctccacagacagtgcggtttatgccgagggggctgcccgaccaacaggaggggcaggtgctgttgccatgctgattggacccgatgcaccaatcgcattcgaaagcaaatttagggcaagtcatatgtcacatgtttatgacttttacaaacccgaccttgcaagtgaatatccagttgttgatggaaaattgtcccaaacttgttatctcatggctcttgattcttgctacaaaggatactgtcaaaagtatgagaaacttcaagggaaacaattttcaatggtggatgctgattattttgtgtttcacagtccgtataacaagcttgtacagaagagttttgctcgtttggtgttcgatgatgttgccagaaatgtcagctctgttgatgagtctgctaaagagaagttaggtcaattcacgtctctaaagggcgacgagagctaccaaagccgtgatcttgaaaaggcagcccagcaagtggcaaaaccagattatgataaaaaagtgaagccagcaactttgatccccaagcaactgggaaacatgtacactgcatctatttatgctgcttttgcttcactcattcacaacaagagtgactctctggatggaaaccgtgtaatgatgttctcatacgggagtggattatccgctacaatgttttcgctacatcttagcgagggaaaaggaccttttagtttatcaaacatcgcaaaggtcctgaatattgaccataagttaaagaccaggacagaggttgtgccagaaaaatttgtcgaattgatgcacttgatggagcacagatatggtgggaaggactttgtgacaagcaaggacactagtcatttggctccaggcacttactatttgactgaagttgactccaagtacaggagattttatgccaagaagacaaccgagttggctaatggtcactgaagagtgagaaccgacacggagtcagttattattgaaagcttttagctctacaagtatggttttggtaaggggtgatgttgtaagagcacataataatctgcttctatttatttaagtttgttacttgagaactaatgtcaattcttaaggaatgtatttttaatctatcttattaataaaagtttatgattattggtat

SEQ ID NO: 1295 - DNA, 1764 bp, Arabidopsis thaliana
gtggacttgtttattaaaaacaaattgagttttcatcatcaaccgattcatatctttcttcttcttcctctacagcttcttcataaatctctctctcttctcctctcttctcaaagatcgaacctttcgatttcagtctcttcagagttctttcgttttcatcgaaacaatggcgaagaacgttgggattttggctatggatatctatttccctcccacctgtgttcaacaggaagctttggaagcacatgatggagcaagtaaagggaaatacactattggacttggccaagattgtttagctttttgcactgagcttgaagatgttatctctatgagtttcaatgcggtgacatcactttttgagaagtataagattgaccctaaccaaatcgggcgtcttgaagtaggaagtgagactgttattgacaaaagcaagtccatcaagaccttcttgatgcagctctttgagaaatgtggaaacactgatgtcgaaggtgttgactcgaccaatgcttgctatggtggaactgcagctttgttaaactgtgtcaattgggttgagagtaactcttgggatggacgttatggcctcgtcatttgtactgacagcgcggtttatgcagaaggacccgcaaggcccactggaggagctgcagcgattgctatgttgataggacctgatgctcctatcgttttcgaaagcaaattgagagcaagccacatggctcatgtctatgacttttacaagcccaatcttgctagcgagtacccggttgttgatggtaagctttcacagacttgctacctcatggctcttgactcctgctataaacatttatgcaacaagttcgagaagatcgagggcaaagagttctccataaatgatgctgattacattgttttccattctccatacaataaacttgtacagaaaagctttgctcgtctcttgtacaacgacttcttgagaaacgcaagctccattgacgaggctgccaaagaaaagttcaccccttattcatctttgacccttgacgagagttaccaaagccgtgatcttgaaaaggtgtcacaacaaattgcgaaaccgttttatgatgctaaagtgcaaccaacgactttaataccaaaggaagtcggtaacatgtacactgcttctctctacgctgcatttgcttccctcatccacaagaaacacaatgatttggcgggaaagcgggtggttatgttctcttatggaagtggctcaaccgcaacaatgttctcattacgcctcaacgacaataagcctcctttcagcatttcaaacattgcatctgtaatggatgttggcggtaaattgaaagctagacatgagtatgcacctgagaagtttgtggagacaatgaagctaatggaacataggtatggagcaaaggactttgtgacaaccaaggagggtattatagatcttttggcaccgggaacttattatctgaaagaggttgattccttgtaccggagattctatggcaagaaaggtgaagatggatctgtagccaatggacactgattcttgaaaaggaacaaatcataaaaagtcacctgaaaatgttatgttttacttgcaccattttaatcgttttataagtttgttgttactttgatttagggacaaagaaggaatgtattctctgtttttatttactgtttgatttactctctcatgcaaatgataatttggaaattattggaatctctattttgtatgtttgtgttctt

SEQ ID NO: 1296 - DNA, 1724 bp, Arabidopsis thaliana
aaccgattcatatctttcttcttcttcctctacagcttcttcataaatctctctctcttctcctctcttctcaaagatcgaacctttcgatttcagtctcttcagagttctttcgttttcatcgaaacaatggcgaagaacgttgggattttggctatggatatctatttccctcccacctgtgttcaacaggaagctttggaagcacatgatggagcaagtaaagggaaatacactattggacttggccaagattgtttagctttttgcactgagcttgaagatgttatctctatgagtttcaatgcggtgacatcactttttgagaagtataagattgaccctaaccaaatcgggcgtcttgaagtaggaagtgagactgttattgacaaaagcaagtccatcaagaccttcttgatgcagctctttgagaaatgtggaaacactgatgtcgaaggtgttgactcgaccaatgcttgctatggtggaactgcagctttgttaaactgtgtcaattgggttgagagtaactcttgggatggacgttatggcctcgtcatttgtactgacagcgcggtttatgcagaaggacccgcaaggcccactggaggagctgcagcgattgctatgttgataggacctgatgctcctatcgttttcgaaagcaaattgagagcaagccacatggctcatgtctatgacttttacaagcccaatcttgctagcgagtacccggttgttgatggtaagctttcacagacttgctacctcatggctcttgactcctgctataaacatttatgcaacaagttcgagaagatcgagggcaaagagttctccataaatgatgctgattacattgttttccattctccatacaataaacttgtacagaaaagctttgctcgtctcttgtacaacgacttcttgagaaacgcaagctccattgacgaggctgccaaagaaaagttcaccccttattcatctttgacccttgacgagagttaccaaagccgtgatcttgaaaaggtgtcacaacaaattgcgaaaccgttttatgatgctaaagtgcaaccaacgactttaataccaaaggaagtcggtaacatgtacactgcttctctctacgctgcatttgcttccctcatccacaagaaacacaatgatttggcgggaaagcgggtggttatgttctcttatggaagtggctcaaccgcaacaatgttctcattacgcctcaacgacaataagcctcctttcagcatttcaaacattgcatctgtaatggatgttggcggtaaattgaaagctagacatgagtatgcacctgagaagtttgtggagacaatgaagctaatggaacataggtatggagcaaaggactttgtgacaaccaaggagggtattatagatcttttggcaccgggaacttattatctgaaagaggttgattccttgtaccggagattctatggcaagaaaggtgaagatggatctgtagccaatggacactgattcttgaaaaggaacaaatcataaaaagtcacctgaaaatgttatgttttacttgcaccattttaatcgttttataagtttgttgttactttgatttagggacaaagaaggaatgtattctctgtttttatttactgtttgatttactctctcatgcaaatgataatttggaaattattggaatctctattttgtatgtttgtgttctt

SEQ ID NO: 1297 - DNA, 1653 bp, Brassica juncea
  misc_feature (425)..(425): n is a, c, g, or t
  misc_feature (464)..(464): n is a, c, g, or t
  misc_feature (563)..(563): n is a, c, g, or t
  misc_feature (923)..(923): n is a, c, g, or t
tacatagcttctctaaactctctctccctctctctctctctaagaccgaaccttcgatctcattctctggagaagaaagttcaatcctttttgattcaacaatggcgaagaacgtagggatattggctatggacatctattttcctcccacctgtgttcaacaggaagctttggaagctcatgatggagcaagcaaaggcaaatacaccattggacttggccaagattgtttagctttttgcactgagcttgaagatgtcatctcaatgagtttcaatgcggtgacatctcttctagacaagtacaagattgaccccaagcaaattgggcgtcttgaagtaggaagtgagactgtcattgacaaaagcaagtccatcaaaaccttcttgatgcaactctttgagaaatgtggaaacactgatgtngaaggtgttgactcgaccaatgcttgttatggtggaacngcagctttgctaaactgtgtcaattgggttgagagtaactcctgggatggacgctatggccttgtcatttgtactgacagtgcggtttatgcagaaggncccgcaaggcccactggaggagcagctgccattgctatgttgataggaccagatgctcctattgtttttgagagcaaactgagaggaagccacatggctcatgtctatgacttttacaagccaaatcttgctagcgagtacccggttgttgatggtaagctttcacagacatgctaccttatggcacttgactcttgctataaacatttatgcaacaagtttgagaaacttgagggcaaagagttctccatcaatgatgcagactactttgtcttccattctccatacaacaaacttgtacagaaaagctttgctcgtctcttgtacaacgacttcttgagaaacgcaagctccattgangaggctgccaaagagaagttcactccttattcgtctttgtcactcgacgagagttaccaaagccgtgatcttgaaaaggtgtcacaacaagttgcgaaaacgttttatgatgctaaagtgcaaccaacgactttagtaccaaaagaagtcggtaacatgtacaccgcttctctctacgcagcatttgcttctctcatccacaacaaacacagcgatttggcgggaaagagggtggttatgttctcatatggaagtggttcaaccgcaacaatgttctcattgcgtctctgcgaaaaccagtctcctttcagcctctcaaacattgcatctgtgatggacatcggcggtaaactgaaggctagacatgagtatgcacctgagaagtttgtggagacaatgaagctgatggaacataggtacggagcaaaggagtttgtgacgagcaaagaaggtatcttagaccttttggctccgggaacttattatctgaaagaggttgattccttgtaccggagattctatggcaagaaaggagacgatggatccatagccaatggacactgaatctttaaaggcaaaagaagcatcaatcacttataagatggtctctactcatcaactctttatgttactttccaatattttaaacgttgttatgaagtttgttgttactttgatctagggacaaagtttgtgtgctctgtttcttatttatttactattgatttgc

SEQ ID NO: 1298 - DNA, 1732 bp, Glycine max
atgtgagtttctctgcactcgatcaaacacaaaatggaaaagaatgtggggattctcgccattgacatctacttccctcccgcttgcgttcagcaggaagcattggagactcatgatggtgccagtaaagggaagtataccattggacttggccaagactgcatgtcattctgtaccgaagtagaagatgtcatctcaatgagtttgacagtggttacttctcttcttgagaagtatgggattgatcctaaacaaatcggtcgtctggaagttggaagcgagaccgtgatagacaaaagcaaatccatcaagacattcctgatgcagatcttcgagaaatatggaaatactgacattgagggtgttgattcaactaatgcatgctatggaggaactgctgctctgtttaattgtgtcaattgggtggagagcaattcatgggatggacgctatggacttgttgtctgcactgacagtgcagtctatgctgaaggacctgcccgacctactggaggagctgctgctattgccatgctaattggtcctgatgctcccatttcttttgaaagcaaattgagaggaagtcatatgtctcatgtttacgatttttacaaacctaatcttgccagtgaatatccagttgttgatggaaagctttcacaaacttgttacctcatggctgttgattcttgctataagaatttctgtcacaagtttcagaaattccagggaaaacaattttctctttttgatgctgaatactttgtatttcactctccttataacaagcttgtacagaagagttttgctcggttgtttttcaatgacttcttgatgaattccagctctgcggatgaggttgccaaagaaaaactgggaccttttgcaactttatctggtgatgagagctaccaaagtcgggatcttgaaaaggcatcccagctacttgcaaagcctctatatgatcagaaggtacaaccaactactttgattccaaagcaagttggaaacatgtacactgcgtctctttatgcagcatttgcctccctcattcacaacaaacatagcacattggcaggtaagagggtgatattattctcatacggaagtggcttaactgccacaatgttttctttgcaattacgagacagtcaacatccgtttagcttgtcaaacatggctagagtgatgaatgtcgatggaaaattgaagtcaagacatgagtttcccccggaggagtttgttgaaaacttgaagttaatggagcatagatatggtgcgaaggaatttgtgacaagcaaggacagtagccttttatctccgggcacattctatctcactgaagttgactccatgtatcggagattctattcaaagaaaactaaagaaagcagtttgactcacgctgagaacggtgtgattgctaatggcgttgctaatggccactgatgttgagcatgtacaatcagcagtcaacttcgcctagaatgaggaagggtattgttatttgcgaagttctgttggtaaattgtttctggggtggcaagtgttatcgattcaaacattttattgtattcttttaagatgtagctagttactctagtctaagtcttgtacacacaaaaaaaaaaagttactcaagtctaaattttatctttttctgtgtattttttgcattttagtgaatggaaattagtctttgaataaaaaaaagttgcaataacttttattc

SEQ ID NO: 1299 - DNA, 615 bp, Solanum tuberosum
ttaaaaaatcctctgttttcttcaaacaacaaagttcccaaaaatgtctcttattccaagcttctttggtggtcgcaggagcaacatcttcgacccattttcccttgacttatgggatccattccagggattcccaatttcaaccaatgccccatcctctgctcgtgaaatctctgcttttgcaaatgcaaaaatcgattggaaagagaccccagaagctcacgtcttcaaagtggacgttccggggatcaagaaagaggaagtgaaagttgaagtggaagaaggaaggattttacaaattagcggtgagagaagcagagaacaagaggagaagaacgatcaatggcaccgtatggagaggagcagcggtaagtttttaaggagattcaggttgccggagaatgcaaagacgggagaaataaaggcagcgatggagaatggggtgctcactgtgactgttcctaaagaagaagagaagaagaaatctgaggtgaaggccattgacatttctggttaaagaaatgcagatcaagtgtttgatgaaagtccctttatcaataatgcattaatgtttggtttgttgggaaattaagcttttaatctgaattatgtgta

SEQ ID NO: 1300 - DNA, 641 bp, Solanum tuberosum
tcctctgttttcttcaaacaagaaagcttccaaaaatgtctctgattccaagcttcttcggtggtcgtaagaagcaacatcttcgacccattttcccttgacttatgggatccattcgagggcttcccaatttcaaccaatgccccatcatctactcgtgaaatctctgcttttgcaaatgcaaaaatcgattggaaagagacccctgaagctcacatcttcaaagtggacgttccggggataaagaaagaggaagtgaaagttgaagtggaagaaggaaggattttacagattagcggtgagagaagcagagaacaagaggagaagaacgatcagtggcaccgtatggagaggagcagcggtaaatttttaaggagattcaggttgccggagaatgcaaagacgggagaaataaaggcagcgatggagaatggggtgctgactgtgactgttcctaaagaagaagagaagaagaaatctgaggtgaaggccattgacatctctggttaaagaaatgcagatcaagtgtttgatgaaagtccctttgtcaataatgtattaatgtttggtttgtagggaaattaagcttttaatcttgaattatgtgtatgtgtaattgtctaagttgtaaacaagaaaat

SEQ ID NO: 1301 - DNA, 844 bp, Solanum phureja
gcctcttactgttcctatcagaaataaagtgaagaagatgctagattacactcgaattgcttgagtttctcagattcatcgactataaatatcaccatactttctttggtttatcatcagcaagtaatcaagcactagaatcaaaagttaaaaaatcctctgttttcttcaaacaacaaagttcccaaaaatgtctcttattccaagcttcttcggtggtcgcaggagcaacatcttcgacccattttctcttgacttatgggatccattcgagggcttcccaatttcaaccaatgtcccatcctctgctcgtgaaatctctgcttttgcaaatgcaaaaatagattggaaagagaccccagaagctcacgtcttcaaagtggacgttccggggataaagaaagaggaagtgagagtcgaagtggaagaaggaaggattttacagattagcggtgagagaagcagagagcaagaagagaagaacgatcagtggcaccgtatggagaggagtagcggtaagtttttaaggagattcagactgccggagaatacgaagacgggagaaattaaggcagcgatggagaatggggtactgactgtgactgttccaaaagaagaagagaagaagaaatctgaggtgaaggccattgacatttctggttaaacacaagtgcagatcaaaagtcgctctgtcaataatgtctgtttctcaagtattttggtttgttggagattaagcttttaatttgaattgtgtatgtgtaattgtggtcttcttctacttgcatttgtaaacaagaaaatgttgtgagagtttaattaatgaaaaatttctttttaaaaa

SEQ ID NO: 1302 - DNA, 682 bp, Solanum tuberosum
aagttaaaaaatcctctgttttcttcaaacaacaaagttcccaaaaatgtctcttattccaagcttctttggtggtcgcaggagcaacatcttcgacccattttcccttgacttatgggatccattccagggattcccaatttcaaccacactcgccagtgccccatcctctgctcgtgaaatctctgcttttgcaaatgcaaaaatcgattggaaagagaccccagaagctcatgtcttcaaagtggacgttccggggatcaagaaagaggaagtgaaagttgaagtggaagaaggaaggattttacaaattagcggtgagagaagcagagaacaagaggagaagaacgatcaatggcaccgtatggagaggagtagcggtaagtttttaaggagattcaggttgccggagaatgcaaagacgggagaaataaaggcagcgatggagaatggggtgctcactgtgactgttcctaaagaagaagagaagaagaaatctgaggtgaaggccattgacatttctggttaaagaaatgcagatcaagtgtttgatgaaagtccctttatcaataatgcattaatgtttggtttgttgggaaattaagcttttaatctgaattatgtgtaattgtctaagttgtaaacaagaaaatggtgtgagagtttaattaatgaataattt

SEQ ID NO: 1303 - DNA, 905 bp, Solanum lycopersicum
tgactgttccgtatctaaaatgaagcaaagaagaggctagaatacactcgagtttctcagattcatcgactataaataccaccatactttctttagtttatccatcaccaagcaatcaggcaaattaatcactacaatcttaagttcgaaatatcctctgttttcttcaaacaacaaatgtctctgattccaagcttctttggtggtaggaggagtaacatcttcgacccattttctctcgacttatgggatcccttcgagggcttcccaatttcaaccaccattgccaacgatccatcctctgctcgtgaaatctctgcttttgcaaatgcgaaaattgattggaaagagaccccacaagctcacgtcttcaaagtggatgttcctgggataaacaaagaggaggttaaagttgaagtagaagaaggaaggattttacagcttagcggtgagagaagcagagagaaagaagagaagaacgataagtggcatcgtatggagaggagcagcggtaagtttttaagaagattcaggttgccggagaatgcaaaaacaggggaaataaaggcagcgatggagaatggagtgctgactgtgactgttccaaaagaagaagagaagaagaagtctgaggcgaaggccattgacatctctggttaaacaagtgtttgatgaaatttcctctctcaataatatctgctttctcaagtacttttggtttgttggagattaagatcttaattttaatgtatgtgtaattgtttaagattgtggtcttcttctactagcatttgtaaacaagacaatgtcgcgagtgtttaattaatgaaaaatttctttttgttgtaaactggatgtcaacattattgtatcattttgcggtaagttaattatataaaaaaaaa

SEQ ID NO: 1304 - DNA, 780 bp, Solanum phureja
gagtttctcagattcatcgactataaatatcacagatactttctctagtttatcatcagcaagtcatcaagcaaatcaagcactacaatcaacaatttaaaaaatcctctgttttcttcaaacaagaaagcttccaaaaatgtctctgattccaagcttcttcggtggtcgtaagagcaacatcttcgacccattttcccttgacttatgggatccattcgagggcttcccaatttcaaccaatgccccatcatctactcgtgaaatctctgcttttgcaaatgcaaaaatcgattggaaagagacccctgaagctcacatcttcaaagtggacgttccggggataaagaaagaggaagtggaagttgaagtggaagaaggaaggattttacagattagcggtgagagaagcagagaacaagaggagaagaacgatcagtggcaccgtatggagaggagcagcggtaagtttataagaagattcaggttaccggagaatacgaagacgggagaaataaaggcagcgatggagaatggggtgctcactgtgactgttcctaaagaagaagagaagaagaaatctgaggtgaaggccattgacatctctggttaaagaaatgcagatcaagtgtttgatgaaagtccctttgtcaataatgtattaatgtttggtttgtagggaaattaagcttttaatcttgaattatgtgtatgtgtaattgtctaagttgtaaacaagaaaatgtttgtgagtttaattaatgaataatttcattttta

SEQ ID NO: 1305 - DNA, 781 bp, Solanum lycopersicum
  misc_feature (740)..(740): n is a, c, g, or t
atcgcaagtcatcaagcaaatcaatcactacaatcaaaagtttaaaatatcctctgttttcttcaaacaacaaatgtctcttattccaagcttctttggtggtcggaggagcaatatcttcgacccattttcccttgacttatgggatcccttggagggctttccaatttcaaccaccattgccaacaatccatcctctgctcgtgaaatctctgcttttgcaaatgcgaaaatagattggaaagagaccccacaagctcacgtcttcaaagtggacgttccggggatcaagaaagaggaagttcaagttgaagtagaagaaggaagaattttacagattaggggtgagagaagcagagagaaaaaagagaagaacgatcagtggcaccgtatggagaggagcagcggtaagtttttaagaagattcaggttaccagaaaatgcaaagacgggagaaataaaggcagcgatggagaatggggtgctcacagtgactgttccaaaagaagaagagaagaagaaacctgaggtgaaggccattgaaatttcaggttaaacacaattgcagtgcagatgaaaagtgcttttgtcaataatgtttgttttcctaaaaatattttggtttgttgggaaattaagcttttaatctgaattttgtgacattataaatgtctaagttgtaagcaagaaaatgttgtgagaattttattttttaatgaataatttcccttctcttgaantttgttttaagactagatggataatgcttggtgctggggtc

SEQ ID NO: 1306 - DNA, 734 bp, Solanum lycopersicum
atcatcaagtcatcaagcaaatcaatcactacaatcaaaagtttaaaatatcctctgttttcttctaacaacaaatgtctcttattccaagcttctttggtggtcggaggagcaatatcttcgacccattttcccttgacctatgggatcccttggagggctttccaatttcaaccaccattgccaacaatccatcctctgctcgtgaaatctctgcttttgcaaatgtgaaaatagattggaaagagaccccacaagctcacgtcttcaaagtggacgttccggggatcaagaaagaggaagttcaagttgaagtagaagaaggaaggattttacagattaggggtgagagaagcagagagaaagaagagaagaacgataagtggcaccgtatggagaggagcagcggtaagtttttaagaagattcaggttgccggagaatgcaaagacgggaaaaataaaggcagcgatggagaatggagtgctgacagtgattgttccaaaagaagaagagaagaagaaatctgaggtgaaggccattgacatctctggttaaacaagtgtttgatgaaagtcccttttttaataatgtctgtgtttgtcaaagtatatttggtttgttgggagattaagcttttaatttgaagtatgtgttgtaattgtttaagattatgcatgaaaatgttttgagaatttacctaatgaataattcgtcttaatcctcgatcggaaa

SEQ ID NO: 1307 - DNA, 808 bp, Solanum tuberosum
gcctcttagtgttcctatcagaaataaagtgaagaagatgctagattacactcgaattgcttgagtttctcagattcatcgactataaatatcaccatactttctttggttcatcatcagcaagtaatcaagcactagaatcaaaagttaaaaaatcctctgttttcttcaaacaacaaagttcccaaaaatgtctctgattccaagcttcttcggtggtcgcaagagtaacattttcgacccattttcccttgacttatgggagggcttcccaatttcaaccacaatcgctaatgccccatcctctgctcgtgaaatctctgcttttgcaaatgcaaaaatagattggaaagagaccccagaagctcacgtcttcaaagtggacgttccggggataaagaaagaggaagtgaaagtcgaagtggaagaaggaaggattttacagattagcggtgagagaagcagagagcaagaagagaagaacgatcagtggcaccgtatggagaggagtagcggtaagtttataaggagattcagactgccggagaatacaaagacgggagaaataaaggcagcgatggagaatggggtgctcactgtgactgttcctaaagaagaagagaagaagaaatctgaggtgaaggccattgacatttctgattaaacacaagtgcagatcaaaagtccttttgtcaataatgtttgtattcctaagtattttggtttgttgggaaattaagcttttaatctgaattttgtgcatgtgtaatgtctaagttgtaaacaagaaaatgttgtgagagtttaa

SEQ ID NO: 1308 - DNA, 713 bp, Capsicum annuum
aatttgatagctttgtggggaatatcgtcgaatactctgagaacatcctagattacactccaattacattaagtttcttggttcatcatcgcctataaatatcacgacatcttctctcattggtcatcagcaaattattaaacgctacaatcaaagaaaaattcaagctctgtaatagttcatcttttgtcttcttcaaacgacaaagtccccaaaaaatgtctctgattccaagcttcttcggtggtcgcaggagcaacatcttcgacccattctccctcgacttatgggatccgttcgaaggcttcccaatttcaagcacaatcgccaacaccccctcctctgctcgtgaaacctctgctttcgcaaatgcaagaatcgattggaaagagaccccacaagcgcacatcttcaaagtagacgttccggggatcaagagagaggaagtgaaagtcgaagttgaagaaggaaggatactacagataagcggtgagaggagcagagagcaagaggagaagaatgatcagtggcaccgtatggagaggagcagtggcaagtttttgaggagatttaggctgccggagaatacgaaaacaggggaaattaaggcagctatggaggatggagtgctcactgtaactgttccaaaagaagaggagaagaaacctgaggtcaaggccattgacatatctggttaaacaagtgcatgccga

SEQ ID NO: 1309 - DNA, 855 bp, Capsicum annuum
ttctctggagaacatctaacttttttacactcccatcgcataaatctctccattcattgcctataaaaaccacgacaccacttctaattcgtcttcaccaagtaattttcaagcatatcaaacgctacaatcaaagaaatattcgttcaagctttttattaaacgttcttctgtttccttcaaacaacaaagccccaaaaaatgtctatgattccaagcttcttcggtggtcgcaggagcaacatcttcgacccagtctccctcgacctatgggatccgttcgagggcttcccaatttcaagcacaatcgccaacaccccctcctctgctcgtgaaacctctgctttcgcaaatgcaagaatcgattggaaagagaccccacaagcgcacatcttcaaagtagacgtgccggggatcaagaaagaggaagtgaaagtcgaagttgaagaaggaaggatactacagataagcggtgagaggagcagagagcaagaggagaagaatgatcagtggcaccgtatggagaggagcagtggcaagtttttgaggagatttaggctgccggagaatacgaagatgggggaaattaaagcagctatggagaatggagtgctcactgtaactgttcctaaagaagaggagaagagatctgaggtgaaggcaattgatatctctggttaaacaagtccatgcagatcaactgttgttttaaagtccttagtaagttatgtttggtgtaatctgaattatgtgtctgtgtaattgtctaagttgtgggtcttggctttggagttgtaaacaagaaaatgttgtgagagtttgattaatgaataatttccttttagcatttatttt

SEQ ID NO: 1310 - DNA, 833 bp, Solanum tuberosum
gcctcttagtgttcctatcagaaataaagtgaagaagatgctagattacactcgaattgcttgagtttctcagattcatcgactataaatatcaccatactttctttggttcatcatcagcaagtaatcaagcactagaatcaaaagttaaaaaatcctctgttttcttcaaacaacaaagttcccaaaaatgtctctgattccaagcttcttcggtggtcgcaagagtaacattttcgacccattttcccttgacttatgggagggcttcccaatttcaaccacaatcgctaatgccccatcctctgctcgtgaaatctctgcttttgcaaatgcaaaaatagattggaaagagaccccagaagctcacgtcttcaaagtggacgttccggggataaagaaagaggaagtgaaagtcgaagtggaagaaggaaggattttacagattagcggtgagagaagcagagagcaagaagagaagaacgatcagtggcaccgtatggagaggagtagcggtaagtttttaaggagattcagactgccggaaaatacgaagacgggagaaattaaggcagcgatggagaatggggtactgactgtgactgttccaaaagaagaagagaagaagaaatttgaggtgaaggccattgacatttttggttaaacacaagtgcagatcaaaagtcgctctgtcaataatgtctgtttctcaagaattttggtttgttggaaattaagcttttaatttgaattgggtatgggaaaaagtggtttttttttacttgcatttgtaaacaagaaaatgttgtgagagtttaattaatgaaaaattt

SEQ ID NO: 1311 - DNA, 919 bp, Solanum phureja
tgttcccaaaactacaagaagatcctagattacactgcaattgctaaagtatctggtttcatcggttataaatatcactgcaatttcatttccttcatcatcaaccaaatcaaacacttcaattgaaagcaaaaactcaagcttttatactctatactctgttttctacaacccaattttgagctaaaatgtctctgattccaaccttctttggtggtcgccggagcaatatcttcgacccattttcactagacatatgggatccactcgaaggtttcccaattgcaaaccccccatcctctgttaatgaaacctctgttttcgcaaatgcgaaaatcgattggaaagaaaccccggaagcccatgtctttaaagtggatgtacctgggattaagaaagaggaagtgaaagttgaagttgaagaaggaaggattttgcagattagtggtgagaggagtaaagaacaagaggagaagaatgatcaatggcaccgtatggagaggagtagtggtaagtttgtaaggaggtttaggttgccggagaatgtgaaaatggaggaaattaaggcggcgatggagaatggagtgcttactgtaactgttcctaaagaagaagagaagaaacctgaagtgaaagccattgatatttctggttgaaaaaaagttgcagatcaagtgtttgacgaaagtcctctgttaaaaatggagcaatacaattgtatttaccgtacggtataatacaatacattaattatattatgaaataatgggtaacaattatccaaaccgagtgtaagtcttttggtttgttaatgtgtgtttgtagtttgtctaaggttgtgtgtgtattctacttgctctttgtaatcaagaaaatgttgtgagtgtttaattaatgaataatttcttttttaacatat

SEQ ID NO: 1312 - DNA, 662 bp, Solanum tuberosum
atcaaaagttcaaaagtaatctgttttcttcaaacaagaaagcttccaaaaatgtctctgattccaagcttcttcggtggtcgaaagagcaacatctttgacccattttccctcgacttattcgagggcttcccaatttcaaccaatgtcccatcctctgctcgtgaagtctctgcttttgtaaatgcaaaaatggattggaaagagacctcagaagctcacatcttcaaagtggatgttccggggatcaagaaagaggaagtaaaagttgaagtggaagaagaagggattttacagattagcggtgagagaagcagagaacaagaggagaagaatgatcagtggcaccgtatggagaggagtagcggtaagtttttaaggagattcaggctgccggagaatacaaagacgggagaaataaaggcagcgatggagaatggggtgctcactgtgactgttcctaaagaagaagagaagaagaaatctgaggtaaaagccattgacatctctggttaaacaagtgcagataaaagttcgtttgtaatagtaatgtttaatttgggagattaagcttttaatctgaaatatgtgtgtgtgtaattgtctaatttgtaaacaagaaaatgttgtgagagtttaattaatgaacaattccttttagt

SEQ ID NO: 1313 - DNA, 664 bp, Solanum tuberosum
gcctcgtgccgctaccatcaaaagttcaaaagtaatctgttttcttcaaacaagaaagcttccaaaaatgtctctgattccaagcttcttcggtggtcgaaagagcaacatctttgacccattttccctcgacttattcgagggcttcccaatttcaaccaatgtcccatcctctgctcgtgaagtctctgcttttgtaaatgcaaaaatggattggaaagagacctcagaagctcacatcttcaaagtggatgttccggggatcaagaaagaggaagtaaaagttgaagtggaagaagaagggattttacagattagcggtgagagaagcagagaacaagaggagaagaatgatcagtggcaccgtatggagaggagtagcggtaagtttttaaggagattcaggctgccggagaatacaaagacgggagaaataaaggcagcgatggagaatggggtgctcactgtgactgttcctaaagaagaagagaagaagaaatctgaggtaaaagccattgacatctctggttaaacaagtgcagataaaagttcgtttgtaatagtaatgtttaatttgggagattaagcttttaatctgaaatatgtgtgtgtgtaattgtctaatttgtaaacaagaaaatgttgtgagagtttaattaatgaa

SEQ ID NO: 1314 - DNA, 826 bp, Solanum tuberosum
aaacacttcaattgaaaccaaaaactcaagcttttatactgcatactctgttttccacaacccaattttgagctaaaatgtctctgattccaactttctttagtggtcgccggagcaacatcttcgacccattttcactagacatatgggatccactcgaaggtttcccaattgcaaaccccccatcctctgttaatgaaacctctgttttcgcaaatgcgaaaatcgattggaaagaaaccccggaagcccatgtctttaaagtggatgtaccagggattaagaaagaggaagtgaaagttgaagttgaagaaggaaggatattgcagattagtggtgagaggagtaaagaacaagaggagaagaatgatcaatggcaccgtatggagaggagtagtggtaagtttgtaaggaggtttaggttgccggagaatgtgaaaatggaggaaattaaggcggcgatggagaatggtgtgcttactgtaactgttcctaaagaagaagagaagaaacctgaagtgaaagccattgatatttctggttgaaaaaaagttgcagatcaagtgtttgacgaaagtcctctgttaaaaatggagcaatacagtctattcaaacattctattcaaacattgtatttaccgtacggtataatacaatacattatattatgaaataatgggtaacaattatccaaaccgagtgtaagtcttttggtttgttaatgtgtgtttgtagtttgtctaagatagtgtgtgtattctacttgctccttgtaatcaagaaaatgttgtgagtgtttaattaatgaataatttcttttttaaca

SEQ ID NO: 1315 - DNA, 477 bp, Solanum lycopersicum
  misc_feature (34)..(34): n is a, c, g, or t
  misc_feature (61)..(61): n is a, c, g, or t
  misc_feature (75)..(75): n is a, c, g, or t
  misc_feature (92)..(92): n is a, c, g, or t
  misc_feature (103)..(103): n is a, c, g, or t
  misc_feature (107)..(110): n is a, c, g, or t
  misc_feature (113)..(113): n is a, c, g, or t
  misc_feature (124)..(124): n is a, c, g, or t
  misc_feature (129)..(129): n is a, c, g, or t
  misc_feature (136)..(136): n is a, c, g, or t
  misc_feature (138)..(138): n is a, c, g, or t
  misc_feature (150)..(150): n is a, c, g, or t
  misc_feature (154)..(154): n is a, c, g, or t
  misc_feature (184)..(184): n is a, c, g, or t
  misc_feature (188)..(188): n is a, c, g, or t
  misc_feature (191)..(191): n is a, c, g, or t
  misc_feature (235)..(235): n is a, c, g, or t
  misc_feature (238)..(238): n is a, c, g, or t
  misc_feature (244)..(244): n is a, c, g, or t
  misc_feature (250)..(250): n is a, c, g, or t
atcctctgttttcttcaaacaacaaatgtctctnattccaagcttctttggtggtcggagnagcaatatcttcgncccattttcccttgacntatgggatccnttcnnnnttncaaccaacacnccatnctctgcncntgaaatctctgntttngcaaatgcaaaaattgattggaaagagacnccanaanctcacgtcttcaaagtggatgttccggggatcaagaaagaggangtnaaagtngaagtngaagaaggaaggattttacagattagcggtgagagaaacagagagaaagaggagaagaacgatcagtggcaccgtatggagagaagcagcggtaagtttataaggagattcaggttgccggagaatgcaaaaacaggggaaataaaggcagcgatggagaatggagtgctgacagtgactgttccaaaagaagaagagaagaagaaacctgaggtgaaggccattga

SEQ ID NO: 1316 - DNA, 797 bp, Solanum tuberosum
tcaaacacttcaattgaaaccaaaaactcaagcttttatactctatactctgttttccacaacccaattttgagctaaaatgtctctgattccaactttctttggtggtcgccggagcaacatcttcgacccattttcactagacatatgggatccactcgaaggtttcccaattgcaaaccccccatcctctgttcatgaaacctctgttttcgcaaatgcgaaaatcgattggaaagaaaccccggaagcccatgtctttaaagtggatgtaccggggattaagaaagaggaagtgaaagttgaagttgaagaaggaaggattttgcagattagtggtgagaggagtaaagagcaagaggagaagaatgatcaatggcaccgtatggagaggagtagtggtaagtttgtaaggaggtttaggttgccggagaatgtgaaaatggaggaaattaaggcggcgatggagaatggagtgcttactgtaactgttcctaaagaagaagggaagaaacctgaagtgaaagccattgatatttctggttgaaaaaaagttgcagatcaagtgtttgtcgaaagtcctctgttaaaaatggagcaatacagtgtatttaccgtacggtataatacaatacattatattatgaaataatgggtaacaattatccaaatcgagtgtaagtcttttggtttgttaatatgtgtttgtagtttgtctaaggttgtgtgtgtatctctttgtaatcaagaaaatgttgtgagtgtttaattaatgaataatttcttttttaacaaaa

SEQ ID NO: 1317 - DNA, 541 bp, Solanum tuberosum
cttcaattgaaagcaaaaactcaagcttttatactctatactctgttttctacaacccaattttgagctaaaatgtctctgattccaaccttctttggtggtcgccggagcaatatcttcgacccattttcactagacactatgggatccactcgaaggtttcccaattgcaaaccccccatcctctgttcatgaaacctctgttttcgcaaatgcgaaaatcgattggaaagaaaccccggaagcccatgtctttaaagtggatgtaccggggattaagaaagaggaagtgaaagttgaagttgaagaaggaaggattttgcagattagtggtgagaggagtaaagagcaagaggagaagaatgatcaatggcaccgtatggagaggagtagtggtaagtttgtaaggaggtttaagttgccggagaatgtgaaaatggaggaaattaaggcggcgatggagaatggagtgcttactgtaactgtttctaaagaagaagggaaagaaacctgaagtgaaagccattgatatttctggttg

SEQ ID NO: 1318 - DNA, 682 bp, Solanum melongena
atcaggaaaaatcacctataataattatcctctctgttattcaagctaaaaatgtctctgattccaagcttctttggtggtcgccggagcaacatcttcgacccattttccctcgatttatgggacccattcgaaggtttccaaatctccaaccccccatcctctgttcgtgaaacctctgctttcgcaaacgcaagaatcgactggaaagaaaccccggaagctcatgtattcaaagtagatgtcccggggattaacaaggaggaagtgaaagttgaggttgaagaaggaaggattttgcagattagcggtgagaggagtaaagaacaagaggagaagaacgatcaatggcatcgtatggagaggagtagtgggaagtttttgaggaggttcaggttgccggagaatgtgaagatggaggaagttaaagcggccatggagaatggagtgcttactgttacagttccgaaagtggtagagaagaagcctgaagtgaaagctattgatatctctggttagggatgaaaaaagttgcagatcaagtgttcgatgaaagtcatctatcaataatgcttgcttatattttcgtcttttggtttgtgattatgtatgtgtttgtgtaatgttataatcgagaaaatgctatgagagtttaatatatggaatgcataatttcctttta

SEQ ID NO: 1319 - DNA, 444 bp, Solanum phureja
caaaaatgtctctgattccaagcttcttcggtggtcgtaagagcaacatcttcgacccattttcccttgacaatgccccatcatctactcgtgaaatctctgcttttgcaaatgcaaaaatcgattggaaagagacccctgaagctcacatcttcaaagtggacgttccggggataaagaaagaggaagtggaagttgaagtggaagaaggaaggattttacagattagcggtgagagaagcagagaacaagaggagaagaacgatcagtggcaccgtatggagaggagcagcggtaagtttataagaagattcaggttaccggagaatacgaagacgggagaaataaaggcagcgatggagaatggggtgctcactgtgactgttcctaaagaagaagagaagaagaaatctgaggtgaaggccattgacatctctggttaaa

SEQ ID NO: 1320 - DNA, 745 bp, Solanum phureja
gcaaatcaaacactaaaatcaaaagttaaaaaatcctctgttttcttcaaacacaacaaagttcccaaaaatgtctctgattccaagcttcttcggtggtcgcaagagtaacattttcgacccattttcccttgacttatgggatccattcccaatttcaaccaatgctccatcctctgctcgtgaagtctctgcttttgcaaatgcaaaaatcgattggaaagagaccccagaagctcacgtcttcaaagtggacgttcccgggataaagaaagaggaagtgaaagtcgaagtggaagaaggaaggattttacagattagcggtgagagaagcagagagcaagaagagaagaacgatcagtggcaccgtatggagaggagcagcggtaagtttataagaagattcaggttaccggagaatacgaagacgggagaaataaaggcagcgatggagaatggggtgctcactgtgactgttcctaaagaagaagagaagaaacatgaagtgaaggccaaagaagaagagaagaaacatgaagtgaaggccattgacatttctggttaaacaagtgtttgatgaaaggccctttgtcaataatgtctgttttctcaagtattttggtttgttaggagattaagcttttaatttgaattgtgtatgtgtaattgttaaagattgtggtcttcttctacttgcatttgtaaacaaaaaattgttgtcagagtttaattaatgaaaaatttc

SEQ ID NO: 1321 - DNA, 627 bp, Solanum tuberosum
aatcaagcactagaataaaaaattaaaaaatcctctgttttcttcaaacaacaaagttcccaaaaatgtctcttattccaagcttctttggtggtcgcaggagcaacatcttcgacccattttctcttgacttatgggatccattcgagggcttcccaatttcaaccaatgtcccatcctctgctcgtgaaatctctgcttttgcaaatgcaaaaatcgattggaaagagaccccagaagctcacgtcttcaaagtggacgttccagggatcaagaaagagaaagtgaaagttgaagttgaagaaggaaggattttacagattagcggtgagagaagcagagaacaagaggagaagaacgatcagtggcaccgtatggagaggagcagcggtaagtttataagaagattcaggttaccggagaatacgaagacgggagaaataaaggcagggatggagaatggggtgctcactgtgactgttcctaaagaaggaagagaagaaacatggaagtgaaggccattgacatttctggttaaacaagttggtggatgaaagaccctttttcaataatgtctgttttctcaagtatttgggtttgtcaaggagattaagcttttaatttgaa

SEQ ID NO: 1322 - DNA, 888 bp, Nicotiana tabacum
ggccattacggccggggagcacgaaaccttctaaatcaaacacaacaatcaaaatcacaatttcaagtctgttaattttccaaaatcccatttggaaagaaaaaaaaaagatggctatgattccaagtttctttggtggtagaaggagcaatattttcgacccgttttcacttgatatatttgatccgtttgagggctttccattttcaggcactgttgctaacgttccatcttctgctcgtgaaacttctgcttttgcaaatgcaagaattgattggaaagaaaccccagattcccatatcttcaaaatggatgttccagggattaagaaagaggaagtgaaagttgaagtagaagaaggaagagtattacagataagtggagaaaggagcagagagcaagaggagaagaacgacacgtggcatcgtatggaaagaagcagtggcaagtttatgagaaggtttaggctgccagaaaatgcgaaaatggaggaaattaaagctgctatggaaaatggagtactcactgtaactgtaccaaaagaagaagagaagaaatctgaagtgaaagctattgacatctctggttaaaaaatattatagagttttagttcttttgtgatgttatgtgtgtatggtgaataattttgaagtgttttgtatgtgatctttgttttctatgttttggatgtgttggatattttgggagtcttaagtttctaatgtgaattaggtctgtgtattattatatcttcaaagttgtgggtatctaatcaacagttgtaataaagagaatcctgttcttgtcagttttgtatatatatatatatatatatatatgtaatgtaaagatagttgctaatctaatcttatgtttttactgttgggg

SEQ ID NO: 1323 - DNA, 1163 bp, Solanum tuberosum
gcactagaatcaaaagtttaaaaatcctctgttttcttcaaacaacaaagttcccaaaaatgtctctgattccaagcttctttggtggtcgcaggcaggggcggatctacgttcaatgatgggggggttcatccgaacccccttcgtcgaaaaattacactatatatataagattaaattttgaatatatgtgtatatatatactattgaaccccctgaacatacaccaaaggcgtagctcagtggcgttgggggttcaggaatttgctctactgcatgcgatgtcgcgtgttcgaatccggacagaggcattttgttttatcagcatatttcaggcgttttatttttttaaaataaataataatgcaatcaaaaaatgatgtttagttccaaaaaattaaaacgctgattgggaatttaggatttattagtttaatccctaattataaagtcaaatattaaaaaatccgtttcttcttgattcgaccgtttaatccgacccgtttatatccgattcgacccgtttatttgtggatattatttacgtgattaattttttttgaacccccttgatgaaaatcctccctccgccactggtcgcaggtgcaacatcttcgacccattttcccttgacttatgggagggcttcccaatttcaaccacaatcgctaacgccccatcctctgctcgtgaaatctctgcttttgcaaatgcaaaaatagattggaaagagaccccagaagctcacgtcttcaaagtggacgttccggggatcaagaaagaggaggtaaaagttgaagttgaacaaggaaggattttacagattagcggtgagagaagcagagagcaagaagagaagaatgatcagtcgcaccgtatggagaggagcagcggtaagtttatgaggagatttagactgccggagaatacgaagacgggagaaattaaggcagcgatggagaatggggtactgactgtgactgttcctaaagaagaagagaagaagaaatctgaggtgaaggccattgacatttctggttaaacaccagtgcagatcaaaagtcgctttgtcaataatgtattaatgtttggtttgttgggatattaagcttttaatctgaattatgtggatgtgtaattgtctaagttgtaaacaagaaaat

SEQ ID NO: 1324 - DNA, 851 bp, Nicotiana tabacum
ggccattacggccggggatcagaaaatcatctaagcaaatcaaacactataatcaaaactcacaatttcaagttacgtaattttccaaaatcccatttagagaaaagagatggctttgattccaagtttatttggtggtagaaggagcaatattttcgacccgttttcacttgatatatttgatccatttgagggctttccattttcaggcactgttgctaatgttccatcctctgctcgtgaaacctcagcttttgcaaatgcaagaattgattggaaagaaaccccagattcccatatcttcaaaatggatgttccagggattaagaaagaggaagtgaaagttgaagtagaagaaggaagagtgttacagatcagtggggagagaagcagagagcaagaggagaagaatgacacgtggcatcgtatggaaaggagcagtggcaagtttatgagaaggtttaggctgccagaaaatgcaaaaatggaggaaattaaggctgctatggaaaatggagtgcttactgtaactgtaccaaaagaagaagagaagaaacctgaagtgaaagctattgacatctctggttaaaaataattagagtttaaggttgttgtacttgtgtgtaattatgtgtgtttagtgaataatcttaaaatgtctgttgaaagttattttgggtatttttagtgttaagtttgtaatgcgaattaaggtctatataattttatcttcaaaagggttgtggatttctaattttgagttgtactagtactagtaatcaagaggatcatgttaagagtgttgattttgtataaataaatatttgataatcttgtgtttttactgtttc

SEQ ID NO: 1325 - DNA, 870 bp, Nicotiana tabacum
ggccattacggccgggggtcaaacaattcgaatacaacaatcaagtacagcttaaacatcatctgattatcatcagtcaaagtcctcattcagataaaaatgtctttgattccaagcttctttggtggccgcaggagcaacatctttgatccattctccctcgacctatgggatcctttcgagggcttccctttctcccgcacagtcgccaacactccaacctctgctcgtgaaaccgctgctttcgccagcgctcgaattgattggaaagagaccccagaatcccacgtcttcaaggtggatcttcctggaattaagaaagaagaggtgaaggttgaggtagaagaaggaagagttctacaaattagtggggagagaagcagagaggaagaggagaataacgacaaatggcaccgtatggagaggagcagcggcaagttccttaggaggtttaggctgccggaaaataccaagatggaggagattaaagcagcaatggagaatggagtgctcactgtgactgtaccaaaaatggaggaaaagaaacctgaggtgaaggccattgacatctcttgttaaataacagagggcgcgcgagcggtggctactgatcgcctatgagttctgtgattctacttgtaatttcagaagtgttttcagtgtcttgttttctggaagtccgtctggtttttagtaacttttagctcaaaaatgtgtctgtacgatggtatttgtatgtttgtgggtcttttacatatacgcttgtaatcgatcaatgtagaatgctgtgtgccttttccgtcaacagcttatttagtgtttactctgtatacgtatatctaatatatagtactgattctttcatctgga

SEQ ID NO: 1326 - DNA, 854 bp, Solanum tuberosum
ctgtagaatcctctcaaagaagatcctagattatacttgaattgctttcatcacctataaatatcactgcaacttctctacttcatcttcaaacacttcaattgaatccaaaaattcaagctttatactctatactctgttttctacaacccaattttgagctaaaatgtctctgattccaactttctttggtcggagcaatattgtcgacccattatcactacacataggggatccattcgaagggtttccaattgctaaccctccatcctctgttcgtgaaacctctgttttcgcaaatgcaagaatcgattggaaagaaaccccggaagctcatgtttttaaagtggatgtacctgggattaagaaagaggaagtaaaagttgaagttgaagaaggaaggattttgcagattagtggtgagaggagtaaagagcaagaggagaagaatgatcagtggcactgtatggagaggagtagtggtaagtttgtaaggaggtttaagttgccggagaatgtgaaaatggaggaaattaaggcggcgatggagaatggagtgcttactgtaactgttcctaaagaagaagagaagaagcctgaggtgaaagccattaatatctctggttgaaaaaaagttgcagatcaagtgtttgttgaaagtcctctgtcaataatgtttgtgttttggtttgttatgtgtgtttgtaatttgtctaaggttttgtgtgtgtattttaacttgatcttgtaatcaagaaaatgtaatgtgagtttaataatgaataatttcctttgaaaccataaaaaagaacacacacacaaaaaaacatcgaaggcgcggggcccggttaccc

SEQ ID NO: 1327 - DNA, 803 bp, Solanum tuberosum
aatcctctcaaagaagatcctagattatacttgaattgctttcatcacctataaatatcactgcaacttctctacttcatcttcaaacacttcaattgaatccaaaaattcaagctttatactctatactctgttttctacaacccaattttgagctaaaatgtctctgattccaactttctttggtcggagcaatattgtcgacccattatcactacacataggggatccattcgaagggtttccaattgctaaccctccatcctctgttcgtgaaacctctgttttcgcaaatgcaagaatcgattggaaagaaaccccggaagctcatgtttttaaagtggatgtacctgggattaagaaagaggaagtaaaagttgaagttgaagaaggaaggattttgcagattagtggtgagaggagtaaagagcaagaggagaagaatgatcagtggcactgtatggagaggagtagtggtaagtttgtaaggaggtttaagttgccggagaatgtgaaaatggaggaaattaaggcggcgatggagaatggagtgcttactgtaactgttcctaaagaagaagagaagaagcctgaggtgaaagccattaatatctctggttgaaaaaaagttgcagatcaagtgtttgttgaaagtcctctgtcaataatgtttgtgttttggtttgttatgtgtgtttgtaatttgtctaaggttttgtgtgtgtattttaacttgatcttgtaatcaagaaaatgtaatgtgagtttaataatgaataatttcctttgaacataaaaaaaaa

SEQ ID NO: 1328 - DNA, 617 bp, Solanum tuberosum
atcaaacacttcaattgaaaccaaaaattcaagctttatactctatactctgttttctacaacccaattttgagctgaaatgtctctgattcctactttctttggtcggagcattatcgtcgacccattatcactagacaaatgggatccactcgaagggtttccaattgctaaccctacctcctctgttcgtgaaacctctgttttcgcaaatgcaagaatcgattggaaagaaaccccggaagctcatgtttttaaagtggatgtacctgggattaagaaagaggaagtgaaagttgaagttgaagaaggaaggatattgcagattagtggtgagaggagtaaagagcaagaggaggagaatgatcaatggcactgtatggagaggagtagtggtaagtttgtaaggaggtttaggttgccggagaatgtgaaaatgggggaaattaaggcggcgatggagaatggtgtgcttacagtaactattccgaaagaagaagagaagaagcctgagatgaaagccattgatatctctggttgaaaaaaagttgcagatcaagtgtttgttgaaattcctctgtcaataatgtttgtgttttggtttgttatgtgtgttt

SEQ ID NO: 1329 - DNA, 815 bp, Solanum phureja
gtttctatggaatattgtagaatcctctcaatgaagatcctagattatacttgaattgatttcatcacctataaatataactgcaacttctctccttcatcatcaaacacttcaattgaaaccaaaaattcaagctttacactctatactctgttttctacaacccaattttgagctaaaatgtctctgattccaactttctttggtcggagcaatatcgtcgacccattatcactacacataggggatccattcgaagggtttccaattgctaacccttcatcctctgttcgtgaaacctctgttttcgcaaatgcaagaatcgattggaaagaaaccccggaagctcatgtttttaaagtggatgtacctgggattaagaaagaggaagtgaaagttgaagttgaagaaggaaggattttgcagattagtggtgagaggagtaaagagcaagaggagaagaatgatcagtggcactgtatggagaggagtagtggtaagtttataaggaggtttaagttgccggagaatgtgaaaatggaggaaattaaggcggcgatggagaatggtgtgcttactgtaactgttcctaaagaagaagagaagaagcctgaggtgaaagctattaatatctctggttgaaaaaaagttgcagatcaagtgtttgttgaaagtcctctgtcaataatgtttgtgttttggtttgttatgtgtgtttgtaatttgtctaaggctttgtgtgtgtattttaacttgatcttgtaatcaagaaaatgtaatgtgagtttaataatgaataatttcctttggacata

SEQ ID NO: 1330 - DNA, 799 bp, Solanum tuberosum
tagaatcctctcaaagaagatcctagattatacttgaattgctaaagtttcatcacctataaatatcactgcaacttctctccttcatcatcaaacacttcaattgaaagcaaaaattcaagctttatactctatactctgttttctacaacccaattttgagctaaaatgtctctgattcctactttctttggtcggagcattattgtcgacccattatcacaagacatacgggatccattcgaagggtttccaattgctaacccttcatcctctgttcgtgaaacctctgttttcgcaaatgcaagaatcgattggaaagaaaccccggaagctcatgtttttaaagtggatgtacctgggattaagaaagaggaagtgaaagttgaagttgaagaaggaagggttttgcagattagtggtgagaggagtaaagagcaagaggagaagaatgatcagtggcactgtatggagaggagtagtggtaagtttgtaaggaagtttaggttgccggagaatgtgaaaatgggggaaattaaggcggcgatggagaatggtgtgcttactgtaactgttccgaaagaagaagagaagaagcctgaggtgaaagctattaatatctctggttgaaaaaaaaagttgcagatcaagtgtttgttgaaagtcctctgtcaataatgtttgtgttttggtttgttatgtgtgtttgtaatttgtctaaggctttgtgtgtgtattttaacttgatcttgtaatcaagaaaatgtaatgtgagtttaataatgaataatttcctttg

SEQ ID NO: 1331 - DNA, 799 bp, Triphysaria pusilla
tctctcgcgaacctaatacatgaacttgccagactcttcccctcactgagtcactctaaattatcgtcctcctttcctaattgctccccagaaaaaaactcgagtaagtctaaacaaattaaatatttttcatcaaaccagccgatctatcttttatctttcccctgtactaattcagcacgaaaatgtctctgattccaagcttatttggtaatcgccggagcaacgtgttcgatccattctcattggatatttgggatccatttgagggctttccgatttcaggtctgccatcatcagccgcccgagaaactacggcggtggccaacgctcgcatagactggaaggagacgccggaggcacacgtgttcaaggtggatgttcctgggctgaagaaagaggaagttaaggttgaggttgaggatggctccattttgcagatcagcggcgagaggagtaaggagcaagaggagaagaatgatacttggtatcgggttgagaggagctctggcaaattcctccgccgcttcaggctgccggaggatgcaaaattgggtgaggtgaaagctgcaatggagaatggggtgttgactgtgactgtgcccaaggaggaagtgaagaagcctgaggtcaaggcaattgacatctctggttaattaaccaattacgatgtagtttgtttggttgtgaatgtgatgaataatatgtgtgtcgttgtgttgtattgtgcttgttttgatattattagagttggaaataagtgtaatgatgtttggaaacgtagtaatggcaatgaagt

SEQ ID NO: 1332 - DNA, 802 bp, Nicotiana tabacum
gtcaaacaattcgaatacaacaatcaactacagtttaatttccagccttaaacatcatctgattatcatcagtcttgttccaattcagataaaaaatgtctctgattccgagcttctttggtggccgcaggagcaacgtgttcgatccattctccctcgacatatgggatccttttgagggcttccctttctccggcacagtcgccaacgttccaacctctgctttcgccaacgctcgaattgattggaaagagaccccagaagctcatgtcttcaaggtggatcttcctggaattaagaaagaggaggtgaaggttgaggtagaagaaggaagagttctacaaattagtggagagagaagcagagagcaagtggagaagaacgacaaatggcaccgtatggagaggagcagcggcaagttccttaggaggtttaggctgccggagaataccaagatggaggagattaaagcagcaatggagaatggagtgctcactgtgactgtcccaaaaatggaggaaaagaaacctgacgtgaaggccattgacatctctgcttaaataacggtggctgctgatctacctgtaatttcgaaagtgttttcagtgtcttgttttctggaagtctggtttttaggactcaaacaatgcgtctgtatgatcgtatttgtatgtttgtgggtcttttacgcatgcgcttgtaatcgatcaatgtagaatgttgtgcgcctttttccgttaacagcttatttactgtttgctctatatacgtatatctaatagtactggttgtttcatccggt

SEQ ID NO: 1333 - DNA, 810 bp, Mimulus guttatus
tcgatatttcaagaatttgcaagatcattctgatcacccatataaatacgcgtgcttcttcaaccaaatcccgtcaaaattagaaaccgagttatcaaatcaacaagttcatcatccacccagtattattttttgcagagatgtctctgattccaagcttctttggcaacggccgccggagcaacgtcttcgatccattttcattggatgtttgggacccatttgagggcttcccattctcctcagccgtcaccaatctcccttcctccgccagagaaacaaccgcggtggccaatgctaggatcgactggaaagagacgccggaggcacacttgttcaaggtggatgttcccgggttgaagaaggaagaagtgaaggttgaggttgaagatggcagtattcttcagatcagcggagagagaagcaaagagaaagaggagaagaacgacaagtggcaccgtgtggagaggagctccggcaaattcatccgcagattcaggctgccggagaatgctaaattggaggaggtgaaggcggcgatggagaatggggtgctgactgtgactgtgcccaaagaggaggtgaagaagcctgaggtcaaggcgattgacatctctggttaatgtttgaattttatatttcagcaagttttggtttgtctcgttgtaatgaataatgaataatgttggcgtatatttgggagcgtatttctatccggttttgtgcaaagtgaaatatcactatgtataatagaaattccggaataaagcccaactagtaaataacaaattacattttgcttttcacatt

SEQ ID NO: 1334 - DNA, 828 bp, Mimulus guttatus
tcgatatttcaagaatttgcaagatcattctgatcacccatataaatacgcgtgcttcttcaaccaaatcccgtcaaaaattagaaaccgagttatcaaatcaacaagttcatcatccacccagtattattttttgcagagatgtctctgattccaagcttctttggcaacggccgccggagcaacgtcttcgatccattttcattggatgtttgggacccatttgagggcttcccattctcctcagccgtcaccaatctcccttcctccgccagagaaacaaccgcggtggccaatgctaggatcgactggaaagagacgccggaggcacacttgttcaaggtggatgttcccgggttgaagaaggaagaagtgaaggttgaggttgaagatggcagtattcttcagatcagcggagagagaagcaaagagaaagaggagaagaacgacaagtggcaccgtgtggagaggagctccggcaaattcatccgcagattcaggctgccggagaatgctaaattggaggaggtgaaggcggcgatggagaatggggtgctgactgtgactgtgcccaaagaggaggtgaagaagcctgaggtcaaggcgattgacatctctggttaatgtttgaattttatatttcagcaagttttggtttgtctcgttgtaatgaataatgaataatgttggcgtatatttgggagcgtatttctatccggttttgtgcaaagtgaaatatcactatgtataatagaaattccggaataaagcccaactagtaaataacaaattacattttgcttttcacattaattcatttctatatgt

SEQ ID NO: 1335 - DNA, 456 bp, Mimulus guttatus
atgtctctgattccaagcttctttggcaacggccgccgtagcaacgttttcgatccattttcattggatgtttgggacccatttgagggcttcccattctcctccgccagagaaacaaccgcggcggcaaacgctcggatcgactggaaagagacgccggaggcccacttgtttaaagtggatgtacctggattgaagaaagaggaagtgaaggttgaggttgaggatggcagtattcttcagatcagtggagagagaagcaaggagaaagaggagaagaatgacaagtggcatcgtgtcgagaggagctccggcaaattcatccgccgattcaggctgccggagaatgcaaaattggaggaggtgaaggtggctatggagaacggggtgcttactgtgactgtgcccaaagaggaggtgaagaaacctgaggccaaagccattgacatatctggt

SEQ ID NO: 1336 - DNA, 771 bp, Mimulus guttatus
atcgaaaactagaaactcagttatctgcaaactatcaaattcttcatcaacaaccaaatcatccatccagtattattttttgaagaaatgtctttgataccaagcttctttggcaacggccgccgtagcaacattttcgatccattttcattggatgtttgggacccatttgagggcttcccattctcctccgccgttgccaatctcccttcctccgccagagaaacaaccgcggtggcaaatgctcggatcgactggaaagagacgccggaggcccacttgtttaaagtggatgttcccgggctgaaaaaggaagaagtgaaggttgaggttgaagatggcagtattcttcagataagcggagagagaagcaaagagcaggaggagaagaacgacaagtggcatcgcatcgagaggagctccggcaagttcatccgacgattcaggctgccggagaatgcaaaattggaacaggtgaaggcggcgatggagaatggggtgctgactgtgacggtgccgaaagaggaggtgaagaaacctgaggtcaagtccattgatatctctggttaatgttttaattttgtattccagtaacttttggtttggtttgtgtggttggttgtaatgaatgatgaataattgtttttatgttggcgtatatttggtagtactgtatttcttttgaattttgtatttgagcaagtttttgaaattgttttagtactgtatcactcactatgtataacagaaattccagaactggtaagtaac

SEQ ID NO: 1337 - DNA, 843 bp, Triphysaria pusilla
gtagaaagaacgagttttatctagaaaatgtcgtcaacaaaaggacatatatgaacttgctagattcatctattcgtcctataaaattttcgccctcactcctaattactcgacaagaagaagctatcaagtaattgcagatcaaattattactcttcatcaatctaatcgaatatgtctctgattccaagcatctttggtaaccgccggagcaacgtcttcgatccgttctctttggatatttgggatccatttgagggctttccgatctccaatatgccgtcttccgcccgagaaaccacggcggtggctaacgctcgcatcgactggaaagagacaccagaggcacacgtgttcaatgtggacgttcccgggctgaagaaagaggaagttaaggttgaggtcgaggacggctcgattctccagatcagcggcgagaggaagaaggagatggaggagaagaatgacacgtggcaccgcgttgagaggagctctggcaagttcctccgccgtttccgcctgccggagaatgcaaaattggctgaggtgaaggcagcgatggagaacggggtactgactgtgacggtgccaaaggaggaagtgaagaagccagctaaggcgatcgatatctccggttaaacaaatcgtgcatagttggttgtgttgtgtgcttgtcaaattactttgtgtgttgtgtgtagaaatgcaataaagtttattttagatagataacatcttgctatgctctttaattttgatgtaacttagtggagaaatgcaagttttgttatcctctattggtgttgtaaaaaactgttcgttaaaattgtgtctatttgatgt

SEQ ID NO: 1338 - DNA, 754 bp, Theobroma cacao
ccgcggggatcgtggaatatatatttgaaggttcaagcctttctttctttaagcttactttttattcgttgttcatagtttaatttgcagggatgtcactcattcctagcctttttggtggccgaagaaccaatgtcttcgatccattttctctagatgtatgggatccctttgatggcttctccaactctgcattggctaacaatgtgccttcttcggcacgcgaaacttcagcctttgctaacgcaaggattgattggaaggagacaccggaagctcacgttttcaaagctgaccttccagggctgaagaaagaggaggtgaaagttgaggttgaagaagggagggttcttcagataagtggggagaggagcaaagagcaagaagagaagaatgacacgtggcaccgcgtcgagaggagctgcgggaagttcctgaggaggttcaggttgcctgagaatgcaaagatggatcagattaaggctagcatggaaaatggtgtgctcactgttactgtccctaaggaggaggagaagaaacctgaggttaaggccattgatatatctggctaaaatatatggtgaaaacaacttaaagtttcatagaactcaatcatgaaaacaataagaaaatgttgttagcatttgtttgagtgtgaggtctttccattgtattccttatgctttttttaattaaaatgatgtagtagtgtgtgacaaggttttgaataaatttgtgcttgcttcgatctgat

SEQ ID NO: 1339 - DNA, 878 bp, Cucumis melo
gtaaacaaccaaaacaaattccccaattctgtcgactatatccatcaccttctgcaatcctaattcaaacgacaatgtcactcattccaagcattttcggtggccgccggagcaacgtctttgacccattttcattggacatttgggatccatttgaaggcttcccattttcaaattcgttggccaatgtcccctcatctgctgtcgaaacttctgcttttgccaacactcgcattgattggaaagaaaccccacaagcccacatcttcaaggcggatcttcccggaatcaagaaggaagaagtgaaagtagaagtggaagaaggcagagttttgcaaatcagtggagagaggagcaaagagcaggaggagaagaatgataaatggcatagagttgaacgaagcagtggaaagtttacgaggagattcaggctgccggagaatgctaaagtggaggaggtgaaggctaatatggagaatggagttctaacagtgacagtgcctaaagtggaagagaagaagcctgagatcaaatcaattgatatctctggctaaacgtcttatatttcttcctgcagtgtcttcccctgtagtagggatgagtttgtatgaataatgaatcctcaaaatcggtctttttaattttggtgtgttctgtaaccgtgaagagattgaagaaagttggttttatgtctgtgtataatatgttaccaaggttaatggatataatgaagttgtgagtttttaagcttaattttattaataaattaaattcaaagatgaatatattccactttcttgctacaagtaagagaagtatgaagttacgtgtcaatatatggtggttttgcaagtcgcatctatcacaaaaaaaaaaaa

SEQ ID NO: 1340 - DNA, 1013 bp, Nicotiana tabacum
ttccaatatcaatagttatatcgagaatatcctagattgcgctcgaaactcgataagttccttggtccatttctttttccttccaaaactcccacctataaataacactgggcgacgttttggttgtcgtcaaacaattcgaatacaacaatcaagtaccttataatttccagccttaagcatcatccgattatcatcagtcaagtcctcgttcagataaaaaaatgtctctgattccaagcttctttgatggccgcaggagcaacatcttcgatccattctccctcaacatatgggatcctttcgagggcttccctttctccggcacggtcgccaacattccaacctctactcgtgaaaccgctgctttctcgagtgctcgaattgattggaaagagaccccagaatcccatgtctttaaggtggatcttcctggaattaagaaagaggaggtgaaggtggaggtagaagaaggaagagttctacaaattagtggcgagagaagcagagagcaagaggagaagaacgataaatggcacagcatggagaggagcagcggaaagttccttaggaggtttaggttgccggagaatatcaaaatggaagagattaaggcaactatggagaatggggtgctcactgtgactgtcccaaaaatggaggaaaagaaacctgaggtgaaggccattgacatctctggttaaataacagagggcgcgcgctcggtggttgctgatctacttgtactttcggaagtgtacagtgtcttgttttctagaagtcttgtttttaggagcttttagctcaaaaatgtgtctgtatcatcatatttgtatgcttgtgggtgttttacatatacacttctactctatgaatgtagtaatttgtgtgccttttctgttaaccgcttatttactgtttcgctctctatacgtatacttgtcatttttagtccgtgcaaagctagacccaattccagaaattgaaggttgcaagagtatttgaaactcgac

SEQ ID NO: 1341 - DNA, 1624 bp, Cajanus cajan
ggggaccaaggtctttataaatcaaagggtgcttaaaagagaggaagagagaaaaagaaagagaatcatggaaagtggtgttgtggctgtaaataatcataactatgaatccaaagcaacatccaccatcaccattaagggcattcttagccttctaatggaaaacattgatgagaatggaagaaagagagttatttctcttggtatgggtgacccaactctcacaacattgttccacactcctaatgttgttgaagatgctgttgctcacactcttcagtctcacaagtttcatggctatgcccccactcctggtcttctccaagctagaattgcaattgcggaatatctgtctcgggaccttccttaccaactatcaagtgatgatgttttcatcacttgtggatgcacacaagccattgatgtttctgtggcgatgcttgctcgccccggtgcaaacattttgcttccaagaccaggcttcccaatatatgaactttgtgctgcatttagaggggttgaagtgaggcattatgatcttcttccacagaaaggttgggaggttgaccttgatgcagttgaagctcttgctgatcacaacacggttgcgttggtgattataaatcctgggaatccttgtgggaatgtgtacagttatcatcatttggaaaagattgctgaaactgcaaaaagggtaggaacaattgtgattgctgatgaagtttatggccaccttgcatttggaggcaagccttttgtgccaatgggagtttttggctctgttgttcctgttctcactcttggctctctctctaagagatggatagttcctggctggagacttggttggtttgtcacaaatgatccatctggcacttttagaaatccaaaggtagttgaacgcattaaaaagtattttgatcttttgggaggtccagccaccttcatccaggcagctgtacctcaaataattgcacttactgaagaagttttcttcaagaaaaccattgataatttgaggcttactgcagatatatgttgtaaagagataaaagatattccatgcattttttgcccttataaaccagaagggtccatggctatgatggtgaaactaaacctctcacttctagaagatatcagcgatgacattgacttctgtttcaaacttgcaaaggaagaatctgttatcattctaccaggaactgcagtaggactaaaagattggcttcgtattactttcgctgctgatccatctgctcttggagagggtatgagaagaataaaatctttctatcaaaggcatgccagaaaattgtaaaagcaatagtgaatccacaaataaacattatcataaaagtgtgttctccttttgctactacactacacaagaattagagattgtatttcaatatcgcattatatagtctggttagaaatgaaccatttaagtgcaagtatccacataatcaagaggtattcctcttcctattttatggacctttggtaatataataaatatgggtcttaatatattgttaatatccatgtcatcggtacgatatctattggcttgaactataaataatctatcagagaatttggataactaaaaaagtaaaaa

SEQ ID NO: 1342 - DNA, 1513 bp, Phaseolus coccineus
taacgtgtggtgttggggaaatcaaactcagaattctccactagggcctttacaaatccaaaaagacagaggctacaaagagaaaccaagcaaagtatggaaactggggctgtagctatgaacaacaacaacaacatcgtcaaccaccaccatgaagccagagcaacttccaccatcaccattaagggcatgctcagccttctaatggaaaacattgatgagaatttggatggtggaaccaagaaagttatttctctcggtatgggtgacccaactctcaccacattattccacgcacctaaggttgttgaagaagctgttgctgactctcttcactctcacaagtttcatggctatgcccccactgctggtcttctccaggctcgaatagcaattgctgaatatctatctcgtgaccttccttaccaattatcaagtgatgatgttttcatcactagtggatgcacacaagccattgatgtttcagtggcgatgcttgctcgccccggtgcaaacatcttgcttccaagaccaggcttcccaatctatgaacttagtgctgcatttagagggattgaagtgaggcattacgatctgcttccagagaaaggttgggaggttgatctagatgctgttgaagctagtgctgatcagaacacggctgcattggtgatcataaatcctggcaatccttgtgggaatgtgtacagttaccatcatttggaaaagatagctgaaactgcaaaacgggttggaacaattgtgatttctgatgaagtatatggtcaccttgcatttggggccaagccatttgtgccaatgggagtttttggctcagttgttcctgttctcactcttggctcactgtctaagagatggatagttcctggatggaggcttggttggttcgtcacgaatgatccatctggaacttttagagaaccaaaggtagttgagcgcattaaaaagtattttgatcttttgggaggtccagccactttcatccaggctgctgtacctcagataattgcaaatactgaagagattttcttcaataaaaccattgacaatttaaggcatactgcagatatatgttgcacagagataaaggatattccatgcattttttgcccttatagaccagaagggtccatggctatgatggtgaaactaaacctttcacttctagaagatattagtgatgatatagacttctgtttcaaacttgcaaaggaggaatctgtgatcattcttccaggaactgcagtagggctgaaagattggcttcgtattacctttgctgctgatccatgtgctcttggagagggtatgagaagaatgaagtctttctgtcaaaggcatgtaagaaaattgtaaaagcatgagtaataaaattattatagcataaaatctcattagagattttttttattcaaatagaatatttctttcttggataaataaaataaaatgaggtactttagaggtgctccaacctttatacaaaacactc

SEQ ID NO: 1343 - DNA, 1790 bp, Medicago truncatula
aacttaactcgctccatttcattttagacgggttgataacagggcgggttgtcctattgtgccctccaaataatgtcaggctgaattggtagccatgatgtttatcttccttccacatatattttgctattattaagaatgaataaaattacaagtagcattttacataagaaattagaaattcagaaaaactataacaaactgccaaagtttttgttcaggacaaaaacgtaacgtgtgtggtctttaagaaattcagaacgacccatcattattttttacgtagttatatacgagaaagaaaccaaacaagctcaaaaaacaaacatggaaagtggtgttggaacaatgaaccatgaatgcaaagcaacttcaactatcacaattaagggtattttgagtcttttaatggaaagtgttggtgagaataatgatgataacagcaagagagttatttctcttggaatgggtgaccctactctttccacatgcttccctaatgctaaggttgctgaagaagctgttgctgatgcactttgctctggaaactttcatggttatgctcctactgctggtcttctccaggctagaaatgcaattgccaaatatctgtctgatgacctcccttatgaactatcgtctgatgatgtttttataacctgtggatgcacacaagcaattgatgtttcagtggcgttgctttctcgccctggtgcaaatatcttgcttcctagaccaggctttccaatttatgaactttgtgctgcatttagacaagttgaagtgaggcattatgatctgttaccagaaaaaggctgggaggttgatttagatgctatcgaaaccctcgtggatcagaacacggtcgcgttagtgattataaaccctgggaatccttgtggaaatgtatacacttaccatcatttggagaagattgcagaaaccgcaaaaaggcttggaacaattgtgattgccgatgaagtttatggtcaccttgcatttggggataatccttttgtgcctatgggagtttttggctctactgttcctgttataactcttgggtccttgtctaagagatggatagtacctggatggaggcttggttggtttgtgacaaatgatccatctggtacttttagaaaaccaaaggtagttgagcgcatcaaaaagtattttgatctattaggaggcccggctacctttatccaggcggcagttcctcgcataattacacagacagaagaggttttcttcagaaaaaccattgacaaattgaggcataccgcagatatatgttgccaagagatggaagacattccatgcatttcattcccttgcaaaccacaagggtccatggctatgatggtggaactaaacctttcacttcttgaagatattagcgatgatattgatttctgtttcaaacttgcaaaggaggaatctgttatcattcttccaggaactgcggtaggattaaaagattggattcgtattacttttgcagccgatccatctgctctcagagatggtatgcaaaggataaagtcattctctcaaagacacgcgagaaaacagtaaaatcgaacaatggtgaataaacaaattaggtgtctgcaaagcatgtattatatttccttggacactttctcatgctaaaggttgcattcattttactacactacacaacaataatggaagatttacttgtatttcaatactgcatacagtctcaatagaaataaattgtttaatttcattaaacattgcaatatcagattcagagtaaa

SEQ ID NO: 1344 - DNA, 1448 bp, Lotus japonicus
ctatggaaagtggtgttgtgggtgtgaaccatgaatgcaagacaacttccaccatcacaattaagggaattctcagtctcttaatggaaaccattgatgatggcagcagcaagagagttatttcacttggcatgggtgacccaacactagccacatgcttccacaccaccaaagtttctgaagatgctgttgctgatactcttcaatctcacaagttccatggttatgctcccactgctggacttctccaaaccagaaatgcaattgctgaatatctgtcacgtgatctcccttaccagctatcatctgatgatgttttcatcactagtggatgcacacaagctattgatgtttcgatggcgctgcttgctcgccccggtgcgaatatcttgcttccaagaccaggcttcccaatctatgaactttctgcgtcatttagacaagtagaagtgaggcattatgatcttctgccagagaaaggttgggaggttgatctagatgctattgaagctcttgcagatcagaacacagttgcattggtgattataaaccctgggaatccttgtggaaatgtgtatagttaccatcagttggagaagattgcagaaactgcaaaaaggcttgggactgttgtgattgctgatgaagtttatggtcaccttgcatttggggccaatccctttgtaccaatgggaatttttggctctactgttcctgttatcactcttggatccctatctaagagatggatagtacctggatggaggcttggttggtttgtgacaaatgatccatgtggtacttttaggaaacctaaggtagtcgagcacattaaaaagtattttgatcttttgggcggtccagccactttcattcaggcggcagtacctcgcataattaagcagactgaagaggttttcttcaagaaaaccgttgagattttgaagtatacctcagaaatatgttgtaaaaagatagaggatattccatgcattttttgcccttgcaaacctgaagggtccatggctatgatggtgaaactgaatctttcgctgctggaagatattagtgatgacattgatttctctttcaaacttgcaaaggaggaatctgttatcattcttccaggaactgcagtagggcttaaagattggcttcggatcacttttgctgctgacccttctgcacttgcagagggcatggataggatacaatgtttttgtcaaaggcatgctaaaaaacagtaaaaacaacaatggtgaatccacaaataaggtgttaataatttgttggcaaggggctctttctccataataaaatcttggccaaatcaattggtgatttgcttcattgtttcctgattttctcaagtctagggtgattttttgcccattgtttcttgttatgtttctaagttatcagtatcactgtgtttatttaaatgatga

SEQ ID NO: 1345 - DNA, 1612 bp, Vigna unguiculata
  misc_feature (6)..(6): n is a, c, g, or t
  misc_feature (1529)..(1535): n is a, c, g, or t
  misc_feature (1537)..(1540): n is a, c, g, or t
gggcgnagaaacaacataacgtgtggtgtggggcgaaaccaaactcagaattctccactgggccttcacaaatccgaattaggcagaggcttcagagcatggaaactggggctgtggctatgaacaacaacagcagcaacgtcatccatcaccagaatgaaaccagagcaacttccaccatcaccattaagggcattctcagccttataatggaaaacattgatgtcaatttggatggtggaaacaagagagttatttctctgggtatgggtgacccaactctcaccacattattccacacacctaaggttgttgaagaagctgttgctgactctcttcactctcacaagtttcatggctatgctcccactgctggtcttccccaagctagaatagcaattgctgaatatctatctcgtgaccttccttacaagttatcaagtgatgatgttttcatcacatgtggatgcactcaagccattgatgtttcagtggcgatgcttgctcgcccaggtgcaaacatcttgcttccaagaccaggcttcccaatctatgaactcagtactgcatttagaggggttgaagtgaggcattacgatctgcttccagagaaaggttgggaggttgatctagatgctgttgaagctcttgctgatcagaacacggttggattggtgatcataaaccctgggaatccttgtgggaatgtgtacagttaccatcatttggaaaagattgctgaaactgcaaaacgggttggaacaattgtgatttctgatgaagtatatggccatcttgcatttggggcaaagccatttgtgccaatgggagtgtttggctccgttgttcctgttctcactcttggctcactgtctaagagatggatagttcctggatggaggcttggttggttcgtaacaaatgatccatctggcacttttagagaaccaaaggtagttgagcgtattaaaaagtattttgatcttctgggaggcccacccactttcatccagagacatgttttaactgatgaaagactagactagtattcactggtggctgctagctatgttagctgatcaaattcaagtgatttggtttggtgctactgatatatgcagctgtacctcagataattgcaaatactgaagagattttcttcaataaaaccattgacaatttgaggcatactgcagatatatgttgtacagagataaaggatattccatgcattgtttgcccttacagaccagaagggtccatggctatgatggtgaaactaaacctttcactcctagaagatataagtgatgatatagacttctgtttcaaacttgcaaaggaggaatctgtaatcattcttccaggaactgcagttgggctaaaagattggcttcgtattacctttgcagctgatccatgtgcccttggagagggtatgaaaaggataaagtctttctgtcaaaggcatgcaagaaaattgtaaaagcatttgtgaacctacaaataaataaaattattacactaannnnnnnannnnaatatagcatattgtatttcaattaagcgttcagtttcatgagatatattaattgcaacatcattaaaagcg

SEQ ID NO: 1346 - DNA, 719 bp, Glycine max
aggcattttgaaaatagttcagtttgttattcaccaacgttaaacgttaacgctaacgcggtcttataaaatgttagcttaataataatttgaaacctcttactttgagagacagtggcagcggtggtactctgaaattgatcctctcagtctcaggaacacggtgcgttagtaaaaagtgaaaaagaaatggcagaactgagtttgggaattctaattgacattgttgatgaggaatggatgagagacactcttcctgatgatgatcttccactgcccccaacactggttgttaggacagatgatactgaggactcaaatcaggagactcaacaagttaatgtggatgcttggcacgatcttgcctttggtcaagaatagaagtttcatcattaactagtgtctagtgttgtgctttgtaattagtgagtggatgatggtgctccctggtatttggactaggcatcttcctttctttttccctgatagattgtaacttattcatgtttatcaactactagtaaccgttaaggttatattaaggaattgtgctatcattgctgaatgttaatgtttgctgtcaggaaagcactgttgtatttttgctttaaggttgaagcaaatttagggcaaccagtccctactggtatgctctggagtctgaaacttgtattaatatgtttaatagtaatatatagtagtactactgttgtttggaa

SEQ ID NO: 1347 - DNA, 977 bp, Cajanus cajan
ggggactctcaaattgatcctctgagtctgagtctgagtctcagttccttgcaatttctttttctctttaatttcattctttcaaatcctttctgcatcttcgccgcgggtaagcattttttcgtgttacataacggtgtgggttttaaggaaattaaaattttaggttttgcattcacttttatttgtttattataaattaggcatttatgcttatttatttaattttacaacttcaattgttatgttaacactgaacaggaacacggtgcttttgtaaaaaagtggagaaaaatggcagaattgagtttgggaattctaattgatattgttgatgaggaatggatgagagacactcttcctgatgatgatcttccacttcccccaacactggttgtcagaacagatgacaccgaggactcaaatcaggagacgcaacaagttaatgcagatgcttggcacgatcttgccttgggtcaagaatagaagtttcattaactagtgtcatgcttagtagtttgtgagtagatggtggtgctccctggtattggactaggcatctttctttctatttccctgatagattgtaacgtattaaagtttatcaacctgttaatgtgatattaaggaattgtagtgtcattactgaatgtaatcgtttgctgtcatggaagcactcttatttttgctttaaggtttaagcaaatttagggcagcccgtgcctaatggtggagtactggtatgcttcgaaacctgtattaaactacgtttaatattaacatgtttaatgataatatacagtttctttgaatacagtaggagtacttgtttgatattagttattttttgaagaaatacttgcttaattttttaaaaaaaattatttttaagaaaaacttgacaaaagtaagtcgaacacacaataagttgcaacttgtgcttggttagttggttatgctagctgtattcatgagtt

SEQ ID NO: 1348 - DNA, 452 bp, Phaseolus coccineus
ttccttatttatggccggggaaggacagtactactactccacttgatccactccgcatcaggaacacggtgtgcgttggttaaacttgaaaagacaaaatggcagaactgagtttgggaattctaattgacattgttgatgaagagtggatgagagatactctccctgatgatgatcttccactgcccccaacactggttgtaaggacagatgatactgaggactcaaatcaggagactcaacaagttaacgcggatgcttggcacgatcttgccttgggtcaagaatagaaatttgatttactagtatgttatgctttgtagttagtaagtatggatgatgcttcttgttgtaatgaattcaaagtttataaacctgttaaggtgatattaaggaattgttcgaagtttataaacctgttcactatggtattacggaattatgtcattgct

SEQ ID NO: 1349 - DNA, 638 bp, Vigna unguiculata
ggactgaaggggggcaagcacgggataacctcctattgatccacttatcagaatcaggaacaccgactgcgttggtgaaaattgaaaatagaaaatggcagaattgagtttgggaattttaattgacattgttgatgaagaatggatgagagacactctccctgatgacgatcttccactgcccccaacactggttgtaaggacagatgatactgaggactcaaatcaggagactcaacaagttaacgtggatgcttggcacgatcttgccttgggtcaagaatagaagtttcatttacttttatgttatggtttgtaattagtgagtagagatgatgcttcctgttgtaatgaattcaaattttataaacctggtaagtatggtattactgaattgtgtcattgctgaatactatttgtttttgctgtcacgaaagcactcttggacttttggtggtcgcaaggttagggcatgcccgagcctaaagatagagtattggtacgctctgaagtttgtattaaattagtaaatgattgacaatagtaatatcaagttttttaagatatggtaatggtttggttggagtagtgtgaatgggattatagatactaaactcggtgtaatcatcatgcaaaac

SEQ ID NO: 1350 - DNA, 487 bp, Glycyrrhiza uralensis
gagtgcagcaatctcaaattaatccatccatcctctccgctcagtggtggaaaaggtaacaaatggcagaactgagtttgggaattctagttgatattgttgatgaagaatggatgagagacactctccctgaagatgatcttccactgcctccaacactggttgttcgaacggatgatacggaggactcaaatcaggagacacagcaagttaatgtggatgcttggcacgatcttgcccttggccaagaatagaagtttcattaactagtgtcatgctagtagttagtagatgatattgcttccagctcctttttatgtccgtgatagatcgtattattgtaaggtattcaagtttatcaacctgtaaaaggttatgtcaaggaattcgggagtcattgctgattgcttgctgtcatgaaagcactctttgtatttttgctttataatttaaggccaacgtatgcatgatgatagattaaaaaaaa

SEQ ID NO: 1351 - DNA, 562 bp, Medicago truncatula
atcctaatatttttcatcgcaagcaagcagtcgtaaattacagcacaataagcttttctccagaatctctccaagtgcagtgtgaagaaaaaaatggcagaactgagtttgggaattctaattgacatcgttgatgaggattggatgagagacactcttcctcaagatgatcttccacttcctccaacactggttgttcggacagatgatactgaggactcaaatcaggaggcacaacaagttaataaggatgcttggcacgatcttgcccttggccaagagtagaagtttcaataaaatagtgctaatatgtcatgcttagtagtaagtagatggtatttattccggataccggactaggcaccttcctttctatgtacgtgaaagacattaagaaattttggtttcatttctagttgattactgtcataaaaacactcttgtatttttgctttgaactctaaaggcaaccttgtgcataatgatagattactgttgtgaagcacaaatctgtaataaattttgtcaacggtgttaagtttgggaaatagagagtttaaat

SEQ ID NO: 1352 - DNA, 1066 bp, Acacia harpophylla
gactctatcggtcagtttcacattggccggccgaaaaaaagtcagtctattttcagattgaggtaacatttctggctctatgctctgcgcctactccgcttcgtccactacgccggcgattacttacctaggtttggcttctcacacagtcagctgtacttttctctaattttcttttaacttcgaatctaccactgtggactgctttcttttcttccttttcatcacttgctcggtatccagcattgagtgtcgttgaagagaatttctaatgtcagatactcaattacgagctcgctgatgttcggccgtaattggccatgtttaagaaatgatctttccatccctgctaattttaaatcgctatttaaaatatagattcatatcataattgacgcatgacgctgcataagagaattagtattctgtttttttgttcaaatatcttatatactgcagttttcttcgagctcgttaaggctaggatgcttatgttaagatttgcgtgtcaattcttctgcttttcatcgccgctctcatgcattttacgaatagggcataggctgttgaatggtcagatatggcagaactgagcttgggtattcttattgatattgttgatgaggaatggatgagagatacactccccgatgatgatcttccactacctccaacactgatagttcggaccgacgatactgaggactcaaatcaggaaactcaacaaattaatgcggattcctggcatgatcttgccatgggccctgaatagaaaccttacttgtcaacgagcgccatacttcgtagtaagtagatggtgttctgtgtttgtttatgtcatatcatccattttgtacttctatcaagtgtaatgttgaattcctagtttttgttgtcatttacgttgtgtaattagagaaggaatgttaatgatatttcgacttaattagttagcctcccgagctatttcatttattttatatgacataaggtgcatgtagtgcatcctactttcattcgtaacagatttatatccatgcaatttgtttgaatgataaaaaaaaaa

SEQ ID NO: 1353 - DNA, 610 bp, Arachis hypogaea
ttgcgctgctcatacagtgtggacattggcagtggtctcaaattgaagccttctgactctgagttcccattttctctctaagggtgtggtggaaaaaagtgaaatatggcagaagtgagtttgggaattctgattgatattgttgacgaagaatggatgagagacactctcccggatgatgatctcccactctccccaaccctagttgttcggacagatgataccgaggacccaaatcaggagacacaagaagttaatgcggatgcttggcacgatcttgccttaggtcaagaatagaaagttgattagtttcatgctttggagtaggtttgagacaatgatgcttcttgttactgaactacgtgccatccttcctatttcttggataaattttatgcttcaattttacgaaccagttcatgtgatgtcattgcccatggattgctgtcactagaagtaccttgtatagttgtattgccggttaatagaaaccagcacttgataatgcattttggcatgtttattagattttttgttcaagtaatacctttaataaagtaagcagaaaatattgtatctttttgtttggacgagaatcaactttaatata

SEQ ID NO: 1354 - DNA, 622 bp, Arachis hypogaea
ttaacttttagttgcgctgctcatacagtgtggacattggcagtggtctcaaattgaagccttctgactctgagttcccattttctctctaagggtgtggtggaaaaaagtgaaatatggcagaagtgagtttgggaattctgattgatattgttgacgaagaatggatgagagacactctcccggatgatgatctcccactctccccaaccctagttgttcggacagatgataccgaggacccaaatcaggagacacaagaagttaatgcggatgcttggcacgatcttgccttaggtcaagaatagaaagttgattagtttcatgctttggagttaggtttgagacaatgatgcttcttgttactgaactacgtgccatccttcctatttcttgattaaattttatgcttcaattttacgaaccagttcatgtgatgtcattgcccatggattgctgtcactagaagtaccttgtatagttgtattgccggttaatagaaaccagcacttgataatgcattttggcatgtttattagattttttgttcaagtaatacctttaataaagtaagcagagaatattgtatctttttgtttggacgataatcaactttaatata

SEQ ID NO: 1355 - DNA, 568 bp, Arachis hypogaea
cataggattccgatcctattgtgttgccttcgggatcggagtaatgattaacagggacagtgtggacattggcagtggtctcaaattgaagccttctgactctgagttcccattttctctctaagggtgtggtggaaaaaagtgaaatatggcagaagtgagtttgggaattctgattgatattgttgacgaagaatggatgagagacactctcccggatgatgatctcccactctccccaaccctagttgttcggacagatgataccgaggacccaaatcaggagacacaagaagttaatgcggatgcttggcacgatcttgccttaggtcaagaatagaaagttgattagtttcatgctttggagtaggtttgagacaatgatgcttcttgttactgaactacgtgccatccttcctatttcttggataaattttatgcttcaattttacgaaccagttcatgtgatgtcattgcccatggattgctgtcactagaagtaccttgtatagttgtattgccggttaatagaaaccagcacttgataatgcattttggcatgtttatc

SEQ ID NO: 1356 - DNA, 554 bp, Manihot esculenta
aggtaattaattgaagtgctgagcaaatatggcagaattaagcctgggtgttcttatagatgtcgtggacgaggaatggatgagagacacattgcctgatgatgatctcccacttccaccagtgctggttgttcgtactgatgacggtgaagattcaaatcaggagactcaacaggttaatggagatacttggcatgaccttgcattaggcaatcagtgaaccattctggccctgagggaagttggtgtgcagtggaagcagcggaaatctattggaaactttgttatgggatgtgtatcagtttcatgaatctaatatgtaattgatttgaagtagcctcagtttcacatcgtcctagtcctttcttaagctctgttgaacttgcagttggattttgaatgtgtgatagaggtgtatctatttgtgtgtttaaatataaattgctcttcgtttgaatgttgctaaagttgtaagcatatcaaaccctgcatccatgccctatgttgctcttcgtttgaagtagcctcagttgcaatctgtgttgaatttagcc

SEQ ID NO: 1357 - DNA, 559 bp, Manihot esculenta
tatccaggtaattaattgaagtgctgagcaaatatggcagaattaagcctgggtgttcttatagatgtcgtggacgaggaatggatgagagacacattgcctgatgatgatctcccacttccaccagtgctggttgttcgtactgatgacggtgaagattcaaatcaggagactcaacaggttaatggagatacttggcatgaccttgcattaggcaatcagtgaaccattctggccctgagggaagttggtgtgcagtggaagcagcggaaatctattggaaactttgttatgggatgtgtatcagtttcatgaatctaatatgtaattgatttgaagtagcctcagtttcacatcgtcctagtcctttcttaagctctgttgaacttgcagttggattttgaatgtgtgatagaggtgtatctatttgtgtgtttaaatataaattgctcttcgtttgaatgttgctaaagttgtaagcatatcaaaccctgcatccatgccctatgttgctcttcgtttgaagtagcctcagttgcaatctgtgttgaatttagcc

SEQ ID NO: 1358 - DNA, 718 bp, Citrus sinensis
tagtgtcagcatagtctcactatttgaggattttatagggttataatggctgcgatctttccctcggccatctctcatctctggtcaaattcataggtacagattggatatggcagaactaagccagggaatcctaattgatattgtggatgaagaatggatgagagacactctacctgatgatgatctcccattgccaccagtgctggttgttcgacctgatgatactgaagactcaaaccaggagcctcaacaggtgaatgaagatacttggcatgatcttgcaatgggtacccagtgaaactcttgaatgtattgtccttcattttgagcttagttaggttctcagttatatgtagcttttcgttcagatgcgactggcaatgaggtatcaggggagtctggaggggcatattatctgaattttcttatacggagtagaatttctaatgtttaagtgtgcgagaatgtatgtgtttgtttttctacttgaatagaatttattaaattagcaattgacatttacatttaatagatttgtgattctgggatcctaaagttcatagtttcctcattttggaacccattaaaccaaaatcctagttgtggttcggttccacgactacaacaaaggctaacctctcttgaaaatgaggaaggaagctatgggttacgggacaggattctattttttcttctgactgccttcagtttctaa

SEQ ID NO: 1359 - DNA, 823 bp, Populus trichocarpa
gcaggtacatattctcaagcttctttcttcgcttttccttttatttctccaagttcactgctttgtaccccagttttctgccttgatcttcattttagctttaatctaattcagattttcaacatgttcgataaaatgcctcaaccaaactttaccccattttctgtttatttttagcacttgagagaagtttttgtactctttatatccttggaggatcactaatatcgaatgttgcttaacctttgtgcaatttgtttgtggtgtgtatttttgaaagggaattcgattgaagtaagaagcaaatatggcagaactaaacatgggtattcttatagatattgtggacgaggaatggatgagagacactttgcctgatgatgatcttgcattaccaccggtgatggttgtcaggactgatgatactgaagattcaaatcaggagactcaacatgtggacacagatgcttggcatgatttggccttaggcaatcagtaaagttttctggtgccagatcttctgtttatttgttgtggaatctgtcgagatggttgaacctttgtttttgagacttagttttctcaatgatctgaaatctagactgagtcctgtttgtgtgtaaggtttcagaaaaaacaactactctttatgtaattgaattggggggggggggcttcattgggtgtattgtgtaaaatggttccacacctgctcatccccttcaaagtatgttgaggctttgccccatttcgtgatggcggtgacatgtttataagttaataatggcattaatgaaaagtcctgtgtgtaaattgagtttca

SEQ ID NO: 1360 - DNA, 824 bp, Populus trichocarpa
gcaggtacatattctcaagcttctttcttcgcttttccttttatttctccaagttcactgctttgtaccccagttttctgccttgatcttcattttagctttaatctaattcagattttcaacatgttcgataaaatgcctcaaccaaactttaccccattttctgtttatttttagcacttgagagaagtttttgtactctttatatccttggaggatcactaatatcgaatgttgcttaacctttgtgcaatttgtttgtggtgtgtatttttgaaagggaattcgattgaagtaagaagcaaatatggcagaactaaacatgggtattcttatagatattgtggacgaggaatggatgagagacactttgcctgatgatgatcttgcattaccaccggtgatggttgtcaggactgatgatactgaagattcaaatcaggagactcaacatgtggacacagatgcttggcatgatttggccttaggcaatcagtaaagttttctggtgccagatcttctgtttatttgttgtggaatctgtcgagatggttgaacctttgtttttgagacttagttttctcaatgatctgaaatctagactgagtcctgtttgtgtgtaaggtttcagaaaaaacaactactctttatgtaattgaatttggggggggggggcttcattgggtgtattgtgtaaaatggttccacacctgcccatccccttcaaagtatgttgaggctttgccccatttcgtgatggcggtgacatgtttataagttaataatggcattaatgaaaagtcctgtgtgtaaattgagtttca

SEQ ID NO: 1361 - DNA, 617 bp, Lotus japonicus
gaaatctttattttgtgctcagtttgagagacagggttgaagtttcagattgatcaatcctctcaggaatacagtgtggtgagaaggtgaaaaatggctgaagtgagtttgggaattcttattgatgttgttgatgaggaatggatgagagacactattcctgatgatgatcttcccttaccgccaacattggttgttcggacagatgatactgaggaaacaaatcaggagacacaacacgttaatgaggataaatggcacgatcttgccttgggccgagaagttcattaactagtgtcactctcagcagtgatgatggtgcttccagttactggacgaggcaccttcttcctttatccctgataggttgtaatgtattcaagtttatcgacctgttaagaaagattttaaggaattcgggtgtcattgctgatttcttgctgtcatgaatgcattctgtattttgctatgtattttgcggtttaatcaagttaaggacaacccttacctaaagatgcagtactggtactctcacaaatatgtataactaaatatgttttagtctaggaccatgataatatctgagagacaattgaggaaatcaagtatgtgttatg

SEQ ID NO: 1362 - DNA, 611 bp, Coffea canephora
cgcaccaccactactgagtccctctttcacagagtcacacagcaggaagaaaggaaggaagggtatggcggaatgcccgagcctggggattctgatcgatatagtagatgaagattggatgagagacacccttccagatgatgatcttccgttaccacccgtacttgtttccagaactgatgacactgaagattctaatcaagaggttcagcaagttgatggcgatacgtggcatgatcttgcactgggaaactcctaaataccagattacggcctggggaagtatatattggacaagttatgttttccagacgcaatcatagcagcccctttgacatagatggaaactctactattttgaactctagtttcaagaagtgatgtttcagtgtcaaactttttgtgcgaaccctgtgatgcagacatgagttcttttcttctctctttttgctgtgtaaatgcattttgattgcccaggtgacttttgcacgcttaggaaatattttggttctgtaatgatgatcacattctttagccacgtaacttgtgctagcaacgatgcagtgaatttaatcactgtagctatggttttgaaggaacgtgttccatcc

SEQ ID NO: 1363 - DNA, 684 bp, Coffea canephora
cggccgggggatatataaggctgaagctgaagtgtatttttcaaaattcaatcgcaattgctactggtactggcgcaccactacaactgagtccctctttcacagagtcacacagcaggaagaaaggaaggaagggtatggcggaatgcccgagcctggggattctgatcgatatagtagatgaagattggatgagagacacccttccagatgatgatcttccgttaccacctgtacttgtttccagaactgatgacactgaagattctaatcaagaggttcagcaagttgatggcgatacgtggcatgatcttgcactgggaaactcctaaataccagattacggcctggggaagtatatattggacaagttatgttttccagacgcaatcatagcagcccctttgacatagatggaaactctactattttgaactctagtttcaagaagtgatgtttcagtgtcaaactttttgtgcgaaccctgtgatgcagacatgagttcttttcttctctctttttgctgtgtaaatgcattttgattgcccaggtgacttttgcacgcttaggaaatattttggttctgtaatgatgatcacattctttagccacgtaacttgtgctagcaacgatgcagtgaatttaatcactgtagctatggttttgaaggaacgtgttccatcc

SEQ ID NO: 1364 - DNA, 587 bp, Orobanche aegyptiaca
attggcccaataccctcccgagaaccagcccgaacgaagatttcgccttcaattgaaggaaaactgaatttcaggtcaattagaaaagggtttaacaatggcggaattaaccttgggcatactcatagacatcttggacgaggaatggatgagagatactttgcccgacgacgatctcccattgccgcctgtacttgtttctaggactgatgaaactgaagattcaaatcaagaaactcaaccggttgaggctgatacgtggcatgatcttgcactgggtaattaatcattgacgcggcaaattatgatattgtactcaatttgaatttgtttgtttgaaaactcgagctactatctgccgtgtgaaccgcgatggttttcatgttctactgagagattttctattgttggttcgtcgagtgagtctactagatgagttcttcaagactcttggaagaagatatactgaaattgcatatggatcactcttcatggacttggttattgtactagtgattttatatctctggatattgaattagaatgtgaaaaagaactacatagatgttttgaggcatgtttcacat

SEQ ID NO: 1365 - DNA, 685 bp, Vitis vinifera
aatgcttttcacagtgaaagaaagctgagggagagccacgccgtcgccactgcgaagctgaataaagccgttcaccgctgcctccttcagcaacctttgtgtttttttatctctactatatctaaaaatcaaaagggccacccacttctctcactcgggcatcaagaagcccttttctgaagttgccctccagacgagagaatccctaaaaaggccctattttcctctgccactctcaatcctcgcaggatattgaggcaagtatagattacgcatggctgaattaagccttggtgtgcttatagatattgtggatgaggaatggatgagagacactctgcctgttgatgatcttccattgccacctgtactggttgctcgaactgaagatacggaagactcgaaccaggagaaccaacaagttgatggagatacttggcatgatcttgcattgggcgctcaatgaggcttttggacataaggagggttttatcactaagttttggtttctgtaagcctggaaagtgaataaagaaagggcatttggcatttaaacatcaacttctcttgtccttccactttcctctccttctgtcgcccttgtcctcccaaaccccagttcctattccaagggaaaaacctgaagaataactttatggtcattgacattataagcaggttttat

SEQ ID NO: 1366 - DNA, 983 bp, Prunus persica
  misc_feature (491)..(491): n is a, c, g, or t
  misc_feature (497)..(498): n is a, c, g, or t
  misc_feature (500)..(501): n is a, c, g, or t
  misc_feature (503)..(503): n is a, c, g, or t
  misc_feature (505)..(505): n is a, c, g, or t
  misc_feature (509)..(509): n is a, c, g, or t
  misc_feature (511)..(512): n is a, c, g, or t
tgttggttgttttttgggctgttgtccagtcaataatttttaacttctatttcatcaaggcaatcatgttacatacccgtcaaaccttgtgacatggtgcctaatgttattccctgtttgcggtgatatacagatggtaattggagaaagttactgttctaatcagttggtttgtttgtctgatttcttcagttcaccaacagaaactatgacatggtttccatgtagcatgattttggcggaaatttggtgtaactctgctaaaattgatttttataaacaacttagtgtcattttgagagacggaaagcatccgggaatcgactagacttgaaatctttaaagcttccttagacatctagcataagctagaatgcgggtgtattgctttattgcctgttaggtctttgctggtaaagtttttgtctttccgtaggtatcatacagagccagaatgtctcatttgttccatatcaggcgatttagtgttncagagnntnncntncacnannatacaccgatactagttcgaactgcacaaaaattctggattagattttccttgggtatagaacaaatggctgagttaaacccgggtatactcatagatattgtggatgaagaatggatgagaagcactcttcctgatgatgaacttccccttcccccagtgcttgttgtacggactgatgacaccgaggattcaaatcaggagactcaacgagttgctgcagatggttggcatgaccttgctttaggttctcagtgatttttattttattttatttacttttatggcataagaatttgtgtaagtacagccttctttcgaaacgtaattgaaccattgtcctttggatttcttgaatatgaggttttggaggctatcttattgacgtgaagctgatcttctgtatattttgtaagcagatagcatattttatttttccttcgaaacacttttaggcttggaccatattttt

SEQ ID NO: 1367 - DNA, 531 bp, Prunus persica
  misc_feature (452)..(455): n is a, c, g, or t
  misc_feature (457)..(458): n is a, c, g, or t
  misc_feature (460)..(461): n is a, c, g, or t
  misc_feature (463)..(464): n is a, c, g, or t
  misc_feature (466)..(468): n is a, c, g, or t
  misc_feature (474)..(475): n is a, c, g, or t
  misc_feature (477)..(482): n is a, c, g, or t
  misc_feature (484)..(489): n is a, c, g, or t
  misc_feature (493)..(494): n is a, c, g, or t
  misc_feature (496)..(496): n is a, c, g, or t
  misc_feature (498)..(498): n is a, c, g, or t
  misc_feature (500)..(501): n is a, c, g, or t
  misc_feature (503)..(503): n is a, c, g, or t
  misc_feature (505)..(505): n is a, c, g, or t
gaccgaacgaatgtttttctgaggcctctctgttctttgtcgtctctctgcaagtttggatacaccaatactagtttgaactgcacaaaaaaattctggattagattttccttgggtatagaacaaatggctgagttaaacccgggtatactcatagatattgtggatgaagaatggatgagaagcactcttcctgatgatgaacttccccttccgccagtgcttgttgtacggactgatgacaccgaggattcaaatcaggagactcaacgagttgctgcagatggttggcatgaccttgctttaggttctcagtgatttttattttattttatttacttttatggtataagaatttgtgtaagtacagccttctttcgaaacgtaattgaagcattgtcctctggatttgttgaatatgaggttttggtggctatcttattgacatgaannnnannanntnnannnctaaanntnnnnnntnnnnnntaanntnanannanantttttattttttccttcgaaacactt

SEQ ID NO: 1368 - DNA, 605 bp, Quercus alba
cttcccctgagtctgactcagttctcaattctctctcatctctctctctctctcacacagagtcacagacagcaaacatggcagaaataagcctggggatactaatagatattgtggatgaggattggatgagagacaccttgcccaatgatgatcttccattaccaccagttttggttgttagaaatgatgacactgaggaatcaaatcaggagactcaacaggttggtggagatacttggcatgatcttgcattaggcactcaatacagctctcatgcctcaggaggtgcataagcaatacttttgaagtggttggatcctttttattgagggatttgaagttcatggctctctttccttgtgtgagaacccttagaatttttcatgtaaaagactgtagttttattttgataatcatacgagaagactttggttattagtcctttgatggaagagctatggtgaaatgtcaatttatacaatgttctcttttgcactggcacatcaccatgtatatatatgtacttcacttccctgtcatgtggagttcatccttaagttctcttcgtctgcagtaatatgaattgctctgcttgttaatac

SEQ ID NO: 1369 - DNA, 749 bp, Castanea mollissima
tgggttgttgaataatgtagctaagttgagagctttatgtgtttgatttattagtctattctaaatgcttcttatattagttttcttttaaacttttggctatgtattatgggcatgagttcatttgctatcgttaatataaaaaatcagttaaatatcataagcacgtgtcgtgatttatgatataattgtttttccttgtatgaactgctaggtgttctgtttcagtgacttgcttaaatctgaatggttataatttgttaagccacaagagaccgatttttaagttatacttcactctctcacagagtcacagcaaacatggcagaaataagcctggggatactaatagatattgtggatgaggattggatgagagacaccttgcctaatgatgatcttccattaccaccagttttggttgttagaaatgatgacactgaggaatcaaatcaggagactcaacaggttggtggagatacttggcatgatcttgcattaggcactcaatacagctctcatgcctcaggaggagcataatcaatactttcttttgaagtggttggatccttttcattgagagatttgatgttcatggctctcttcccttgtgtgagaacccttagaatttttcatgtaaaagactgtagttctattttgataattatatgagaagactttggttattagtcctttgatggaagagctatggtgaagtgtcaatttatacaatgttctcttttgcaccg

SEQ ID NO: 1370 - DNA, 1736 bp, Arabidopsis lyrata
ttctctcgattctctctctcttaagtgagcttcgccgttaaaatttctccggtaccggaaaattaataacgaagaaagcgagaagacactgttacactaattagaaatctctccctctctctctctatctttctttgtcgaagtcgtgcgtgatgctagttacggtggtgaagcagcggttagtgtactctcgccggagaaatcggttataaccagaatctcacctccgtgatcgaagaatctgttttccggttttgacagtttcgaaatttttgagaagaaatggaaaaacaggcgaagctaacgaggacacagtcgtcgttgctccggtcatcgtcgaatcttcgttcgtcatttcaaagcttatcttcaatcgtcgaaggcgaacaagatctagaagccggagagaaagaagagaaacagagaagaaaaccacctaaaccattcggttcatcaagtcctaaatccggtttaactcggattaaccccggtttagctttcacaatggtgtctctctctttccttagtctctcatcgttcttcttcttcgtcgtcttctcacaaaccgatgagattctcacatcggagaatcttttactagctttaatattcgtcgccgtagctctcttcttcgcttccaagaacatcgctcttcttaaccaaaccgtaatcgcaatcaaacaaatttcgggtttcaaagcagaaactcaaaatcaaaaccggtacaatggtacatcggagacgatactaaaccggagaagaagatcataaagcggttcattaaagaaggagttcaattctacagtaatggagatttctacgaaggtgaatttcacaaagggaagtgtaacggaagtggagtttattactatttcgtgagaggaagatatgaaggagattggatagatgggagatatgatggtcatgggattgagagttgggctagaggaagtagatataaaggtcaatataggcaaggtcttagacatggttatggagtttatagattctacactggtgattgttatgctggtgaatggtttaatggtcaaagccatggttttggtgtccaatcttgtgctgatggtagctcttatgttggtgagtctagatttggtgttaaacatggtcttggttcttaccatttcagaaatggagataagtatgcaggagagtattttggagacaagattcatgggtttggtgtgtatcgatttgctaatggtcattgttatgaaggagcatggcatgaaggtcgtaagcaagggtttggtgcttactcgtttagaactggtgatgctaaatctggtgaatgggattcagggaagcttgtaacttctcttcctcttacgagtgagccagtttcaagagcggttcaggcggctcgagaaacagcgaacaaggcagtgaatcggagacgagtagatgagcaggtgagccgagccgtggctgcagctaataaggctgctacggctgcaagagtggctgctgtgagagctgttcagaatcaaatggaaggtaaattttgtcaaagttgaaaacaaaaattgtaaaaatcttttgtttttaccggtcttctctgtaaccctgattgagctaaaaaaaatggtagcttgtttcagaggtttgtaacagagagtaattttcgatctttttactaatgtaacaaactgtaaatagttgaagaagctggtgtttttacttttgttgtaaatcaacggcttgaaatggagctt

SEQ ID NO: 1371 - DNA, 1655 bp, Brassica napus
aagcatagaagctttagcctcgccgttaaaaatttctcgaaatttgataaaccaggagaaacaaaaatcacaagttacggatctctatctatctcgttggtgatgcttgctacggcggtgacgcggcggctagtgtattctcgccggagaaaccgagaagttcggttatagccacgatctcgaatttacaggaagctttcgtgatcgtgtttttactgtgttcgaatttttccgaaagagatggaaggacaggcgaagctgacgaggacacagtcgtcgctgctccggtcaccgtcgacgacggtaagatcgtcttttcagagcttaagtgtaatcgctagcgaagtctctcaccagagacaagatctagaagccggagagaaagaagagaagcagagaagaaaaccgcctaaaccgttcggttccagtcctcgaaccggtttaacccgaatcaacccgggtctagccttcacgatggtttctctctccttcctcagcctctcgtctttcatcttcttcgtcgtcttctcccaaaccgatgagcttctcacctccgagaacctcctcctagctctgatcttcgtcgccgtcgctctcttcttcgcctccaagaacatcgctctcctcaaccaaaccatactcgcactcaaagaaaccaccaaactctttggcttccacagcaagaaccggtcagaaccggttcagtggtacatcggcgataccgaaaccaaaccggagaagaagatcaaaccgttcgtcaaagaaggagttcatttctacagcaacggagatttctacgaaggagagtttcacaaagggaaatgcaacgggagcggtgtgtactactacttcgtgagaggacgttacgaaggtgattgggtcgatgggaggtacgatggtcatgggatcgagagctgggctagagggagtagatacaaaggccagtataggcaagggcttagacacggttacggagtttacagattctacactggtgattgctacgctggtgagtggcttaatggtcaaagccatgggtttggtgttcagtcttgtgctgatggtagctcttatgttggtgaatcaagatttggtgttaaacatgggcttggatcttaccatttcagaaatggagataagtatgcgggagagtattttggagacaagatccatgggtttggtgtgtatcgttttgctaatggtcattgttatgaaggagcgtggcacgaaggtcgtaagcaagggtatggtgcttactcgtttagaaccggtgatgctaaatccggtgaatgggattcagggaatcttataacgtttcttcatcctacgagcgagccggttcggagagcggttcaggcagctagagaaacggctaagaaggctgtgactcggagacgagtagatgagcaagttagccgagccgtggcagctgctaataaggctgcaacggcggcaagagtggctgcagtaaaagcagttcagaatcagatggatggtaacttttgtcaaagttgaaaactttggtggaagtgtaaatttttcttttgttgttcttttttcctctgtgtaaccctgattgagctaaaataatggaagcttgtttcagaggtttttaccagagtaattttccatgtaacagaaactgtaaatatcag

SEQ ID NO: 1372 - DNA, 1499 bp, Brassica napus
  misc_feature (790)..(790): n is a, c, g, or t
  misc_feature (826)..(826): n is a, c, g, or t
  misc_feature (842)..(842): n is a, c, g, or t
  misc_feature (844)..(844): n is a, c, g, or t
  misc_feature (856)..(856): n is a, c, g, or t
  misc_feature (865)..(865): n is a, c, g, or t
  misc_feature (880)..(880): n is a, c, g, or t
  misc_feature (913)..(913): n is a, c, g, or t
  misc_feature (1000)..(1000): n is a, c, g, or t
  misc_feature (1062)..(1062): n is a, c, g, or t
gggtctctctctctccctctcaaagcatagaagctttagcctcgccgttaaaaatttctcgaaatttgataaaccaggagaaacaaaaatcacaagttacggatctctatctatctcgttggtgatgcttgctacggcggtgacgcggcggctagtgtattctcgccggagaaaccgagaagttcggttatagccacgatctcgaatttacaggaagctttcgtgatcgtgtttttactgtgttcgaatttttccgaaagagatggaaggacaggcgaagctgacgaggacacagtcgtcgctgctccggtcaccgtcgacgacggtaagatcgtcttttcagagcttaagtgtaatcgctagcgaagtctctcaccagagacaagatctagaagccggagagaaagaagagaagcagagaagaaaaccgcctaaaccgttcggttccagtcctcgaaccggtttaacccgaatcaacccgggtctagccttcacgatggtttctctctccttcctcagcctctcgtctttcatcttcttcgtcgtcttctcccaaaccgatgagcttctcacctccgagaacctcctcctagctctgatcttcgtcgccgtcgctctcttcttcgcctccaagaacatcgctctcctcaaccaaaccatactcgcactcaaagaaaccaccaaactctttggcttccacagcaagaaccggtcagaaccggttcagtggtacatcggcgataccgaaaccaaaccggagaagaagatcaaaccgttcgtcaaagaaggngttcatttctacagcaacggagatttctacgaaggngagtttcacaaagggnantgcaacgggagnggtgtgtantactacttcgtgagnggacgttacgaaggtgattgggtcgatgggagntacgatggtcatgggatcgagagctgggctagagggagtagatacaaaggccagtataggcaagggcttagacacggttacggagtntacagattctacactggtgattgctacgctggtgagtggcttaatggtcaaagccatgggtntggtgttcagtcttgtgctgatggtagctcttatgttggtgaatcaagatttggtgttaaacatgggcttggatcttaccatttcagaaatggagataagtatgcgggagagtattttggagacaagatccatgggtttggtgtgtatcgttttgctaatggtcattgttatgaaggagcgtggcacgaaggtcgtaagcaagggtatggtgcttactcgtttagaaccggtgatgctaaatccggtgaatgggattcagggaatcttataacgtttcttcatcctacgagcgagccggttcggagagcggttcaggcagctagagaaacggctaagaaggctgtgactcggagacgagtagatgagcaagttagccgagccgtggcagctgctaataaggctgcaacggcggcaagagtggctgcagtaaaagcag

SEQ ID NO: 1373 - DNA, 1410 bp, Arachis hypogaea
tcattgtgggtttcttcccaagcttatccctgagttaattaaattgtcgagatgggaacacaacccgaacaaccatgtcctgaggaagatgacgaggagatgctgggtcatgagcaacaatttcgagtcagtcaatgtcaacaagcaggagtgtggggtcaccgtccagccggagtgagcagacaatggcaacgcctgctagtgatagcacttttctcagattaaaccatcttgacattcatggtgatgatgctggatcgcagggagcagttgctagcaagaagaaaaagagaggtcaacgggctgtaggaggagataagagtggaagagggctccgccaatttagcatgaaagtttgtgagaaggtggagagcaagggacgcacaacatacaacgaggtagcagatgagcttgttgctgaatttgctgacccaagcaacagtgttttagcccctgatcagcaacaatatgatgagaaaaatattcgtcgaagggtctatgatgctttgaatgttctcatggcaatggatatcatttctaaggataaaaaggaaatacaatggaagggtcttcctcgtactagccagagtgatattgaagaactaaagacagaacgtcttgggattaggaatagaatcgaaaagaaagcagcttacttgcaagagctggaagagcaatatgtaggtcttcagaacctcataaaacggaatgagcaagtatgtagctcaggaaatgctcccagtggaggtgtatctttgccctttattctagtgcagacacgtccgcatgcaactgttgaagtggaaatatcagaagatatgcagcttgttcattttgatttcaatagtactccttttgagctgcatgatgacaactatgttctcaaggcaatgaaattttctgaaaggcctcagaacgataataatgtaacgccaaatgttacagatggcggtgaaggttctagcatgtcagggttgtttcatgtgcaggctcctaccacagtttcaaacccacccgtgaggcctccatcatcaccaccacttcctggaatattgaaggccagggtcaagcctgagcactaatatgaacttctgccatattctcttgcctgagcatgtctgtatatttttgtaaagtaagaattaattgatagatcttcataaaaatcatccaactggtatagccaattcaccctctaggtaagcagcagattagtggttggtctgcttttctgtatttttggcaaattctttgcctactatatttcctattttactaacataactaattattttttcttcctttagacattttttttctttaactttgtcattttctggttataatagagaaattggttaatactatttcactgattgtaagccattcagtcttatgccaatcctagta

SEQ ID NO: 1374 - DNA, 1198 bp, Arabidopsis lyrata
aaactccagatttcttccttgttcatcttgtttcaaccctcgcttacgtttccgacttctccacatctctcgattcagcttcgattagatttgaattgggaagttgacaagtttgaagatttttcatttgatggattgatctgatttcgaaattttcatttcccgtttcgggttcaattgatttcgatcagattgaacccagttgttctcaatccaaacaggttcattccaaattcatctgtttcctcaaaaaaaaggattcgactttctctgagatggtatatttccagaactcaatctccgtcgtagaccaatctccagtcatggctcaatcagcagattttcatcatcattcaaagcaatcaagaagcagcagcaacagaaagtcatcatcatcgtcgtcaagctgttcttcacatttccaagtctgctgcgacggatctagatcagctgcaatagatgttttgatcttaatcgctgtgatcacatcttccgggttcttgatcttcccttacatcaaattcatcactgtcaaatctgttgaaatcttctcagagctctcttgtttagtcaaagaagagattttgcgtaaccctgatccaattgtgtacggtttgatagctttgagtatctcgtgtactgcgttatcggcttggatgattgttatactcttgtgtagtcgtcatcgatgtgggaaaccgaattgcaaagggcttaggaaagctaatgctgagtttgatattcagttagagactgaggattgtgttaagagctctaatagtggcaagagtgttagcaagaagggtttgtttgagttgcctcgtgaccatcaccgtgagttagaggcggagttgaagaagatggctccaccgaatgggagagccgtgctggtgtttcgggcgaaatgtgggtgttctgttgggagattagaggttcctggacctaagaagcagcaactgcaacaaaggaaggtcaagaagtgatgagaaaaggtttaatctttttgaggtaaagatggaatcattacaggttatgatgatgatgatgattactttgattagcttataaacaacctttttttctttttggtttagttattttcacaagaacttcttacagaaactaatactatgttaaatctccatgtgtttaaataaaagctttacaaggatattacaagagaaaatggttaacagtg

SEQ ID NO: 1375 - DNA, 564 bp, Arabidopsis lyrata
ccaagtctttctcaaaaaacacatctttacacttgaaaaaagttgtttcctttcttagtaataaaaatatcgttttcgtttcttcttctccacacttctagatttttctcagctaacataccagaaagaagaaagacaagcctagaaacattataaagatagacacaaagaaggtccgagaattgtgagtaaaaatgtgtttggaagttgtgtatcatgaagagaagacggagcttggtcgacaacaagcaccgggtatgtgtccatactgtggcggaaaagtatcggcggtggacatagagacgaagtggttgttctgtttcttaccactttgtttcaaggtcaaacgcaaatactcttgttcttcctgcgaccgtcgtctcgtcttgtattattgaagtaacgcaaatagagtgatgcgaaaatgaatgaaaagaagaaaaaaaaacctacaaaaaagaaacagaggagaaattgaaaattgttatctatttcatttatttgtttgctcctcgatcggtgttgagggttttgcagatttcctcctgtgacttgtgattttgc

SEQ ID NO: 1376 - DNA, 473 bp, Brassica napus
ctttcttgttcttcacacttctagagttttcctagcaaacgtaccagaaagaaaaagagacaagcccggaagcagtatataaacacaaaaggtgtctctgagaattggagtaagaaagaagcaaaaatgtgtttggagtttgtctatcacgaggagaagacagagcttggtcggcaacaagcaccgggtgtgtgtccgtattgcggcggaaaagtgtcggcggtagatattgagacgaagtggttgttctgtttcttgccactctgtttcaaggtcaaacgcaagtactcttgttcatcctgtgatcgtcgtctcgttttgtattattgaaagaaacagagtaaatgaagaaagaatatatattttatttatttgttggttttgttactctcagtgttgaggtttttgcagattgtaccctgtaatttctgatttgctataaacacccatcttggtggtgacattggttaagt

SEQ ID NO: 1377 - DNA, 626 bp, Brassica napus
gacagcaaagtccttgtgaacaaaaggaaacatcttcacactttataatattttcccctttgtggtaataatttttcatttcttgttcttcacactttccagaagcagggacaagtccagaagcaatatataggcacaaaaagggatcaccgagttaaaaaagaagaagcaaaaatgtgtttggagcttgtgtatcacgaggagaagactgagcttggtcgacaacaagcaccgggcgtgtgtccatactgcggcggaaaagtgtcggcggtagatattgaaacgaagtggttgttctgtttcttaccactatgtttcaaggtcaaacgcaagtactcttgttcctcatgtgatcgccgtctcgtcttgtattattgaaagaaacagagcagcagatgaagaaagaagcagagaagagtggaactgttgtctaattcactcctctcaatgttgatgtttttgcatattttcccctgtactttctgagttgctattaacagccctcatggtggtgacattggttgaattcattgagtttttgttcaatgtaaataatctcgttggtcctatttcttttgttaagccagtggaattcagttttgtttaaataaatttctgtcattctt

SEQ ID NO: 1378 - DNA, 655 bp, Brassica napus
gacagcaaagtccttgtgaacaaaaggaaacatcttcacactttataatattttcccctttgtggtaataatttttcatttcttgttcttcacactttccagaagcagggacaagtccagaagcaatatataggcacaaaaagggatcaccgagttaaaaaagaagaagcaaaaatgtgtttggagcttgtgtatcacgaggagaagactgagcttggtcgacaacaagcaccgggcgtgtgtccatactgcggcggaaaagtgtcggcggtagatattgaaacgaagtggttgttctgtttcttaccactatgtttcaaggtcaaacgcaagtactcttgttcctcatgtgatcgccgtctcgtcttgtattattgaaagaaacagagcagcagatgaagaaagaagcagagaagagtggaactgttgtctaattcactcctctcaatgttgatgtttttgcatattttcccctgtactttctgagttgctattaacagccctcatggtggtgacattggttgaattcattgagtttttgttcaatgtaaataatctcgttggtcctatttcttttgttaagccagtggaattcagttttgtttaaataaatttctgtcattcttgaatgatattactattctttttgttcatt

SEQ ID NO: 1379 - DNA, 605 bp, Brassica oleracea
tgacagcaaagtccttgtgaacaaaagaaaacatcttcacattttataatattttcccctttgtggtaataatttttcatttcttgttcttcacactttccagaagcagggacaagtccagaagcaatatataggcacaaaaagggatctccgagttaaaaaagaagaagcaaaaatgtgtttggagcttgtgtatcacgaggagaagactgagcttggtcgacaacaagtaccgggcgtgtgtccatactgcggcggaaaagtttcggcggtagatattgaaacgaagtggttgttctgtttcttaccactatgtttcaaggtcaaacgcaagtactcttgttcctcctgtgatcgtcgtctcgtcttgtattattgaaagaaacagagcagcagatgaagaaagaagcagagaagaattgaactgttgtctaattcactcctctcaatgttgatgtttttgcatattttctttgtactttctgagttgctattaacacccctcatggtggtgacattggttgaattcattgagtttttgttcattgtaaataatctcgttggtcctatttcttttgttacgcgaggggaattccgtcttgttt

SEQ ID NO: 1380 - DNA, 643 bp, Brassica napus
ggacagcaaagtccttgtgaacaaaagaaaacatcttcacactttataatattctcccctttgtggtaataatttttcatttcgtgttcttcacacttccagaagcagggaccaagtccagaagcaatatatagacacaaaaagggatctccgagttaaaaagaaaagaagcaaaaatgtgtttggagcttgtgtatcacgaggagaagacagagcttggtcggcaacaagcaccgggtgtgtgtccatactgcggcggaaaagtgtcggcggtagatgtcgagaccaagtggttgttctgtttcttaccactatgtttcaaggtcaaacgcaagtactcttgttcctcctgtgatcgtcgtctcgtcttgtattattgaaagaaacagagcagcagatgaagaaagaagcagagaagaattgaactgttatctaatttactcctcccaatgtggatgtttttgcatattttcccctgtactttctgagttgctattaacacccctcatggtggtgacgttggttgaattcattgagtttttgttcaatgtaaataatttcgttggtcctatttgttttgttatgcgagtggaattcagttttgtttaaataaagttctgtcattcttgaatgatattactat

SEQ ID NO: 1381 - DNA, 689 bp, Brassica napus
gacagcaaagtccttgtgaacaaaagaaaacatcttcacactttataatattctcccctttgtggtaataatttttcatttcgtgttcttcacacttccagaagcagggaccaagtccagaagcaatatatagacacaaaaagggatctccgagttaaaaagaaaagaagcaaaaatgtgtttggagcttgtgtatcacgaggagaagacagagcttggtcggcaacaagcaccgggtgtgtgtccatactgcggcggaaaagtgtcggcggtagatgtcgagaccaagtggttgttctgtttcttaccactatgtttcaaggtcaaacgcaagtactcttgttcctcctgtgatcgtcgtctcgtcttgtattattgaaagaaacagagcagcagatgaagaaagaagcagagaagaattgaactgttatctaatttactcctcccaatgtggatgtttttgcatattttcccctgtactttctgagttgctattaacacccctcatggtggtgacgttggttgaattcattgagtttttgttcaatgtaaataatttcgttggtcctatttgttttgttatgcgagtggaattcagttttgtttaaataaagttctgtcattcttgaatgatattactattctttttgttcattttgaatgataaaataactcctagccatttctag

SEQ ID NO: 1382 - DNA, 715 bp, Brassica napus
aagcaggtatcaacgcagtagttacgcggggacagcaacaaaaaaaaaacaatcttcacgcaaatattttcctcttttggtataaaaggaatttatttttcctttcttgttcttcacacttctagagttttcctagcaaacttaccagaaagaaacagagacaagctcagaagcagtatataaacacaaaaggtgcctctgagaattggagtaagaaagaagcaaaaatgtgtttggagtttgtctatcacgaggagaagacggagcttggtcggcaacaagcaccgggtgtatgtccgtattgcggtggaaaagtggctgcagtagatattgagaccaagtggttgttctgtttcttgccactctgtttcaaggtcaaacgcaagtactcgtgttcttcctgtgatcgtcgtctcgtcttgtattattgaaagaagcagagcaaaagaagaaagaatatttatattatttatttatcggttttgctactcttaatgtgaggtttttgcagattttcccctgtaatttctgatttgctataaacacccatcttggtgatgacattagttaagttcattaagttttgtgggtttcatgtaaataatttactggtcgtgtttcgtcgattacatgagtgaaattcatttttttttaagtaagttcattactgaacttgtttactattatacttgttcattgcaatgattggtaactt

SEQ ID NO: 1383 - DNA, 641 bp, Brassica napus
gacagcaacaaaaaaaaacatcttcacgcaaatattttccctctttttggtaataaaaaggaaattttatttttcctttcttgttcttcacacttctagagttttcctagcaaacttaccagaaagaaacagagacaagctcagaagcagtatataaacacaaaaggtgcctctgagaattggagtaagaaagaagcaaaaatgtgtttggagtttgtctatcacgaggagaagacggagcttggtcggcaacaagcaccgggtgtatgtccgtattgcggtggaaaagtggctgcagtagatattgagaccaagtggttgttctgtttcttgccactctgtttcaaggtcaaacgcaagtactcgtgttcttcctgtgatcgtcgtctcgtcttgtattattgaaagaagcagagcaaaagaagaaagaatatttatattatttatttatcggttttgctactcttaatgtgaggtttttgcagattttcccctgtaatttctgatttgctataaacacccatcttggtgatgacattagttaagttcattaagttttgtgggtttcatgtaaataatttactggtcgtgtttcgtcgattacatgagtgaaattcatttttttttaagttaagttcatt

SEQ ID NO: 1384 - DNA, 652 bp, Raphanus sativus
  misc_feature (500)..(500): n is a, c, g, or t
  misc_feature (512)..(512): n is a, c, g, or t
  misc_feature (577)..(577): n is a, c, g, or t
ggacagcagagtccttgtgagcaaaagaaaacatcttcacactttataatatttttcccttttctggtaatattttctcatttcttgttcttcacacttccagaagcagagacaagtccagaagatatatatcgacacaaaaagggatctctgagtaaaaaaaacaaagaagcaaaaatgtgtttggagtttgtgtatcacgaggagaagacagagcttggtcgccaacaagcaccgggtgtgtgtccatactgcggcggaaaagtggcggcggtagatactgagacgaagtggttgttctgtttcttaccactctgtttcaaggtcaaacgcaagtactcttgttcctcctgtaatcgtcgtctcgtcttgtattattgaaagatacatacagagcagcagatgaaggaaagaaacggaggagaggagtgctgagagtctgttatctaatttatttgtttgtttgttttgctcctctagatgatgagattttttgcagntttctccctgtnatttctgaattgctaaaaacacccctcatggtggtgacattggttaagttcattgagtttttttnttcaatgtaaataatttcgtttgttgcgtgagtggattcagtattgtttaaataaatattgtcattcatgtctga

SEQ ID NO: 1385 - DNA, 595 bp, Brassica rapa
  misc_feature (28)..(28): n is a, c, g, or t
  misc_feature (31)..(31): n is a, c, g, or t
tactttcccatttttggtaatcaaaaantcntttctctttcttttttcttgttcttcgcacttctagagttttcctagcaaacgtaccagaaagaaacagagacaagctcagaagcagtatataaacacaaaaggtgtctcagagaattggagtaagaaagaagcaaaaatgtgtttggagtttgtgtatcacgaggagaagacagagcttggtcggcaacaagcaccgggtgtgtgtccatattgcggcggaaaagtggcggcagtagatattgagaccaagtggttgttctgtttcttgccactctgtttcaaggtcaaacgcaagtacacttgttcctcttgtgatcgtcgtctcgtcttgtattattgaaagacacagaacaaatgaagaaagaatatatatttttatttatttgttggtttcctactctcaatcaatgttgaggttttcgcagattttcccctgtaatttctgatttgctataaacacccatcttggtggtgacactggttagaggttttgtgggtttaatgtaaataatttcgttgtttcgttgattacgtgagttgaatcaagttttgtttaaataaa

SEQ ID NO: 1386 - DNA, 644 bp, Raphanus sativus
ggacagctacaacaaaagaaaacatcttcacgcaaatatttccccatttttggtaattaaaaaaggaaattttctttcttttttctcttcttcgcacttctagagttttccaggcaaacgtaccagaaaagaaacagagacaagccagaagcagtatataaacacaaaaggtgtctctgagagttggagtgagaaagaagcaataatgtgtttggagtttgtgtatcacgaggagaaaacagagcttggtcggcaacaagcaccgggtgtgtgtccgtattgcggcggaaaagtggcggcggtagatattgagaccaagtggctgttctgtttcttgccactctgtttcaaggtcaaacgcaagtacacttgttcttcctgtgatcgtcgtctcgtcttgtattattgaaagaaacagagcaaatgaagaaagaatatatattttatttatttgttggttttactctcagtgttgaggttttcgcagattttcccctgtaatttcttatttgctaccaacacccctcttggtggtgacattggttaagttcattgaggttttgtgggtttaatgtaaataatttcgttgattacatgagttgaatttcagctttgttaattaaataaagattttgtcattctta

SEQ ID NO: 1387 - DNA, 650 bp, Cleome gynandra
aataaagaacagaaaagccttcttctcttattctctcttcctcatcataccagaaaaacccagacaaagaggaaacagaggattcagataatcacacttttccacattttttttttaaagaactctttttaagaaagaaaaaagggacccttcttctcttcttcctttatcctcaccattttccttttgaaaaaccccagaaaaggggatactgaaaattggagtattaccgagaatctgagaaaacggagaaggcggcgaagaaagagaaaaaaatgtgtctggtgtttgtgttcaatgaggagacgacggagcttggccggcaacaagcgccgggaatgtgtccgtactgtgacggaaaggtgtcagcgatcgacgttgagacaaagtggatgttctgttttttgcctctctgttttaagatcaaacggaagtacttctgttcttcttgcgaccgtcgtctcgtcttgtattactaacaacccactcagagcgagagagagcgatatttgtttttgccctcatacttcgaagtttctcagagtgacccctgtaattatgatttgtgcggaaatacccctattctcggtgtgtgtgaaattggttgattgaatttcgtacaatgtaaaataacaatgccctcgtctcgt

SEQ ID NO: 1388 - DNA, 463 bp, Thellungiella halophila
tcggccatcacgcctcgtcatttcgacggtattcccttgaaatcatcctaatcctgctgcagaaaccctaaggaatagattcaattcgagaatcatggatccacttcccgaacccgttacctacgtctgcggagattgtggacaagagaacacattgaagtctggagatgtgatccaatgcagagagtgtgggtatcgtattctgtacaagaagcgtacccgtagagttgttcaatacgaagctcgctgagaacaccactagtcagtcctgaggaagatggtttcaagactttttgccattgtatgtaatatatattgacatgttttgtttggtttgatttgaacacaagtgtgactctgtaatttccttgcctcttatgaattccttagaataagtgagtttacattggtgaatccttttgattggctttaattactcatcttcattcgccatttcaacaag

SEQ ID NO: 1389 - DNA, 386 bp, Thellungiella halophila
cccacgcgtccggtttgaatcaccgcataaaccctagctttttggattcgattcgaagtcatggatccacagcccgaaccagttacttacgtctgcggagattgtggacaagagaacactttgaagtctggggatgtgatccaatgccgagaatgtgggtaccgtattctatacaagaagcgcacccgtagagttgttcaatacgaagctcgctgagaaccacaaacccctgaagatgtttggaactctggtttcctgctgttgcttgtaacatataatgactagaaaatctgtctctggctttgcttagtggcttgttttggttacaatgattgtgacactgaaatttctttgcctttttggtaaatgaagaaagcctttatgct

SEQ ID NO: 1390 - DNA, 460 bp, Brassica juncea
tcaacgcagagtagcgggggttcgagatcatcgcataaaccctaattcttcagaaacctaagctgtgtctgatcagattcgagtggatataaatggatcaacagccagaaccagttacttacgtctgcggagattgtggacaagagaacactttgaagtcaggggatgtgatccaatgcagagagtgtggctaccgtattctttacaagaagcgtactcgtagagttgttcagtacgaagctcgctgagaaccacaactcaccctgaaagatgattctaagtctgttaagatgtcataaagacttctcctgcctctgtttgtaatataattcagttcgacttgaaattatgtttctgtttttggacaagtggcttgtttttgtttgatttggttaaacaatgagtgtgacttcgtaacccattatgggatctctcttgatctaaaatcacccctttcagt

SEQ ID NO: 1391 - DNA, 572 bp, Brassica juncea
tggctatcgtattctctacaagaagcgggggtcgtctcttcgctcgtgtttgaagtcaccgcataaaccctagctttgttgattcgattcgttatcatggatcaacagcctgaaccggttacttacgtctgcggagattgtggacaagagaacactttgaagtcaggggatgtgattcagtgcagagagtgtggctatcgtattctctacaagaagcgtactcgtagagttgttcaatatgaagctcgctgagaaccacaccacaacccctaaagatgattccaagtctcctaataagatggcattaagactctttctgcttgtgtttgtaatatatttgactaaaaaaatctgtgtctgaatttggctaagtggtttgatttgattacaagaatgtgttatatctctttacctttttggtaatgaagatatactatactaacggattcacattggtagaatccattatttgggctatatctcctgatctatagtttcagatccatatctgactgttcagtgtatcaaacagagtgacatgaaaagataccacccaaggaaacttgatgctc

SEQ ID NO: 1392 - DNA, 494 bp, Brassica juncea
tagggtaaatgttaaaaccagacacgtctcttctctcgtgttcgagaccagcgcataaaccctaattcttcagaaacctaagctttgtctggtaagattcgagtggatagaatggatcaacagccagaaccagttacatacgtctgcggagattgtggacaagagaacactttgaagtcaggggatgtgatccagtgcagagagtgtggctaccgtatcctatacaagaagcgtacccgtagagttgttcagtacgaagctcgctgagaaccacagccttgaatgatgatttgaagtctgctaagatgtcatagagacttctcctgcctttgtttgtaatataatccagttcgacttgaaattatgtttatgttttttttttgctgagtgacttgtttttgtttgatttggttaacaatatgactttgtaacccattatggaatgtctctcttgatctaaaatcacccatcatcagttacgcatatacagaata

SEQ ID NO: 1393 - DNA, 479 bp, Brassica juncea
ggtttatgcaaacacgagctttgtggattcaattcgttaccatggatcaacagcctgaaccagttacatacgtctgcggagattgtggacaagagaacactttgaagtctggggatgtgatccagtgcagagagtgtggttaccgtattctctacaagaagcgtacccgtagagttgttcaatacgaagctcgctgagaaccgcaacccctaaagatgatttgaagtctgctaagatggcattaagacgtttcctgcatctgtttgtaatatatctggactagacaatctgtttctgtttttggctacgtggctttgatttgattgccaatgactgtgtaatctcttttaactatttggtaaatgaagaaatcctataataacggattcacattggtagaatccactattgggctatatgcctatatctcatctaaagtagtttcagagccatatattttgtgtcaatgtatcaaaaag

SEQ ID NO: 1394 - DNA, 504 bp, Brassica napus
gctcgtgttcgagatcatcgcataaaccctaattcttcagaaacctaagctttgtctggtcagattcgagtggatataatggatcaacagcccgaaccagttacttacgtctgcggagattgtggacaagagaatactttgaagtctggggatgtgatccagtgcagagagtgtggataccgtatcctatacaagaagcgcacccgtagagttgttcagtacgaagctcgctgagaaccacaactccgcctgaaagatgatttgaagtctgttaagatgtcataaagacttctcctgcctttgtttgtaatataatccagttcgacttgaaattatgtttatgttttttgctaagtgacttgtttttgtttgatttcgttaacaatatgactttgtaacccattatggaatgtctctcttgaagcagaaagggccgtttcagtgttatatatcactcttgtcagtgctcgacattaagagaaaccgatgcaaagttatctcctg

SEQ ID NO: 1395 - DNA, 475 bp, Brassica napus
ctctctctctctctctcgtctcttcgctcgtgttcgagaccatcgcacgcataaaccctaattccgcagaaaccttagctttgtctggtaagattcgagtggatagaatggatcaacagccagaaccagttacttacgtctgcggagattgtggacaagagaacactttgaagtcaggggatgtgatccagtgcagagagtgtggataccgtatcctatacaagaagcgtacccgtagagttgttcagtacgaagctcgctgagaaccacaactccgcctgaaaaatgatttgaagtctgctaagatgtcataataaagacttctcctgcctctgtttgtaatataatcccagttcgacttgaaattatgtttctgttcttttgctaagtggcttgtttttgtttgatttggttaacaatatgactttgtaacccattatggaatgtctctcttgatctaaaatcacccatcatc

SEQ ID NO: 1396 - DNA, 446 bp, Brassica juncea
  misc_feature (86)..(86): n is a, c, g, or t
  misc_feature (92)..(92): n is a, c, g, or t
  misc_feature (182)..(182): n is a, c, g, or t
gctcgtcgtctcttcgctcgtgtttgaagtcaccgcataaaccctagctttgttgattcgattcggttatcatggatcaacagccngaaccngttacttacgtctgcggagattgtggacaagagaacactttgaagtcaggggatgtgatccagtgcagagagtgtggctaccgtattctntacaagaagcgtactcgtagagttgttcaatacgaagctcgctgagaaccacaactcaccctgaaagatgattccaagtctgttaagatgtcataaagacttctcctgcctctgtttgtaatataattcagttcgacttgaaattatgtttctgtttttggacaagtggcttgtttttgtttgatttggttaaacaatgagtgtgacttcgtaacccattatgggatctctcttgatctaaaatcacccctttcagttacacat

SEQ ID NO: 1397 - DNA, 429 bp, Brassica oleracea
  misc_feature (302)..(302): n is a, c, g, or t
ggtcgtctcttcgctcgtgtttgaagtcaccgcataaaccctagctttttggattcgattcgttatcatggatcaacagccagaaccagttacttacgtctgcggagattgtggacaagagaacactttgaagtctggggatgtgatccagtgcagagagtgtggctaccgtattctctacaagaagcgtacgcgtagagttgttcaatacgaagctcgctgagaaccacaacccctaaagatgattccaagcctgctaagatggcattaagacgtttcctgcatctgattgtaatatatcnggactagacaatctgtttctgtttttggctacgtggctttgatttgattgccaatgacttgtgtaatctcttttaactatttggtaaatgaagaaatcctataataacggattcacgttggtagaat

SEQ ID NO: 1398 - DNA, 475 bp, Brassica rapa
ggtctctctctctctcttgtctcttcgctcgtgttcgagatcatcgcataaaccctaattcctcagaaacctaagctttgtctggtaagattcgagtggatagaatggatcaacagccagaaccagttacttacgtctgcggagattgtggacaagagaacactttgaagtcaggggatgtgatccaatgcagagagtgtggataccgtatcctatacaagaagcgtacccgtagagttgttcagtacgaagctcgctgagaaccacagccttgaatgatgatttgaagtctgctaagatgtcatagagacttatcctgcctctgtttgtaatataatcccagttcgacttgaaattatgtttctgttcttttgctaagtggcttgtttttgtttgatttggttaacaatatgactttgtaacccattatggaatgtctctcttgatctaaaatcacccatcatcagttacgcat

SEQ ID NO: 1399 - DNA, 555 bp, Brassica napus
gggtcctattttctcgtcgtctcttcgctcgtgtttgaagtcaccgcataaaccctagctttgtggattcaattcgttaccatggatcaacagcctgaaccagttacatacgtctgcggagattgtggacaagagaacactttgaagtctggggatgtgatccagtgcagagagtgtggttaccgtattctctacaagaagcgtacccgtagagttgttcaatacgaagctcgctgagaaccgcaacccctaaagatgatttgaagtctgctaagatggcattaagacgtttcctgcatctgtttgtaatatatctggactagacaatctgtttctgtttttggctacgtggctttgatttgattgccaatgactgtgtaatctcttttaactatttggtaaatgaagaaatcctataataacggattcacattggtagaatccactattgggctatatgcctatattttgtgtcaatgtatcaaaaagaaatcttcacaaggaaacttgtaaaatgctccatattatgtcaaagttaagcaagttatatcaaat

SEQ ID NO: 1400 - DNA, 452 bp, Brassica napus
  misc_feature (71)..(71): n is a, c, g, or t
  misc_feature (96)..(96): n is a, c, g, or t
  misc_feature (108)..(108): n is a, c, g, or t
gggtcctattttctcgtcgtctcttcgctcgtgtttgaagtcaccgcataaaccctagctttgtggattcnattcgttaccatggatcaacagccngaaccagttacntacgtctgcggagattgtggacaagagaacactttgaagtctggggatgtgatccagtgcagagagtgtggttaccgtattctctacaagaagcgtacccgtagagttgttcaatacgaagctcgctgagaaccgcaacccctaaagatgatttgaagtctgctaagatggcattaagacgtttcctgcatctgtttgtaatatatctggactagacaatctgtttctgtttttggctacgtggctttgatttgattgccaatgactgtgtaatctcttttaactatttggtaaatgaagaaatcctataataacggattcacattggtagaatccactattgg

SEQ ID NO: 1401 - DNA, 563 bp, Brassica napus
  misc_feature (32)..(33): n is a, c, g, or t
  misc_feature (35)..(36): n is a, c, g, or t
atcaacgcagagtacgcgggagggtaaatgtnnannccagacacgtctctcgtctcttcgctcgtgttcgagatcatcgcataaaccctaattcttcagaaacctaagctttgtctggtcagattcgagtggatataatggatcaacagcccgaaccagttacttacgtctgcggagattgtggacaagagaatactttgaagtctggggatgtgatccagtgcagagagtgtggataccgtatcctatacaagaagcgcacccgtagagttgttcagtacgaagctcgctgagaaccacaactccgcctgaaagatgatttgaagtctgttaagatgtcataaagacttctcctgcctttgtttgtaatataatccagttcgacttgaaattatgtttatgttttttgctaagtgacttgtttttgtttgatttcgttaacaatatgactttgtaacccattatggaatgtctctcttgaagcagaaagggccgtttcagtgttatatatcactcttgtcagtgctcgacattaagagaaaccgatgcaaagttatctcctg

SEQ ID NO: 1402 - DNA, 520 bp, Brassica napus
ggtcgtctcttcgctcgtgtttgaagtcaccgcataaaccctagctttgtggattcgattcgttatcatggatcaacagccagaaccagttacttacgtctgcggagattgtggacaagagaacactttgaagtctggggatgtgatccagtgcagagagtgtggctaccgtattctctacaagaagcgtacccgtagagttgttcaatacgaagctcgctgagaaccacaacccctaaagatgattccaagtctgctaagatggcattaagacgtttcctgcatctgattgtaatatatctggactagactgtttctgtttctgtttttggctacgtggctttgatttgattgccaatgacttgtgtaatctcttttaaccatttggtaaatggagaaatcctataataacggattcactttggtagaatccaatattggctatatatgcctatatctcatctaaagtagtttcagagccatatattttgtgtcaatgtatcaaaaagaaatctttcac

SEQ ID NO: 1403 - DNA, 446 bp, Brassica napus
ctcgtcgtctcttcgctcgtgtttgaagtcaccgcataaaccctagctttgtggattcgattcgttatcatggatcaacagccagaaccagttacttacgtctgcggagattgtggacaagagaacactttgaagtctggggatgtgatccagtgcagagagtgtggctaccgtattctctacaagaagcgtacccgtagagttgttcaatacgaagctcgctgagaaccacaacccctaaagatgattccaagtctgctaagatggcattaagacgtttcctgcatctgattgtaatatatctggactagactgtttctgtttctgtttttggctacgtggctttgatttgattgccaatgacttgtgtaatctcttttaaccatttggtaaatggagaaatcctataataacggattcactttggtagaatccaatattggcta

SEQ ID NO: 1404 - DNA, 531 bp, Raphanus sativus
agctcgtgtgggtagttcagcctaaaccctagctttgttcgactcgagtcgatagcaatggatcaacagcccgaaccagttacttacgtctgcggcgactgtggacaggagaacactttgaagtctggggatgtgatccaatgcagagagtgtggctaccgtattctctacaagaagcgtacccgtagagttgttcaatacgaagctcgctgagaaccacaatcccaaaagatgattgcaagtctgttaagatgactctttcctgcctatgtttctaatataaccttgactagaaagtctgtcgttatttttgctaagtggcttgttttggtgtggtttgattacaactgagcgtgcctttgtaataatggtgctgttcgtttgctcatctgggtgatccatctgggtgaagatgcaagttgatgtttgttttgtaccttaaaatgctacatccaaatggatcacccaactgcatttatgaaaactcatctcaaattctcacccaaatgagggtgagtcttcacggagcaa

SEQ ID NO: 1405 - DNA, 403 bp, Raphanus sativus
ggctcgccccttccactcgtgtttgaaatcaccgcataaaccctagctttgtggtgattcgtttcgttaatcatggatcaacagcccgaaccagtcacttacgtctgcggagattgtggacaagagaacactttgaagtcaggggatgtgattcagtgcagagagtgtggctatcgtattctctacaagaagcgtacccgtagagttgttcagtatgaagctcgctgagaacccctaaagattgattccaagtatgctaagatggcaataagtttcctgcatctgtttgtaatatatctggactagaaaatctgtttctgaatttggctaagtggtttgatttgattataaaaaaatgtgttatattatctctttacctttttggtaatgagtatatgtatac

SEQ ID NO: 1406 - DNA, 526 bp, Brassica oleracea
  misc_feature (491)..(491): n is a, c, g, or t
gacgctcgtgttcgagatcatcgcatacaaccctaattcctgagaaacctaagctttgtctgattcgagtggatataatggatcaacagccagaaccagttacttacgtctgcggagattgtggacaagagaatactttgaagtctggggatgtgatccagtgcagagagtgtggataccgtatcctatacaagaagcgtacccgtagagttgttcagtacgaagctcgctgagaaccacaactccgcctgaaagatgatttgaagtctgttaacatgtcataaagacttcaactgcctttgtttgtaatataatccagttcgacttgaaattatgtttatgtaacccattatggaatgtctctcttgaagcagaaagggccgtttcagtgttatatatcactcttgtcagtgctcgagattgctaaattgtcaataggacatgatcaaagagagcgcagacattaagagtaaccgatgcaaagttatctnttaaagtaattaattagcgcgctagtaaatcaata

SEQ ID NO: 1407 - DNA, 561 bp, Brassica napus
  misc_feature (10)..(10): n is a, c, g, or t
  misc_feature (12)..(13): n is a, c, g, or t
  misc_feature (15)..(15): n is a, c, g, or t
  misc_feature (17)..(17): n is a, c, g, or t
  misc_feature (19)..(19): n is a, c, g, or t
  misc_feature (21)..(24): n is a, c, g, or t
  misc_feature (26)..(26): n is a, c, g, or t
  misc_feature (28)..(29): n is a, c, g, or t
  misc_feature (551)..(551): n is a, c, g, or t
ggacgtaggntnnangnanannnngngnngtctctctctctctctctctctctctctctctctcgtctcttcgctcgtgttcgagaccatcgcacgcataaaccctaattccgcagaaaccttagctttgtctggtaagattcgagtggatagaatggatcaacagccagaaccagttacttacgtctgcggagattgtggacaagagaacactttgaagtcaggggatgtgatccagtgcagagagtgtggataccgtatcctatacaagaagcgtacccgtagagttgttcagtacgaagctcgctgagaaccacaactccgcctgaaaaatgatttgaagtctgctaagatgtcataataaagacttctcctgcctctgtttgtaatataatcccagttcgacttgaaattatgtttctgttcttttgctaagtggcttgtttttgtttgatttggttaacaatatgactttgtaacccattatggaatgtctctcttgatctaaaatcacccatcatcagttacgcatatacttactgtacatactnttctttgcta

SEQ ID NO: 1408 - DNA, 465 bp, Arabidopsis lyrata
gcaaattcagtttctgtgaactctttctttgttgaatcatggaaccagcacagcccgaacccgttacttacgtctgcggagattgtggacaagagaacactttgaagcctggggatgtgatccaatgcagagagtgtgggtaccgtattctctacaagaagcgtacccgtagagttgttcaatacgaagctcgctgagaaccgtagtggttgttaatcctgaagatgtttcatagtctgttaagatgggttgagacgttttggcactgttggggatgtatatcgacatgctttttgctaaattgccagttcgatttgatttggggatttgatcccagtgtgactctgtaatcacttggaataactaaattcacattgctagaatccttgattgctataatctcctctaaattactcatcctcattctccatttcgacaggctaaacatctctaagttgtgttgct

SEQ ID NO: 1409 - DNA, 429 bp, Helianthus annuus
accaaaaccctagccagccatcgtcgttttcaactactctactctggtcgcagtaatcaatcaatggatccagcacctgagccagttacttacatttgtggagattgtgggcaggagaatactttgaaggttggtgatgtcattcaatgtcgagagtgtggttaccgcattctctacaagaagcgaactcgtcgaattgtgcaatatgaagcccgttgaagaacacactgcaagtgaagctcacattggcattatcaagtatgattgaagtattgtgtaataagtgggaaatttggatcttatctgtgtcaaatgtttgaatgctatgtgaacttttccatcttagatgtcatgtgaatagtttataacattaagtatcgacaattggtggttcattccatgtttctctgatagcaagtagacaaaaaa

SEQ ID NO: 1410 - DNA, 498 bp, Helianthus annuus
cttccgatctagtacgcggggaactggattccttccctaaaatctttacaaaactgatcagcgaaatcatccacagcggcggcttcgttctccggtggccctgctaccttctccggcggccctgctttcttctccggcggccttcttctccggttcttccatactccaatccaacagtaatcaatcaatggatccagcacctgagccagttacttacatttgtggagattgtgggcaggagaatactttgaaggttggtgatgtgattcaatgccgagagtgtggttaccgcattctctacaagaagcgaactcgtcgaattgtgcagtatgaagcccgttgaagaacaccctgcattggcattatcaagtatgattgaagtatcgggtaataagtgaaatttggatcttatctgtgtcgaatgtttgattgctaatgtgaactttttcatcctagatgtcatgtcaatagttataacattataaatcgacaattggc

SEQ ID NO: 1411 - DNA, 446 bp, Raphanus sativus
gggagacacgtctctctctctctctcgtctcttcgctcgtgttcgagatacattgcataaaccctagttctccagaaacctaagctttgtccgattcgagtggataataatggatcaacaaccagaaccagttacttacgtctgcgaagattgtggacaagaaaacactttgaagtcaggggatgtgatccaatgcagagagtgtggctaccgtattctctacaagaagcgtacccgtagagttgtccagtacgaagctcgctgagaaccacaactcaccccgaaagatgatttgaaagtctgttaagatgtcataaaggcttttcctgcctatgttttgtaatataattcaaactccacttgaaattctttttcttgtttttgtttgatttggttaacaatgagtgtcactttataacccattattggctacatctcttgctcca

SEQ ID NO: 1412 - DNA, 369 bp, Artemisia annua
ctagtgcttgtacactgaccgcagttatcaatcgtatcaatggatccacagccagaaccagttacttacatttgtggagattgtggtcaggagaatacgttgaaagttggtgatgtgattcagtgtagggagtgcggttatcgtatcctctacaagaagcgtactcgccgaattgttcagtatgaggctcgttaaagaagactcgacaagggaagtgtgcaagttattattaagtatgtttaggagaatcaaatgatcttgtaacaatggaatgctaagtgaatactaatgtgtgaaatttggaactgtaatggtatcttatctgtttcaaatgtcttaatgcatttgtgatatcctagttcttttttg

SEQ ID NO: 1413 - DNA, 233 bp, Cleome gynandra
tcggggtatctctagaggtcaccgaaaagccctagctcctgcaaaaccccaaccttagttgattcgaatagtatggatccgcagcccgagcccgttacgtacatctgtggagactgtggacaagagaacacattgaagcctggggatgtgatccaatgccgtgagtgtggctatcgcattctatacaagaagcgtactcgtagaattgtccaatacgaagctcgttgataaca

SEQ ID NO: 1414 - DNA, 214 bp, Cleome spinosa
aattttctcaaaagccctaactcctgcgcaacaccgattttattttatttgggtagcatggatccacagcccgaacccgttacgtacatctgcggagactgtggtcaggaaaacaccttgaagacgggggatgtgatccaatgccgggagtgtgggtatcgcatcctgtacaagaagcgtactcgtagaattgtccaatacgaagctcgctgag

SEQ ID NO: 1415 - DNA, 525 bp, Heritiera littoralis
ttattacataactttccagcagtttccgtgtattctctctttgagttgcttccgctagcatccgttaccttgaggttagtttgaaaaacttgttggagttagcatcaatggatccgcagcctgaacctgtgacctatatctgtggagactgtgggcaagagaatacgttgaagcatggagatgtgatacaatgccgggagtgcggttaccgcattctttacaagaaacgaacccgaagaattgttcagtatgaagctcgttgaaggtggaattcagagaaggggagggcataagcacacatgtcaataagaaacaatctcacaagtggctatgccttgtgcaagattgattgaattgattgcagttcctgaggatttgaacataacttttaatccatggttgcgtatcccgagtgatgtctattgatttagagcatcaatgaagggttcattcttttaaagtctgtctatgttctgttctttagtgtggtttcatacctttgttaatgtattagcttcatgtgtt

SEQ ID NO: 1416 - DNA, 656 bp, Tropaeolum majus
aacataatatctttctcaaaacctaattttttaaatagtagtttctacgcagcagcttaaattctcatctttctgatcttactaatagtataattctacttgtgtttttattttctggattctactttttgcttgatacagcaatcaatcactcactttgttaaataatggatccgcagcctgaacctgtgacgtatatctgtggagactgtggtcaagaaaatacgttgaagtctgctgatgtgatacaatgtagggaatgtggttaccgcattctatataagaagcgaacccgcagaattgttcagtatgaagcacgttgagtacaaaaatgttgatacattcatcatatgtgtgaagaatgtgaagacagtagattgccgttatttgcttatttagtgattttagatgccagggtagaatgtgtacattcaaatgttggattgctaagcattgacatattattaggctttttctatgttgtgttttgaactaaaccaatgctatgattagcaaacaatgtggcttccattgaatgtcaaccaaaggcatgcgttacaatgtcagactgtttattcttcatattgctctagtctctttgatttataagtttgggaagaacccatattctgtggccaaaaaaaaaaaaaaggccg

SEQ ID NO: 1417 - DNA, 413 bp, Artemisia annua
cagtactccgacggggacaaaaccctagtgcttgtacactgaccgcagttatcaatcgtatcaatggatccacagccagaaccagttacttacatttgtggagattgtggacaggagaatacgctgaaagttggtgatgtgattcagtgtagggagtgcggttatcgtatcctctacaagaagcgtactcgccgaattgttcagtatgaagctcgttaaagaagactcggcaagggaagtgtgcaagatattattaagtatgtttaggagaatcaaatgatcttgtaacaatggaatgctaagtgaatactaatgtgtgaaatttggatctgtaacggtatcgtatctgtttcaaatgtctaatgcatttgtgatatctagttcttctttgtcgtctctgaaactcgcgatat

SEQ ID NO: 1418 - DNA, 305 bp, Artemisia annua
cacactgaccgcagttatcaatcgtatcaatggatccacagccagaaccagttacttacatttgtggagattgtggtcaggagaacacgttgaaagttggtgatgtgattcagtgtagggagtgcggttatcgtattctctacaagaagcgtactcgccgaattgttcagtatgaagctcgttaaagaagactcgacaagggaagtgtgcaagatattattaagtatgtttaggagaatcaaatgatcttgtaacaatggaatgctaagtgaatactaatgtgtgaaatttggatctgtaacggc

SEQ ID NO: 1419 - DNA, 634 bp, Theobroma cacao
ggtacgcggggaaaacctaaaacatcagaaactgaaaaagaagacaggggctccttttctcttccaaacctagtgttcgccacgctcgggttggtctgaagaacttgtttgagtgactatcgatggatccgcagccagaacctgttacctatatctgtggagactgtggacaagagaacacattgaagcatggagatgtgatacaatgccgtgagtgtggttaccgcattctttacaagaagcgaacccgaagaattgttcagtatgaagctcgctaaatatgaaattcaaagaagggggagggcataagcacttatgtcaatgagaaacaatatcagaagtgttgatgcattgtatatggttgattgtattatgcggttcaagaagatttgtacattattgtcaatcaatggttgcttgggacctgagtgatggctgttgatttagaacaacaagagttcatacttcttatggtctgcttatgttctgtttttaagtggtttcattttgttataggggacttaatcttttttaatgtgttagcttcatgttatgcaccttgtcttgttgatttgttagctccataattttaaaacaaggattaaacttatgtgaggcaatgctttctttttca

SEQ ID NO: 1420 - DNA, 662 bp, Gossypium hirsutum
gatccacgccgccaaacaaagccttctcctctcctcctcctcctcccctccttcctttgctgttcctaaagtttcgttctctcttagctgcctgaacgtcctattttttccctctctcgtgactcgttcatcaggaaaaacttgttcgagtgagcatcaatggatccacaacctgaacctgttacctatatctgtggagactgtgggcaagagaacacattgaagcatggagatgtgatacaatgccgggaatgtggttatcgcattctttacaagaagcgaacccgaagaattgttcagtatgaagctcgctgaaagtggtgtttggagaaggggagggtatgagcaaacaatctcttagtcagtagttatgtgttttgtatatggttgattatattaagtgtggatagtgaggatttgaacacttaagttctgtccatggatgctttgcctagcaacctaagtgatgtctattgatttagaacatcaaaaacaagttcatacgtttaaagaactgtctatgttatgtttcttattgtgactgcttttaagtgatttctggttcaatggtgaacttttaaatctttaattatatatttttaagttttggatttgatgtttggttgatagaaatatgtgaatgatataaaggttgttaaatc

SEQ ID NO: 1421 - DNA, 599 bp, Gossypium hirsutum
attcccctcagttgaaacacccctcccctctcctctcctccactccaccaacacccaccggccaccaccatcatcgacacacactgccagctctccaaacaggtgacgtttctgcactcaaccttgatgtcgggttcaaaccctagttgggtttaaaattgagcacaacggggctttggacttcaaatcgggttcaaaattgttgggctctggttcgtcaggaaaaacttgtttgagtgagcatcaatggatccacaacctgaacctgttacctatatctgtggagactgtgggcaagagaacacattgaagcatggagatgtgatacaatgccgggagtgtggttatcgcattctttacaagaagcgaacccgaagaattgttcagtacgaagctcgctgaaagtggtgttcggagaaggggagggtatgaacaagcaatctcataatcagtagttatgcgttttgtatatggttgattatattaagtgtggttagtgaggatttgaagtaacactaagttctgtccatggatgctttgcctagtaactaagtgatgtcttgttttagaacatcaaaaacaaattcatacttttaaaa

SEQ ID NO: 1422 - DNA, 382 bp, Gerbera hybrid cultivar
ggttcatcaaaccgccattgtcgttacttactcaaccagagatcgcagtaatcaatggatccacagccagaaccagtaacttacatctgcggagattgtgggcaggagaatacattgaaggttggtgatgtgattcagtgccgagagtgtggttatcgtattctttacaagaagagaacccgtagaattgtccagtatgaagcccgctgaagaagacttgcatggaaactgttaaggtatgtttagcataattgagtgattttgtatcaaggaggtactgattgattaccgatgtgtgaaatttggatctaatggtaccgagttctaatgaaatgtttctggaatacaattgttttatcgtgtcaaaaaaaaaaaaaaaaaa

SEQ ID NO: 1423 - DNA, 372 bp, Gerbera hybrid cultivar
gcttggatttaccgatttgagtttgtaatcaatggatcctcaaccagaaccagttacttacatctgtggagattgtgggcaagaaaacacgttgaaggttggtgatgtgattcagtgtcgtgaatgtggttatcgcatcttgtataagaagcgaacccgtagaatcgttcagtacgaagcacgctgaacaagatcactttatcaagcacatatgcatgtagcatttggtattgtcggggtcttgttaatggtttcgattaccgtttattttgtacgtttggttttgttttattttgataacgaagattaagaaagtgaaagcgataatgaagaataagatgaacgtttccaatcaaaaaaaaaaaaaaaaaa

SEQ ID NO: 1424 - DNA, 401 bp, Lactuca sativa
gaaaccctagcgttcgttcgtcctacgccattatcgtttcctaacgccagcgatcgcagtaatcaatggatccacagccagaaccggtcacttacatatgtggagattgtggacaggagaatacgttgaaggtcggtgatgtgattcagtgccgagaatgtggttaccgtattctttacaagaagcgcactcgtcgaattgttcagtatgaagctcgttgaagaagggtttatgatggaagagctctctcgtggatattttcaagtatgtttatgtttgtaacagaaattgagtgtgaattttggatctaatggtatcctctattatgagtgtaatatcatcctgttttcattgtgaaattgttctgaaatgcaagtatataccatgggtatctcatcata

SEQ ID NO: 1425 - DNA, 404 bp, Lactuca sativa
gtcgaaaccctagcgttcgttcgtcctacgccattatcgtttcctaacgccagcgatcgcagtaatcaatggatccacagccagaaccggtcacttacatatgtggagattgtggacaggagaatacgttgaaggtcggtgatgtgattcagtgccgagaatgtggttaccgtattctttacaagaagcgcactcgtcgaattgttcagtatgaagctcgttgaagaagggtttatgatggaagagctctctcgtggatattttcaagtatgtttatgtttgtaacagaaattgagtgtgaattttggatctaatggtatcctctatcatgagtgtaatatcatcctgttttcattgtgaaattgttctgaaatgcaagtatataccatgggtatctcatcata

SEQ ID NO: 1426 - DNA, 392 bp, Lactuca sativa
tggatttgcttattcgagcgtgtaatcaatggatcctccaccagaaccagttacctatatctgcggagactgtggacaagaaaacacgttgaaagttggtgatgtgattcaatgccgagaatgtggttatcgtatcttgtataagaaacgaacccgtagaatcgttcagtacgaagcacgctgaagaggacaacgcaatggatatggtaacattatgaagcatgtgtaaaagattctggacatggttttaagcaacgtttgcaatttaagatatatgatgtggcatgatttttgttgtcaaatcggttccattttctttaaaactagaactcatattatctcattgtaatatgttactaggttttgcattaaattttaatcatatttcttac

SEQ ID NO: 1427 - DNA, 390 bp, Lactuca sativa
tggatttgcttattcgagcgtgtaatcaatggatcctccaccagaaccagttacctatatctgcggagactgtggacaagaaaacacgttgaaagttggtgatgtgattcaatgccgagaatgtggttatcgtatcttgtataagaaacgaacccgtagaatcgttcagtacgaagcacgctgaagaggacaacgcaatggatatggtaacattatgaagcatgtgtaaaagattctggacatggttttaagcaacgtttgcaatttaagatatatgatgtggcatgatttttgttgtcaaatcggttccattttctttaaaactagaactcatattatctcattgtaatatgttactaggttttgcattaaattttaatcatatttctt

SEQ ID NO: 1428 - DNA, 393 bp, Lactuca sativa
gaaaccctagctttctttcgtctacgccattgtcgttttctaacaccagcatcgcagtaatcaatggatccacagccagaaccagtcacgtacatatgtggagattgtggacaggagaatacgttgaaggtcggtgatgtgattcagtgccgagaatgtggataccgtattctttacaagaagcgcactcgtcgaattgttcagtatgaagctcgttgaagaagggtttatgatggaagatttctctcatggatagtttgaagtatgtttagctttgtaacaaaaactgagattatcaatgtgtgaattttggatgtaatggtatctctattatcatatttgtgttttagatgtcatcctgttttcaatgtgaaattgttctgaaatacaagt

SEQ ID NO: 1429 - DNA, 381 bp, Lactuca sativa
ctagctttctttcgtctacgccattgtcgttttctaacaccagcatcgcagtaatcaatggatccacagccagaaccagtcacgtacatatgtggagattgtggacaggagaatacgttgaaggtcggtgatgtgattcagtgccgagaatgtggataccgtattctttacaagaagcgcactcgtcgaattgttcagtatgaagctcgttgaagaagggtttatgatggaagatttctctcatggatagtttgaagtatgtttagctttgtaacaaaaactgagattatcaatgtgtgaattttggatgtaatggtatctctattatcatatttgtgttttagatgtcatcctgttttcaatgtgaaattgttctgaaat

SEQ ID NO: 1430 - DNA, 446 bp, Lactuca sativa
acgccattatcgttttctacaccagctatagcagtaattaatggatcctcagccagaaccagtcacttacatatgtggagattgtggacaggagaatacgttgaaggtcggtgatgtgattcagtgccgagaatgtggataccgtattctttacaagaagcgcactcgtcgaattgttcagtatgaagctcgttgaagaagggtttatgatggaagatctctctcgtggatattttcaaatatgtttaggtttgtaacaaaaattgagtgtgaattttggatctaatggaatctctattattatatttgtgttttagatgtcatcctgttttcattgtgaaattgttctgaaatgcaagtatataccatgggtatctcatcataatgataatatgctactataaaacaattacatttaatgtgtgaagaagcaagcatttcactca

SEQ ID NO: 1431 - DNA, 409 bp, Carthamus tinctorius
gggggataagggttccatataaatcacaaaaccctagggttcgtgagcccgccattatcgtctcctaattccaccagagattgcagttgtcaatggatccccagccagaaccagttacctacatatgtggagattgcgggcaggagaacacgttgaaggttggtgatgtgattcagtgcagggagtgtggttaccgcatcttgtacaagaagcggacccgtagaattgttcagtacgaagctcgttgagcaagacttcatgatggaaaagtttgcattgatacttttaagcatgtttagcacaatcaaatgatcatgtaacaaggggacacgaacgattactgatgtgtgaaatttggatcttatggtatcgttttttagatgtgaaatgtagtgtgtgatcaaaactg

SEQ ID NO: 1432 - DNA, 742 bp, Gossypium hirsutum
acgagcggccagtatcaacgcagagtacatggggatccacgccgccaaacaaagccttctcctctcctcctcctcctcccctccttcctttgctgttcctaaagtttcgttctctcttagctgcctgaacgtcctatttttccctctctcgtgactcgttcatcaggaaaaacttgtttgagtgagcatcaatggatccacaacctgaacctgttacctatatctgtggagactgtgggcaagagaacacattgaagcatggagatgtgatacaatgccgggaatgtggttatcgcattctttacaagaagcgaacccgaagaattgttcagtatgaagctcgctgaaagtggtgtttggagaaggggagggtatgagcaaacaatctcttagtcagtagttatgtgttttgtatatggttgattatattaagtgtggatagtgaggatttgaacactaagttctgtccatggatgctttgcctagcaacctaagtgatgtctattgatttagaacatcaaaaacaagttcatacttttaaagaactgtctatgttatgtttcttattgtgactgcttttaagtgatttctggttaaatggtgaacttttaaatctttaattatatatttttaagttttggatttgatgtttggttgatagaaatatgtgaatgatataaaggttgttaaatcatcttttgtaggtaaagaaaaaaaaaaaaaaaaataggaaccgactacg

SEQ ID NO: 1433 - DNA, 266 bp, Cleome gynandra
cctaaatgagctcacttggactcccctctagagaattactacggaggctatcgaaaagccctagctcttttgtcgattcgagtattatggatccgttgcccgaacccgttacttatatatgcggagactgtggtcaagagaacactttgaagcctggggatgtgatccaatgccgggagtgcgggtaccgtattctgtacaagaagcgaacgcgcagaattgttcaatacgaagctacgatgagaacaaccacgcaaggttactca

SEQ ID NO: 1434 - DNA, 618 bp, Cleome spinosa
ccctagctccttcaaaaccacaacctttcttgattcgaacggcatggatccgcagccggaacccgttacatacatctgtggagattgtggtcatgagaacacgttgaagcatggggacgtgatccaatgcagggagtgtgggtatcgcattctgtacaagaagcgtactcgtagaattgtccaatacgaagcccgctgagttacaaccactccgagattcactccgcctctctgtgttatatatcaactagaaagtcaaattcccgaacttcgttgctatatgctcggtgtctggtttgatcgccgtgatcgggactggaacatatctgtgttctgccttcaagaacagtcatctctctctttcactgtttactcttttgttataaaaccctatttagatctttttcccgagaaaaactgtcaacagcgtgttgcatgagctcttattaccattgtaaataagcgtggagccatttcgtacacgttggttcgatcaatcttcttcgcttggcttcgcttctgtccttggagaggaaacgtgtgtgtatatgtgtgtgtgtgtgtgtttcggtgattgagagtttgtgattatttttttctatgtaacgttttagaagc

SEQ ID NO: 1435 - DNA, 447 bp, Cyamopsis tetragonoloba
caaacctagaagactagagccttcttctttcaaccagtcatggatccccagcctgagccggtcagctacatctgcggagattgtgggcaggagaacactctgaaacctggtgatgttatacagtgccgtgagtgcggttacagaatcctttacaagaagcgcactcgtcgcattgtccagtacgaggcacgctgaagaaaaatgctgcagcatgggctgggctagtatttccatgaatcatgatattgaactttgaaaaatgctgaagaaattgtgaatccaacttccaccttatattggttatctcgtatctatgtaggggaaaaacctgttgggaaatatagaactttgaaatgtgtgaatgcattatgaacatccatgtgctataatttgcacttgacatcccgtttatggtaaaaaaaattcttattgactcaaaacctcgtg

SEQ ID NO: 1436 - DNA, 450 bp, Taraxacum officinale
ccgtaatcaatggatccacagccagagccagttacatacatatgtggagattgtgggcaggagaacacgttgaaggtcggtgattcgattcagtgccgagaatgtggttaccgtattctttataagaagcgtacccgtcgcattgttcagtatgaagctcgttgaagaaaagaaagcttgagtggatatattcaagtctgtttagcacaattaatgatatgtttttaacaaaaagttgattacttgtgtgaatttggatctgtgttttacatgttaaatgcagtatcatcttttttcttccctatgaaattatatattctcagtatcttatatttatgtcaacaacaatctgaaaatataaccatttttattagtatcggtaaaagtattgtgctgttgaattctacattaaatgagaattgagtttgactaaaaaaaaaaaaaaaaaaa

SEQ ID NO: 1437 - DNA, 336 bp, Panax ginseng
atttctctcctataaaagcaaaagccttaaaccccagcaaactctttacctccttccggcgtcaaagtgaccttagattttgatcgcgttgatcattaatggatcctcaaccggaacctgtgagctacatctgtggagattgtgggcaagaaaatacactgaaacctggtgatgtgattcagtgccgggagtgtggttaccgtattctctacaagaagcgtacccgcagaattgttcagtatgaagcacgctgaagaagtggatagggaagtggactggagaagatgatgggggagcttatacatatttaagggatgaagcaagtattaataatgt

SEQ ID NO: 1438 - DNA, 348 bp, Orobanche aegyptiaca
aaccctagccccttttcaaaacgaccgtaaaacctaatttctacagtctctgattatcgccgttcgattaacaatggatcctcagcctgagccagtcagctacatctgcggagactgcggtcaagagaatacgttgaagccaggggatgtgattcagtgccgtgaatgtggttaccgtattctctacaagaaacgaacccgcagaattgttcagtatgaagctcgttgaagccgttcttgaacgtccatatgttgaagggtcccgactgtattatcacgataatgattgtgaaatgttattttgtatggtgatgatgagaaccaatatatcagctgagttatggtgtc

SEQ ID NO: 1439 - DNA, 572 bp, Orobanche aegyptiaca
taaaccctagccccttttcaaagaccgtaaaacctaatttctacaacctctgattatcgccattcgattaacaatggatcctcagcctgagccagtcagctacatctgcggagactgcggtcaagagaatacgttgaagccaggggatgtgattcagtgccgtgaatgtggttaccgtattctctacaagaaacgaacccgcagaattgttcagtacgaagctcgttgaagccgttcttcacggtccatatgttgaaggcccccgattgtattttaacaatatgattatgaaatgttattttgtatggtaatgagatatcatagtatatcaactttgaattatggtgtcattattattctaatatgttgggaatattaacaatgcaatttgtgtagtaagaatgttatgttgctagtgaactacttattgtttgcatggttgttattcttatttgttccttgttcatgttagggttgtaagatatcaaatatttttgactcgattcaatattcgaattcgattatcaagattcgaattcgaaatattagaataagaatccagtatttattct

SEQ ID NO: 1440 - DNA, 1293 bp, Beta vulgaris
gcacgaggcgaagaaccagtagacagaacacagaagtctcacagcagcgaaccaaaccctttcgctaatctttctcttcaaaccttgccgtcctctgctcaactgccctttttttgagtggaaattcgaaatcgcagtatcagtgatggatcctcaacctgaacccgtgagctacatttgcggagattgtgggcaagagaacacactgaagcctggtgatgttattcagtgtagagagtgcggctaccgtattctttacaagaaaagaactcgaagaattgtccaatatgaagcacgctaaatgagatgctgaggttcaaacagaagtggagatgtaatatggattctgtctgatggaaatgctatatgtttagttggtcaaaaatgtgattctgattgtgattgtggttgtgggagtcttaagatgtgggtcagtcctgttttaatgtttatcttgtctggacattacctggaggaaatggaatgattgacagcctaatcagctagtttttggggaattaccaagtagaaactattactattctattattgtagttgcctagttggtgccacatgctctatctttgaaaggtgataagattcacatcttgcgtcatgaccctttccctttcctaaaaaaaaaaaaaaaaaaaacccgagttttttttttttttttttaaaagaaaattttcggggcccaaaatccctcataaaattcccacaataccaagggctttaacaaaaaaaccttgttgaaaccaaaaaaatacctcttttggcaaccccattggccaactttttttcggattcaacttccacaaggggaacaattacttcaaaaggcctaacccaacataaccctctttccaaaagtataaaccccgccaattccacaggcgaaaaatttttttaaaccctgaagaccagtttttttccaaaggccgcccaaaaataaattccaccccttgcccacaaaggcaagttatcccacggtcttgggagttctcttggcaaacccactctaaaggtgggctaaactgtgccacccccggggtcacataagggtgaaactctccccccttctatgtctcaaggtctctcccccttttgacgcgaaaataaaacccctaacccaacaccatttgggaggctttttaaaaaacattttcttttcaacaaaactcttaacgtcgcgtggggtgggcgcttcccccacacctcgcccgcgtggctcacaaggaccctctacatgggcccttctacaagcgggggattaccaaccctttctgattt

SEQ ID NO: 1441 - DNA, 371 bp, Brassica napus
gactcctcttcgctcgtgtttgtagttccgcataaaccctaccttgttcgactcgagtcgataacatggatcaacagtccgaacctgttacttacgtctgcggagattgtggaaaggagaacactttgaagtctggggatgtgattcagtgccgagagcgtggttaccgtattctttacaagaagcgtacccgtagagttgttcaatacgaagctcgctgagaaccacatccctgaacgatgatgatatgaagtctgtttaaggtggcatatagacttgtcctgcctctgtttgtaatttaacttgacttaaaatctgtttttgtttccgttaagagcatctttatccgtaaaaccccaaatgaggttctt

SEQ ID NO: 1442 - DNA, 1050 bp, Catharanthus roseus
aaagaattcggcacgaggaaaccccgctgccggagtcagtcgaagcatcgagaaattgttttctaaaattctgctttctttcattgctgattgctatggatcctcaacccgagccagtcagctatatctgcggagattgcgggcaagagaacaccttgaagcctggggatgtgattcaatgcagagaatgtggttatcgcatcctttacaagaaacgtactcgtagaattgtgcagtacgaagctcgctaagatgagaatgtggtggagttgcaatatcacctaaggtgttctaaatagttctgttgcatatgttatggtagatgtcctagtaagtgcttggcttatgttgtggactttaagtactgtgtttctatagccagtggaacctgcaatttgcgtccaagttgtgtggtattggtgatgctctgttggtaatctagaggaaaccaatttaccttaatttggtactgttacatccttgatttgtatctagtgcattttcactttctggtatttatcatcatcctttcttctacaaaaacctcgtgccgaattcggcacgaggcattatcgcctgcttctcccttcttcacttgcacgtcgagcaaaagagagttaatatcatcagccaagatgcagaacgaagagggacaaaacatggatctttacatccctaggaaatgttccgcaaccaataggttgattacttcaaaggatcatgcttctatccagatgaaccttggacatctggatgagaggggtgtctatactggcgccttttccacatttgctctttgcggctttgtccgtgctcagggggatgccgacagtgcccttgatcgcctttggcagaagaagaaggttgaagtccgtcagcagtagatgatgccagtagatggtgggtgaatttcgtttgtagaactaaatgattttgtctcctagtactatagtatttgtggacaaagtatgattttgcctggttaatttctaatgaatcttgttttcagttactgagttgatcacatttatcttatttgtcttctatttc

SEQ ID NO: 1443 - DNA, 413 bp, Centaurea maculosa
tgtctaccatctcctctgactccgccttcttcagtaatcgatggaccaacagccggaacctgttacttacatatgtggagattgcgggcaggagaacacgttgaaagtcggtgatgtgattcagtgccgggaatgtggttaccgtatcctgtacaagaagcggacccgtcgaattgttcagtacgaagctcgttgaagaagacttttagtcgaagcttgtatggatatttcgaaatatggctagcacaattcaatgatcatgtagcaaactaagtgatgattaaccgacgatatgtaaaacttggatcttacggtatcttgtgtgttttagatctatgatctcatcttgtttaatgataaaatgtttatagagcacatctatttattatgttatatcatattcttaagggatt

SEQ ID NO: 1444 - DNA, 733 bp, Coffea canephora
gaaaacccgtccctcccagacccggtcgtctccgtcccttggcttaaaactctgccatttcccagcgactttgaagcttccagagcttgaaattaccgaatttcgggtataatggatcctcaacctgagccagtcagctatatctgtggagattgtggacaagagaacacgttgaagccaggggacgtgattcagtgtagagaatgcggctatcgtattctttacaagaagcgtacccgtagaattgttcagtatgaagctcgctgagctgatctcaactgtgcatcatcactatctcaagtattttgagttgttctgctgctgctgctgctgcatattttttatgcctgatgtgatatatgttggtagttttattcgatggattgtagttaatgttttctacttgttgatggagtctgctcttgatgtatcagttgtattgtagacttgctcctatgctgtagacacaatgactaaagtttccagggaagtcccatccatgctgtaggctcttgcatcttgagcatttcactttctattgttatcttttgaccgtcctttgtgtgtttgcgtattcttcgctcgttccttttttgccgagggcaaattaatacaaggaaacacaaaaagcaaatggaagcaacagatatgagatactgaactaaagggcgcttcctaggactagaatgttttgcctagtcagaaacgatggtctgggggtttggttggttgc

SEQ ID NO: 1445 - DNA, 518 bp, Coffea canephora
tcgtctccgtccctaggcttaaaactctgccatttcccagcgactttgaagcttccagagcttgaaattaccgaatttcgggtataatggatcctcaacctgagccagtcagctatatctgtggagattgtggacaagagaacacgttgaagccaggggacgtgattcagtgtagagaatgcggctatcgtattctttacaagaagcgtacccgtagaattgttcagtatgaagctcgctgagctgatctcaactgtgcatcatcactatctcaagtattttgagttgttctgctgctgctgctgctgcatattttttatgcctgatgtgatatatgttggtagttttattcgatggattgtagttaatgttttctacttgttgatggagtctgctcttgatgtatcagttgtattgtagacttgctcctatgctgtagacacaatgactaaagtttccagggaagtcccatccatgctgtaggctcttgcatcttgagcatttcactttctattgtt

SEQ ID NO: 1446 - DNA, 562 bp, Gossypium hirsutum
  misc_feature (296)..(296): n is a, c, g, or t
  misc_feature (400)..(400): n is a, c, g, or t
  misc_feature (402)..(402): n is a, c, g, or t
gacatggatatcagtgtatgttactccaactatattaaaaagttttgagcaggttcgtcaggaaaaacttgtttgagtgagcatcaatggatccacaacctgaaccggttacctatatctgcggagactgtgggcaagagaacacattgaagcatggagatgtgatacaatgccgggagtgtggttatcgcattctttacaagaagcgaacccgaagaattattcagtacgaagctcgctgaaagtggtgttcggagaaggggagggtatgaacaaggaatctcataatcagtagntatgcgttttgtatatggttgattatattaagtgtggttagtgaggatttgaagtaacactaagttctgtccatggatgctttgcctagtaactaagtgatgtntngatttagaacatcaaaaacgaattcatacttttaaaaactgtctatattattgtgactactttttagtgatttctggttaaatggtgaacttttaaatctttgtttatatttttcaatgccgaaggtgaccgactcgggactacttatagagcgggcggg

SEQ ID NO: 1447 - DNA, 429 bp, Cynara scolymus
gcgggggatcgcaaatcctagggttcgtgagaccgccattctctacgagtcattccccctgctgcctcgttttcttgctcagtaaccaatggacccccagccagaaccggttacttacatatgtggagattgcgggcaggagaatacgttgaaagttggtgatgtgattcaatgccgagagtgtggttaccgtattctatacaagaagcggacccgtataattgttcagtacgaagctcgttgaagaagactttacgatagaagcttgcatggatggatattttcaagtatgtttggaacaatcaaatgatcatgtgaacaaccaacaaattaccgatgtgtgaaatttggatcttatggtatctctcattagatgccaatgttcatcttgtttaatggtgaaatgtttatagagtacaactatttatc

SEQ ID NO: 1448 - DNA, 708 bp, Vitis vinifera
acattttctctcaaattttctgaaaaccaaacatagtctgaagttgccctccagccgagagaattgccctttccccttttctgaagctgccctccagccaagagagttcctcttcctaaaaagacctatcttcctctgccactctcaatcctcgcagattttgtatcctgtgcgcgggctggactggtaggaaaatatcgggaaattttccgataaatcggtatttcgccgatatttcgcaaacgtgaaagggggactgaagggttttgtcttgggagaaccctaacgccgccttgcatagcagcagctctgcttccaaaatggatccgcaacccgaacctgttagctacatctgtggagactgtgggcaagaaaacaccctgaagcctggcgatgtgattcaatgccgtgaatgtggttaccgcatcttgtacaaaaagcgaacccgtagaattgtgcagtatgaagcacgctgaaggcaatgtgaaagctcaagcatatagagttggttgattctgtatcacttggtagaaggatgtgcatctattttgatactaatgctgggcgtattattataaggtttctgttggattgtctcaaacaattacttgtcaacaatgaaatgaacaggcattgataggtacaatgaaatgtacttgataaattctattggcttgatatttcttaccagaaatctttttgtattta

SEQ ID NO: 1449 - DNA, 423 bp, Vitis vinifera
aagacctatcttcctctgccactctcaatcctcgcaggagaaccctaacgccgccttgcatagcagcagctccagaaccctaacgccgccttgcatagcagcagctctgcttccaaaatggatccgcaacccgaacctgttagctacatctgtggagactgtgggcaagaaaacaccctgaagcctggcgatgtgattcaatgccgtgaatgtggttaccgcatcttgtacaaaaagcgaacccgcagaattgtgcagtatgaagcacgctgaaggcaatgtgaaagctcaagcatatagagttggttgattctgtatcacttggtagaaggatgtgcatctattttgatactaatgctgggcgtattattgtaaggtttctgttggattgtctcaaacaattacttgtcaacaatgaattga

SEQ ID NO: 1450 - DNA, 554 bp, Mesembryanthemum crystallinum
gttttggacaagcaacgccgttatcactatctctcctcttccaaaatcgtctatattaatacactgccgcttcacccttcaaatcctcaagcaaccatctttctttcatcgcaccggtttctgatttcaaccttaacaatggatcctcaacctgaacctgttagctacatctgtggggactgtggacaagagaacactctgaaacctggtgatgtgattcagtgtcgagagtgtggctatcgcattctctacaagaaacgcacccgtagaattgtccagtatgaagcacgctgaaattgacgcacaattcttaaaaattgttcataaggatatcgaacatgtttagctggtgggtatgatgtagctggtgttggtcttgattatgttggctatataactcaattgtcggaaaacaagctccatgaagtgttaattttctgtttttttttttttttttaatatggatttctctctttggtttattgtcgccttcctgaatcttcgctgagttcttttcctttgttgcaataaacaaacactcttatatcaggggc

SEQ ID NO: 1451 - DNA, 436 bp, Actinidia deliciosa
  misc_feature (307)..(307): n is a, c, g, or t
  misc_feature (323)..(323): n is a, c, g, or t
  misc_feature (332)..(332): n is a, c, g, or t
  misc_feature (342)..(342): n is a, c, g, or t
  misc_feature (346)..(346): n is a, c, g, or t
  misc_feature (381)..(381): n is a, c, g, or t
gtctctctctctctcttcaaaagatcctgaatttcatcatccatggatcctcaaccagaaccagtcagctatatttgtggagattgcggccaggagaatacactgaagcctggtgatgtcattcaatgccgcgagtgtggttaccgcatcttgtacaagaagcgaactcgtagaattgttcagtatgaagcacgctgagcaggattagaggaaagcctcctacaaagatgatatgagaatgggggaaaagaaaggggtggggatgtttaaaggcgtgaaggctgattttgtttacattgctgggtantattgagtggatatcnaagtcgtgnttgcactggntttngtacgttattgtataacagatggttgtgttgagtnttgtgttgcgactttgttgtgtttggatcaaaatgtgattttcaattaaaaaaaa

SEQ ID NO: 1452 - DNA, 425 bp, Mimulus guttatus
ggaagaaaacctttataaaccctaaaatttcagagtctctggttatcgatcgccgaaaacaatggatcctcagcctgagccagtcagctacatctgtggagattgcggccaagaaaacacactgaagcaaggggatgtgattcagtgtcgtgaatgtggttatcgtattctctacaagaaacgtacccgccgaattgttcaatatgaagctcgttgaagtcaacatcaaagtcccaccatgtagcggttgttcggtatgaagctcgtttaagcagtatgaagtaggtctccatgtattataactgctgcaaattgtgttatataatgttctacttttatactcgtaaccgtaatatgtgatcgtgtgttttctcgtgtgagtagtctatgttcgaacgagtaatctggaaaaagatttggttttt

SEQ ID NO: 1453 - DNA, 435 bp, Petunia hybrida
gggacaggatggatgctccaccagaggcctgtgagttacatctgtggagattgtggacaggaaaataccctaaaatcaggtgatgtgatacagtgccgtgaatgtggttatcgcattctctacaagaagcgcacccgccgaatcgtgcagtatgaagctcgctgatgctggtacatcacgccttccgagtattgccgatatgcaattgattttggaatagcttcaagtgcttctgtcgtggtagtagatgttaagtatgtaatagtggaggttatgctttttactgtttgtgcaaatcttttctgaatggccattgcataatgtcactcttcagcgtggtctatcttcgtgtgcattccatcttgttattatggaattattagttcaaggtttgctgttgagtattctgacataatattagaatccttcttggag

SEQ ID NO: 1454 - DNA, 601 bp, Brachypodium distachyon
atcctaaaaaagccctagcacgtcctcgaatcgaaaccagcagcctcggcccgccgaacccccctgcccctccccacgccgccgccgccttgtaactaggcagagtagctgtttttcgtttcgccgactccgcaggagctccctccgatggatccgcagcagccggaacccgtcagctatctctgcggagattgtggagctgagaacacgctgaagtcaggagatgtgatacagtgtcgtgagtgtggctatcgcatcctgtacaagaagcgcacacgccgaattgttcaatatgaagcccgctgaagagagaaagctacaatgttggatgcatgatactccgtacaagacttgtagtttgatggttgatcgtgtccgtccatgaactggactttaggttgaagtcgtaaaactcccaactgtgtttgagatttgagataatgcacacctaaggttttctattgtttgtttgttcatgtgacgtgaatttctcgtgtcaagcagcatccacatttgaagaacagcaaactgtcgtaatttctttcagctggttgtgactgtcaacttctgtagtgtctatgccatctgcagttaactgacg

SEQ ID NO: 1455 - DNA, 633 bp, Avena sativa
gtccgctgcctctcacaaaccctagctcttctaaaccctactccagcccgccgcacgagcttctccccgatggatccgcagcagccggagcctgttacctatctatgtggagattgcggagccgagaacacgctgaaggcaggggatgtgatccagtgccgtgaatgtggctaccgcatcctgtacaagaagcgcacccgccgcattgtccaatacgaagcgcgctgaagacaaaggagcaacaatggcaaagcaaatgaagaacattcgccgttagcttgtgcctctaagtgctgtagtgtggtgctctcagacaaagctataatggagaagaaatgtatagtactcctagttccgtatctgtccatgcactttggcctgaactggtaaaacctggtgaactgtattgatatgtttggtatatttgggaagtgagattatatggatcttatgagctgggaatcaaaagatggctctctacaatctcaacaaaaaatgtctttctatgccgcaattgctttctgcaacaatagctgtctgttgaacgtgggcacttattatttgttgattgtattgtgtatcatcatgtattttgattgttcttcactggtatggtagcaatttgcttgtgcc

SEQ ID NO: 1456 - DNA, 560 bp, Musa acuminata
ggggacgccgtggctgccgtcggtagttctgtccttggtagccgcaagcctagagcgctcgacgatcccgtttctttctcctctagaagacctttgtttcctgagtcatggatcccctgcagcctgaacctgttagttacatatgtggagattgtggagcggagaacacgctgaagcctggggacgtgatacagtgcagggagtgtggatatcgcatcctttacaagaagcgcactcggagagttgtgcaatacgaagcccgttgagaataacagaacctctgtggatggcgagttatctgatatgttggtggtcttaaagaacttataatacagtattgatgtcattgtggaccatgggattagtaaaacccagtaaacaaatagactgcaaacactatgaactgaagatttctttttgagccgtcactgtgattgtaagttatacctgtgtgccagctgatcaaaactgggtttgggtttatgggatgccacatttttattaactagggttccaactagaagttttgaagtgctcttacaaagtaatctctgtctatc

SEQ ID NO: 1457 - DNA, 561 bp, Musa acuminata
  misc_feature (40)..(40): n is a, c, g, or t
  misc_feature (509)..(509): n is a, c, g, or t
ggggacgccgtggctgccgtcggtagttctgtccttggtngccgcaagcctagagcgctcgacgatcccgtttctttctcctctagaagacctttgtttcctgagtcatggatcccctgcagcctgaacctgttagttacatatgtggagattgtggagcggagaacacgctgaagcctggggacgtgatacagtgcagggagtgtggatatcgcatcctttacaagaagcgcactcggagagttgtgcaatacgaagcccgttgagaataacagaacctctgtggatggcgagttatctgatatgttggtggtcttaaagaacttataatacagtattgatgtcattgtggaccatgggattagtaaaacccagtaaacaaatagactgcaaacactatgaactgaagatttctttttgaggccgtcactgtgattgtaagttatacctgtgtgccagctgatcaaaactgggtttgggtttatgggatgccacatttttattaactngggttccaactagaagttttgaagtgctcttacaaagtaatctctgtctatc

SEQ ID NO: 1458 - DNA, 399 bp, Brachypodium distachyon
ggcagagtagctgtttttcgtttcgccgactccgcaggagctccctccgatggatccgcagcagccggaacccgtcagctatctctgcggagattgtggagctgagaacacgctgaagtcaggagatgtgatacagtgtcgtgagtgtggctatcgcatcctgtacaagaagcgcacacgccgaattgttcaatatgaagcccgctgaagagagaaagctacaatgttggatgcatgatactccgtacaagacttgtagtttgatggttgatcgtgtccgtccatgaactggactttaggttgaagtcgtaaaactcccaactgtgtttgagatttgagataatgcacacctaaggttttctattgtttgtttgttcatgtgacgtgaatttctcgtgt

SEQ ID NO: 1459 - DNA, 634 bp, Vigna unguiculata
  misc_feature (572)..(572): n is a, c, g, or t
ggagtgtgcatcaggtccgaagcgaaacctaaagcctagaaccttcttcttttacagtttgccggaatcaccgatggatcctcaacctgagccggtcagctacatctgcggagattgtggcatggagaatacgctgaagcctggtgacgttatacagtgccgcgagtgcggttaccgtatcctttacaagaagcgcactcgtcgcattgtccaatacgaggcccgctgaagaaaactgctgcggcattggcatttccatgattaaaatgtgctgcatatgtaccatgtgttgtatttggtctgtgatattgaagaactacttataatacagcgatgatctgagaattctgcagtttgcattttgatgatagttttagaaaacgagaaaagaaaacttttaaatgtgaatatatttttactatttttgctcattaatagatcaactgggtgtttggtttggttagtcgtctcatgtcctcgtttacatgtttgttttaatacccatcatcatagtttgtttaaggtgctattttttatttatgctttttggggttgtttttgggaatttatcnaaagcagatcatgtttgttggacgttcttgattatatcaacgaagtatttgttagtactatt

SEQ ID NO: 1460 - DNA, 488 bp, Ipomoea nil
ttacggccggggcagtttggctgtgtcaaaactattactgtagcgagcgctgcgcattggagtcaatggatgctcaaccggaacccgtcagctacatctgtggagattgtggtcaagagaacacactgaagcagggagacgtgattcagtgccgtgaatgtggttaccgtattctctacaagaagcgaacccgcagaattgtgcaatatgaagcacgctgatactcatggtttggagatccactggagaagttgatatggaaggtgtcaagtatctcacttagtgaataaggagatgtcaatacttattaagcatgtaatgccgctattacctacagtacttacattttaaattgcaccattatttgtagaactgcttcttcctcttgagtccggtgttaatgtcagtgttctgtctgcaaatgtgggcttgtgccattgtgaaacttgaatagttgaatgttagtcatctttggtgtcttgtgtcat

SEQ ID NO: 1461 - DNA, 804 bp, Cucumis melo
  misc_feature (607)..(607): n is a, c, g, or t
  misc_feature (642)..(642): n is a, c, g, or t
  misc_feature (654)..(654): n is a, c, g, or t
  misc_feature (657)..(660): n is a, c, g, or t
  misc_feature (671)..(671): n is a, c, g, or t
  misc_feature (684)..(684): n is a, c, g, or t
  misc_feature (690)..(690): n is a, c, g, or t
  misc_feature (694)..(694): n is a, c, g, or t
  misc_feature (698)..(698): n is a, c, g, or t
  misc_feature (713)..(713): n is a, c, g, or t
  misc_feature (718)..(718): n is a, c, g, or t
  misc_feature (720)..(720): n is a, c, g, or t
  misc_feature (722)..(723): n is a, c, g, or t
  misc_feature (725)..(725): n is a, c, g, or t
  misc_feature (731)..(731): n is a, c, g, or t
  misc_feature (734)..(734): n is a, c, g, or t
  misc_feature (736)..(736): n is a, c, g, or t
  misc_feature (744)..(745): n is a, c, g, or t
  misc_feature (751)..(751): n is a, c, g, or t
  misc_feature (755)..(756): n is a, c, g, or t
acttttgtttggtttttccgtcgccgatcattatagtcaagccctacgcgacttcgatttctttctctgctctcgcatcaccctcgcagcggaagatttttgaagtttcactcatggatcctcaacccgaaccagtcagctacatctgtggagattgtggaatggagaacactctgaagcagggtgatgttatacagtgccgggagtgtggttatcgtattctctacaagaagcgcacccgtcgcattgttcagtacgaggcccgctgaaatgcttattcttgcgatggacttctagtatcatgcatattttgtaagtttcttttaggaaaacaaaaacgatactcgatatggactaaggacttgctgtagtacaaaacatgttgataacgctgcttaaatatttttcattatcctcttgtgctaactccatatccaactgataatatgatatgaatggtttatctcttgatagactggatggttcagttttgcatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaagggcccccccnccccccaaaaanttnnnnaaaccccccanccccggggggggnccgggncccnattncccccaaaagggggncaaanancnncncccccnggncngccttttnnaaaccngggnnggggaaaaacccgggggttccccaatttaaccccttgggagcaactcc

SEQ ID NO: 1462 - DNA, 531 bp, Elaeis guineensis
gaaaaagaaaaccctagcttgcggttctggagtcaaatggatccccagcctgagcctgtgagctatatttgtggagattgcggagcagagaatactttgaagccgggtgatgtgattcaatgcagagagtgtggataccgcatcctgtacaagaagcgcactcggagaattgttcagtatgaagcgcgctaaggataaatgtgaagggatgcccttggtgggagctgctgtctgttgaatggcgtactgtggagtatttgagtgtcggagattcgaaaaaacaatactagtggtcttttgtgtgtttatagcgtatggataattttgaccgactaaactctctctttaatggctgactgttatcatatgctgtttgttgagtattcttgttatacatcttgacagcatttcttggtccagttaaaattagtattttatcagttcgtggaattatacataaatataaatgtgtagaccatgatattatgcttttaaagggaatgctcggtcgaaagatcgccatggccaaat

SEQ ID NO: 1463 - DNA, 328 bp, Petunia hybrida
tcgagacactgttggcctactggagttgtatttaataccctaaaaccctttcattctgagtaataattggaatagtagttgctctgtaccattgactgacgaggatggatgctcaaccagagcctgtgagttacatctgtggagattgtggacaggagaataccctaaaatcaggtgatgtcatacagtgccgctgaatgtggttatcgtattctctacaagaagcgcacccgccgaaatcgtgcagtatgaagatcgctgatgctgatatgtcgcgccttccgagatattgccgatatgcaattgatattggaatagcttcaagtgg

SEQ ID NO: 1464 - DNA, 435 bp, Manihot esculenta
gccggccatactctacgagtcttcgtcttcgtcttcgtcttcatcttcatcttcattcctctcattctctctcgagttaaacctagagttgaactcatggatcctcagcctgagccagtcagctacatctgtggcgattgtggcatggagaacactttgaagcccggagatgtcattcagtgtcgagagtgcggttaccgtattctctacaagaaacgcactcgccgaattgttcagtatgaggcacgttaaaagcagaacaggatgcacattttgtatacagagctttgtattgaagcacgctttgtctgggtgcaactagcaaatatattttggttttctgtattttgatgagatttcatgttgaaactgtcaatttgactggtctggtatcattctctatgctataactaaaatctgtctcggatgatgcat

SEQ ID NO: 1465 - DNA, 408 bp, Cucumis sativus
gcaggaagatttttgaagcttgactcatggatcctcaacccgagccagtcagctacatctgtggagattgtggaatggagaacactctgaagcagggtgatgttatacagtgccgggagtgtggttatcgtattctctacaagaagcgcacccgtcgcattgttcagtacgaggcccgctgaaatgcttattcttgcaatggactttactagtatcatgaatattttgtaagtttcttttaggaaaacaaaaacaatactcgatatggattaaggacttgctgtagtacaaacatgttgataatgctgctactatgccattatccccttgtgctaactccatatccaactgataatatgaatgaatggtttatctcttgatagactggatggttcagttttgcatttc

SEQ ID NO: 1466 - DNA, 281 bp, Eschscholzia californica
ttctcttcttccttcaaacatacagaaacccttaacagtaaatttgcccatacatggatccgcagccggaaccagtaagctacatctgtggagattgtgggatggagaatacactgaaacaaggggatgtaattcaatgccgggagtgtggttatcgcatcttgtacaagaagcgaacccgtcgaattgttcagtatgaagcacgttgaagaagggaagctattgaaattggtcatggaaattaaagtatgatacttgttgcattatgaatgtttgaagtc

SEQ ID NO: 1467 - DNA, 822 bp, Linum usitatissimum
aggccctcattgattctttttcatcagagaggacttattcacagtagtagttggtttattaagaaaataatctgttggtcgaaccgggttggttaaacacttggttggatgatattgaccgagtatatatcaacaaactatatgttcaatctacaccaatattgttttccttggaccttgaatacatgcatgagctttgttctagcgttggccacgatgaactcatgtatcggtgaacggttgatctcgggctcttggttcttggtcgatgagtaccggtaccatgtcgcctcgggtttttcactttcgatcttatgtcacggtgaatcaagaacaaaaaatcttgtgatgaccctttgttcattgcctcccaacagcctttgctagtgatcgatcttccactcttctatttgctgcttcccctgcgaacaaacacaagtcagtcggtagaatttgacgccatggatcctctgccagagccggtcagctacatctgcggagattgtggaacagagaatactctgaagcctggcgatgtcatccagtgccgagagtgcggttaccgtatcctctacaagaagcgcacccgccgaattgtccagtacgaggcacgctagagagttgtaatcaagagacctatggtcttgagcagtctgcggcaaccgaagctacattttacagataactagtcatgttaagcctttgagtatttctgcagcttgtaaaagatattcctagacttgatgtcctagaatgctgggcaatgtgaacatcctgatgttaatggcagtgtttatggaatgaggggaaatgtttgtactg

SEQ ID NO: 1468 - DNA, 485 bp, Ipomoea batatas
ttacggccggggcagtttggctgtgtcaaaactattactgtagcgagcgctgcgcattggagtcaatggatgctcaaccggaacccgtcagctacatctgtggagattgtggtcaagagaacacactgaagcagggagacgtgattcagtgccgtgaatgtggttaccgtattctctacaagaagcgaacccgcagaattgtgcaatatgaagcacgctgatactcatggtttggagatccactggagaagttgatatggaaggtgtcaagtatctcacttagtgaataaggagatgtcaatacttattaagcatgtaatgccgctattacctacagtacttacattttaaattgcaccattatttgtagaactgcttcttcctcttgagtccggtgttaatgtcagtgttctgtctgcaaatgtgggcttgtgccattgtgaaacttgaatagttgaatgttagtcatctttggtgtcttggac

SEQ ID NO: 1469 - DNA, 494 bp, Cucumis melo
ttttacttttgtttggtttttccgtcgccgatcattatagtcaagccctacgcgacttcgatttctttctctgctctcgcatcaccctcgcagcggaagatttttgaagtttcactcatggatcctcaacccgaaccagtcagctacatctgtggagattgtggaatggagaacactctgaagcagggtgatgttatacagtgccgggagtgtggttatcgtattctctacaagaagcgcacccgtcgcattgttcagtacgaggcccgctgaaatgcttattcttgcgatggacttctagtatcatgcatattttgtaagtttcttttaggaaaacaaaaacgatactcgatatggactaaggacttgctgtagtacaaaacatgttgataacgctgcttaaatatttttcattatcctcttgtgctaactccatatccaactgataatatgatatgaatggtttatctcttgataaaaaaaaaaaaaaaaaa

SEQ ID NO: 1470 - DNA, 522 bp, Tropaeolum majus
gagtgccattacggccggggaatgattttcttttctttatatggccctaactttgttagagtaactgcttttcacgcaacctcaggaaggcttcttcttcaacctcaagaatctccttcaacgtaaaagtaatcactcaccatattttattaaataatggatcctcagcatgaacctgtgacgtatatctgtggagattgtggccaagaaaatactctgaagccggctgatgtgatacaatgcagggaatgtggttaccgcattctgtataagaagcgaacccgcagaattgttcaatatgaagcacgttgagaacaaaacaaaatgctgatacattcggatatgtgtgaagaaagtagaattccgatatttgggtacttagtgtttttaaatgtgtggcagaccgtgtctatattctaatgttggattgatgaggtttggcgtattattttaggttttatttgttctgattagaaactaaaccatgttatgatttagcaaacgaaatgcttgccttacaat

SEQ ID NO: 1471 - DNA, 498 bp, Cajanus cajan
tacggggggattttcagtgtgcagaagctccgtaccctaaacccaaaccctagaaccttcttccgtcacagttcgccggaactagcgatggatcctcagcctgagccagtcagctacatctgcggagattgtggtatggagaatacgctgaagcctggtgacgttatacagtgccgtgagtgcggttaccgaatcctttacaagaagcgcactcgtcgcattgtccagtacgaggcacgctgaagaaactctcaacattgacaagtaatttccatgaagaaattgttgcagtatctgtgcttggtattaggtctatgatatttaagtttttatacaatgatgatgcgagtaattctactgtacgattgcatttgggtgatgtttagaaaaggataaaactttgaaatgtgaatatctattacgaatatgtgttcattagtgtgtaactttacatcactattgtggttaagaattttaagttttaactattaaagaaaa

SEQ ID NO: 1472 - DNA, 245 bp, Salvia sclarea
ctactagaccttggctgtcactcagaaaccctaaaaatctcgaattctcttcacttttcctcgccgatcaacaatggatgctcagcccgagccagtcaactacatctgcggagattgtgggcaggaaaacacgctgaagcaaggcgatgtgattcagtgccgcgaatgtggctaccgcattctctacaagaagcgcacccgccgcattgtccaatacgaagctcgctgaactcacttccccggcg

SEQ ID NO: 1473 - DNA, 484 bp, Ocimum basilicum
gcacgaggacccactctgagctagcggcggcctcaaaaacctcaactcgaaatttcttcaaatccaataatggatgcgcagccagaacccgttagctacatctgtggagattgcgggcaggaaaacacgctgaagccaggggatgtgattcagtgccgtgaatgcggttatcgtattctctacaagaaacgcacccgcagaattgtccagtatgaagcgcggtagagcaatttccaaggtcctcgtatgatgttgaggagtattttcccccttactgcaggctacacttgtgttatgtgatgatctagtgatgttgataaatggtgatatgaggacatgtgatatatggtgtttcacattttatgttctgtggttggctgggtgctcatgaaacaaagaaatgaaattctgcaatgtgacagggatatatatattcatgacatgattgctagttacttgttcatatctatcaaatctttgctgc

SEQ ID NO: 1474 - DNA, 586 bp, Phaseolus coccineus
attcggccactccaatgttttctgtgtgcatcagctccgaagcgaaacctaaagcctagaaccttcttctttcacagtttgccggaatcaccgatggatcctcagcctgagccggtcagctacatctgcggagattgtggcatggagaatacgctgaagcctggtgacgttatacagtgccgcgagtgcggttaccgtattctttacaagaaacgcactcgtcgcattgtccaatacgaggcccgctgaagaatattgctgtggcattggcaagtgatttccatggagaaaatgtgctgcatatgtgccatgtgttttatttgttgtgatattgaagaactacttacagtacaatgatgattagagtaaatctacagtttgcatttagatgatgcttttagaaaaaggataaaaaaacttttaaatgtgaataattattaccatttttgtcattagtttgcaatttaacaattgtagagtttggtgctcaaaagtagaaaaactgtgactgttgttaggttttgttagtcgtctcatatccttgtttatgctttgctgtaaaacaaaatgaacagtttttatttca

SEQ ID NO: 1475 - DNA, 388 bp, Fagus grandifolia
ttgagggcaagccgtatcaatctcctataaaatgacctttatctcgtatgattttatagggtatcgtgcctcgatttctagggttttcattctcaacctggttttcattctatatagaagtttggaatctgtacatcttgttcgacttgatggatcctctacctgaaccagtcaactatatctgtggagattgtgggatggagaacactctgaagacaggtgatgtgatacagtgcagagagtgcggttaccgcatcttgtacaagaagcgcacccgccgtattgttcaatatgaggcacgttaaggaagagatttaaaaacagaattggggaggcacatgtaatttcataaaagccatcgctttgtctttgtgcagcttgctaattt

SEQ ID NO: 1476 - DNA, 586 bp, Bruguiera gymnorhiza
  misc_feature (6)..(6): n is a, c, g, or t
  misc_feature (8)..(8): n is a, c, g, or t
aaatgngngtttccacctgcacattacgcgagccttaatcaggaatagcgaagtcgttgatgccaccagcagcagcagcttcattgtttcctagacaagcttcactttcgttggcggagaactaaggatggatcctcaaccagagcctgtgagctacatctgtggagattgtggaatggagaacactttgaagcccggggatgtcattcaatgccgtgaatgcggttaccgtattctctacaagaagcgcacccgccgaattgttcagtacgaggcacgctgagagaaagatggattggtggattcttaatatacgctggagcttgtttatggttttctagtttcttaaggggtggaatgcatcattggaagtttgctgccattatatgcctgttgaattacttccaacaatgttgaataatgcaagtgtgtgacgattagtgatcaaacttttgcactgctggatgttaacgttggacaattaaaggatctaagctgccagtttccctctttggtgtttgctatgtcgatagtacatacctatctggacgttgagccatgtaaaattttgaccctctatctttgg

SEQ ID NO: 1477 - DNA, 660 bp, Ricinus communis
gacttggattatgtgttactatctctacttttgtgcgagtgtaactgtaaatccaagagttttggggattaataagtaatcatatttatgtttaaggactagtttaaactgcaattacttgcatgccacttttatttttgacccccagaaagttctagaaatcaatatttattcccttcatagtttagaccttttctttgtttcatcatcatcaacaacccaaaaagaagaagcagcaaaaaccctagactctgaatcatggatcctcaacccgaaccagtcagctacatctgtggagattgtggaatggaaaacactttgaagcaaggagatgtgatccagtgcagagagtgtggttaccgtattctttacaagaagcgaacccgcagaattgttcagtatgaggcacgctaagagcagagcaaggatgcatatctggcacatgtgagcatggcattgaagctgtctgaaatagcaagcaaatgggtgtggtttctatgtagtttctgaagcagaaacgatagtaagaccatatataggactggtttagtatagttctttaaaactaatcacatcattgttcgatggtgcaagtctgtttgtgacatctttgaacagttaatggattaaaacctataaacatgtggttgtagtgtttaa

SEQ ID NO: 1478 - DNA, 468 bp, Cichorium intybus
cggcggggacacaaaccctcctcgcgaaaccctagttttcgtcagtcagcgattatcatttacaaacccgggcgatcacagtaatcgatggatcccccgccagaaccagttacttacatatgtggaggttgtggacaggagaatacgttgaaggtcggtgatgtgattcagtgccgggaatgcggttaccgtatcctctacaagaagcgtactcgccgaattgttcagtatgaaactcgttgaagaggactttatgatggattgcgtggatattttcagcacaattaagtgaaaatgtaacaaacattgattaacagtgtgtgaattttgggtctaatggtatcatcatgtttgtgtttttgatgttgaatgcccagtgatttcatcctgttttccagtgaaatgttttgaaatatactattatgtgtctcaagttatcagcaaatgttttgaataaatttttacatc

SEQ ID NO: 1479 - DNA, 666 bp, Citrus sinensis
gggggacccgccacaagttcaataaaaggaagattcatcgtgcgctaaatccctagaaagttgtttctttgactttgtttgggaatctcttgaacctcgaaaccgcaatggatcctcagccagagccagtcagctacatctgtggagattgtggaatggagaacacgcttaagccaggtgacgtcatccagtgccgtgaatgcggttaccgtatcttgtacaagaagcgcacccgccgaattgttcaatatgaggcacgttaatggggagatgtgggtggagagccaatgcctatgaagcataaccagctgtcttgcaaactgccagtttcgttgtagcttctcagcagttttcactgtggtttgtgtggtgatttgtagaatagctgtaatgaacattccatgatgcaagtatgttgtgtctcgggcacatattgtttctaaaacttaattgaaattagatataaactgcaaaaatagaaagcttgttgtgttatagtcgccatagacaaatatatgctaactcgtatggggtttgattttctggtgcggtgtcactcctctcaattcacgaaatcatggaatagagtttgtcatcatacaataatggttaaagatgttaataaaaaaacatgccaaagatataatcaaggggatcttttgtcaa

SEQ ID NO: 1480 - DNA, 485 bp, Glycyrrhiza uralensis
gctggggttctacagtttcggtcttctgatacctagaagaagaagaagaaagctagaaccgtcttccgtcaccgttcgccggaaccggtcatggatcctcagcctgagcccgtcagttacatctgcggagattgtgggatggagaataccctgaaaccgggtgatgttatacagtgccgtgagtgcggttaccgaatcctttacaagaagcgcactcgtcgcattgtccagtacgaggcacgttgaagaaaattgatgcgggattggcaaaagttattttctttaatcatcattaacatgtactaaaattgttcatgcaccttccaccttgtgctttgttatgtgttgtctacaagattgaagaactacttttagtactgggatgatctgactaattacaccgtattttgctggtattgtgaaaaggaaaacaacttttaaaatgtgaatttaatatgaatttgaattcatgttcaatagtttgc

SEQ ID NO: 1481 - DNA, 573 bp, Glycyrrhiza uralensis
gagcccaatgattgcataaaagcttgaattggtgtgcagttgtgtcctgtgatacctagaagaagaaagctagaaacttgttccgatcatggatcctcagcctgagcctgtcagctacatatgcggagattgtgggatggagaataccctgaagccaggtgacgttatacagtgccgtgagtgcggttaccgaatcctttacaagaagcgcactcgtcgtattgtccagtacgaggcacgttgaagaaaattgctgcggcattggcaagtgatttccgtgaatcgtcattaacatgtactaaaattgttcatgcaccttccactttgtgattggttatgtgatgtgatgtctacaaaattgaagaactatttttagtactggaatgttgcattttgctggtattgtgaaaaggaaaagactttccaaatatgtgaatgtatttgttcaatagtttgcgacttttcatcacttttatagttaaaagaattaacagttccaactgttaaaagggattgatgctcaaaatggaccaattaaatagcatgcatgattgtagtttgcgcacccaaagc

SEQ ID NO: 1482 - DNA, 396 bp, Liriodendron tulipifera
agaaccccaacttcttgtctattgatcaatggatccgcagcctgaaccagtgagctacatctgtggagattgtggaacggagaacacattgaagcctggtgatgtgattcaatgtcgtgaatgtggttaccgcatcttgtacaaaaagcgcactcgccgaattgttcaatacgaagcacgctgaagacaactctgggaaggatgacggcatcaaaagacccaccaactctgttactatcaagcattcatgagtgacttggcttcttatgaagtattaggtaagttggactcttggtatagaaaatgtgattagtcattgtcagtaaaaaccttgatttatactctatcgacagtaaattctatagttttgcatatgaagattgtgctattttctcc

SEQ ID NO: 1483 - DNA, 578 bp, Lotus japonicus
ggattctctcatcgcggtggtgcagctctacaacctccaagtctcgaaccttcttccgtcgttcgccgttcgccgtaaccgccatggaccctcaaccggagccagttagctacatctgcggagattgtggaatggagaatacgctgaagcctggtgatgttatacagtgccgtgagtgcggttaccgtatcctttacaagaagcgcactcgtcgcattgtccagtacgaagctcgctgaagaaagctgctgcagtttaagcacgtgatgtcctgaatcatcgtaaacatgtactggaattgttggagcaccttctaccttgtgcttgattatctgatatctactaaattgaggaactgtgaaaagaactttgaaatatgtgaatgtattacaaatatgcaagttcattagtttgaaactttgcattgcttttatggttaaagaaattattaggttcagttattataagtattgatgctcaaaatgggtcaactaattaggaatatagtttgcgcaaccaaacctcattgtggtttcttccacaaattcatacatttgataaaattgtcttggattgcg

SEQ ID NO: 1484 - DNA, 718 bp, Medicago truncatula
ggggattcagccgtaaacagagaaccttctctttcattacaatcgtcttcgactctcatcaatcaattaccaattcctagtgatggatcctctgcctgagcctgtgagttacctctgtggtgattgtggagtcgagaataccttgaagtctggcgacgttattcagtgccgtgactgtggttacagaatcctttacaagaagcgcactcgtcgcattgtccagtatgaagcacgttaagaagattatgaggaccatggcaagtagtcactgtgaatcatctttaaaacataaaaattatctggtgtgtacaaatcttaagaatagttttaagtaatgggatgatcttgcttatttcaccctattgtattttggtggtattgtggaaatgaaatcctaaaacttgagtatgaaaaaaaaaacctcgtgccgaaatcattcattcagactctcataaacatatacagacacattgctactccagcttttgccttgcctccttccttcacagcctgtcaaacctaaattattacctcaacaacatgattaatattccagtttttatataaaaaattgttcacctggttgctttgttgatgtttcaaacctaaagaatatgaactgccaagtgtcttcatgctgtctatgacctatctccaaattcttcagtacttggattcatccgtccttttatttttattttttccaaccatgattcaa

SEQ ID NO: 1485 - DNA, 486 bp, Populus trichocarpa
aatatgaaataaaactcaaacgcgcacgccaggtcgttaaattgtcaaaccaaaaaaaagagaaaccctaaaaccctctctgctgagctatggatcctcaaccagaacctgtcagctacatctgtggagattgtggaatggagaatactttaaagccaggagatgttattcagtgcagagagtgcggttaccgtattctttacaagaagcgtactcgtagaattgtgcaatatgaggcacgctgagggatggatggggatgtgcattttgtgcctgaatcagcatcgaggcatggttggcgtattggatgtgttatgtctgccttttagtttcatgagaccaccagcagtatagctgatttagtattggaatcatatgaaccgtatatactgtgaagtgtttctgttagaccttgcaacttgttaatggatgaagattaaaagtttgtgcttgtgacattctgatacaatgaaaggttgttaatta

SEQ ID NO: 1486 - DNA, 484 bp, Populus trichocarpa
aattgaaataaaactcaaacgcgcacgccaggtcgttaaattgtcaaacaaaaaaaagagaaaccctaaaaccctctctgctgagctatggatcctcaaccagaacctgtcagctacatctgtggagattgtggaatggagaatactttaaagccaggagatgttattcagtgcagagagtgcggttaccgtattctttacaagaagcgtactcgtcgaattgtgcaatatgaggcacgctgagggatggatggggatgtgcattttgcgcctgaatcagcatcgaggcatggttggcgtattggatgtgttatgtctgccttttagtttcatgagaccaccagcagtatagctgatttagtattggaatcatatgaaccatatatactgtgaagtgtttctattagaccttgcaacttgttaatggatgaagattaaaagtttgtgcttgtgacattctgatacaatgaaaggttgttaatta

SEQ ID NO: 1487 - DNA, 247 bp, Glycine max
attgtgcctccgaagcgaaacctaaagcctagaaccttcttccgtctcacagtttgccggaatcaccgatggatcctcagcctgagccggtcagctacatctgcggagattgtggcatggagaatacgctgaagcctggtgacgttatacagtgccgtgagtgcggttaccgtatcctttacaagaagcgcactcgtcgcattgtccaatacgaggcccgctgaagaaaactgctgtggcattggca

SEQ ID NO: 1488 - DNA, 394 bp, Glycine max
tcttcgttgagcagaaagctaaaggctaaagcctagaaccttcttcctttacacctcgctggaaccagcgatggatcctcagcctgagccagtcagctacatatgcggagattgtggaatggagaatacgctgaagcccggtgacgttatacagtgccgtgagtgcggttaccgtattctttacaagaagcgcactcgtcgcattgtccagtacgaggcacgctgaagaaaactgctataacgtttgcaagtaatttccatgaagaaattgttactacatctgtgttgtgtgatattgaagaactacttttaattctacagtagattgctttttgggtgatgtttagcaaaagataaaaactttgaatgtgaatatattacaaacatccgtgtt

SEQ ID NO: 1489 - DNA, 489 bp, Juglans hindsii x Juglans regia
tcggccggggacgcaatttcagagttgcaccaaatactgaaaaccctaaaaagctgtctttttcttggaatatctccggatcttcgacttgatggatcctcaacctgaaccggtgagctacatctgcggagactgtgggatggagaacactctgaagccaggtgatgtgatacagtgccgagagtgtggttaccgcatcttgtacaagaagcgcacccgccgtattgttcaatatgaggctcgctgaattgggggaggcaaggacatgcagttgttcaaggacatgcatatacatatatgtagttactgttactgtcttcctgcaacttgctaatctggtggatggtttacttttcaagaaacagattgatttatgctttagcacactatgcgatcgataaaaaacacctgtgctgtctatgcaagtgatcacattaaagtagaacactgcaaatcaatctgattgctctgcatgtttgatttcctaca

SEQ ID NO: 1490 - DNA, 376 bp, Medicago truncatula
attcagccgtaaacagagaaccctctctttcgttacaattcatcaattaccaattcctagtgatggatcctctgcctgagcctgtgagttacctctgtggtgactgtggagtggagaatacactgaagtcaggcgatgttattcagtgccgggattgtggttacagaatcctttacaagaagcgtacccgtcgcattgtccagtatgaagctcgttaagaagattatgaggaccatgacaagtagtcattgtgaatcattttaaaacaaagaatttggtgtgtacaaaacttaaagagtagttttaagtaatgggatgatctttcttattgtattttgatggtattgtggaaatgaaatcctaaaacttgagtatg

SEQ ID NO: 1491 - DNA, 605 bp, Cryptomeria japonica
ggctcgaaaatacgaagagagataaagggacggggggttttatcagaggtgcaagggcaggggagaaaagcagtttagcaatcccaactttcggaactgcagaagatatttaacaggtttttggtaccatggatgggcctgcgatgcctgaacctgttggttacctttgtggagactgtggagctgagaatacactgaaacctggtgatgtaatccagtgcagagaatgtggctatcgtatactgtacaagaaacgcacaaggaggattgttcaatatgaagctcgctgaattgattccattcgatctggatcatttcgggatgatttggatcatgtttgatcttgaggataaaattatgaatgcaaaataattcttattatgcaacataaaacttcgtacagaggctcggtatcaagcctcaatcttgagtttgggggtatttggaagcacattgttatgtttgaatcagtttctaatgatgttcgtctcatcgactttgaggaattttactggtgggtagacaatacataagtaatatcatatagagcttcagaaactttatgatactataaagaaacctttcatggccctctttttctaagc

SEQ ID NO: 1492 - DNA, 619 bp, Triticum aestivum
  misc_feature (540)..(540): n is a, c, g, or t
  misc_feature (583)..(583): n is a, c, g, or t
tactcgcatagccttcttcccaccgagcagcccctcacgaaccctagcttgctataaaccctactccttcccttccccgatggatccgcaacagccggagcctgtcagctatctgtgcggagattgcggagctgagaacacactcaagacaggggatgtgatccagtgccgtgaatgtggttaccgcatcctgtacaagaagcgcacccgtcggattgttcaatatgaagctcgctgaagacaaggaacaaacatcattcactgttaagtgtgtgccctgagacaaagctactacaatggagaaatgtattaggcagtactcgctcgtaggtagtaatctttccattggactttggcttgaagtggtaaaaacttgtcaaacgtgtattgagattttagacatttgaggattgagattatgcatctttaaagctggattttaaaaaatggttattattgctgtcgccaggaataaagtgccctgttggttgcacgcaggctctggctgttatttgctgcctgtatcgttattactacctntgtaactattttaagacgtttttgtagttcaaattgaaatgtnaaaatgtcttatatttagttacgaaggtagtacctt

SEQ ID NO: 1493 - DNA, 454 bp, Triticum aestivum
  misc_feature (449)..(449): n is a, c, g, or t
gaaacctccaaacacctacctctctacgaactacctgccgccggaaaaccctagagcgctcggccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatgggtcctaagtggcgaatctaanaaaaa

SEQ ID NO: 1494 - DNA, 526 bp, Triticum aestivum
cacgaaccctaacttttctaaaccctaattccagcctgtcatccccttcgcgacactctaccgctctcccgatggatccgcagcagccggagcccgtcagctatctatgcggagattgcggagctgagaacacgctgaagacaggggatgtgatccagtgccgtgagtgtggctaccgcatcctctacaagaagcgcacccgcaggattgttcaatacgaagctcgctgaagacagaagaacaaacatcattcactgttggtaggtgcctcgattgatgtggagtgtgccctgagacaaagctacaatggagaaatgtattatatacagtacttttaggtcttatttgtccgttggactttggcttgaagtggtaaaacttgttgtaaccgtattgagattttagacatttgagaatccagattatgcatcccaaaagctggatgtcgaaaaatggttattattgctattgccagcaataaaatgctctgttggttggttgcggcctcttgctcttaaaaaaaaaa

SEQ ID NO: 1495 - DNA, 770 bp, Hordeum vulgare
gagtttgagtgtttgtgctttattcactctccccccccccttggagatcataaaatacacctttctttcccaacgggcatgaaagcggtcaaccgggcctttggggaaatttcctcccccccctttagctcgtgcctcattctgcacgagcggacttgccggcgaatcacgaatcccgtcccaagttcactactcgcgtcgcataggcttctgcccgccgagcagcccctcacgaaccctagcttgctaaaccctactccttcccttcaccgatggatccgcagcagccggagcctgtcagctatctgtgcggagattgcggagctgagaacacactcaagacaggggatgtgatccagtgccgtgaatgtggttaccgcattctgtacaagaagcgcactcgtcggattgttcaatatgaagctcgctgaagacaaaggaagaaacttcattcactgttaagtgtgtgccctgagacaaagctactacaatggagaaatgtactagacagtactcacgcgcaggtgtccattggactttggcttgaagtggtaaaaacttgtcaaacatgtattgagattttagacatttgaggattgagattatgcatctttggaagctggatttcaaagatggttattattgctgtctccagcaataaagtgccctgttgattggactcagacttttgctgttatttggtgctcgtatgattgttaccttaataattcttgtgttatgttctttagtttttctaaactgagcttcgt

SEQ ID NO: 1496 - DNA, 640 bp, Hordeum vulgare
gtaagcattgccttccctatttcaccccgtgcgcggagccgctcctgacgagcgctggctacagccccttcgcgacactctaccgccctcctcgatggatccgcagcagccggagcccgtcagctatctatgcggagattgcggagctgagaacacgctcaagacaggggatgtgatccagtgccgcgagtgtgggtaccgcatcctctacaagaagcgcacccgcaggattgttcaatacgaagctcgctgaagacaaaggaacaagcatcattcgccgttagttcatgtctggagcgatgggagtgtgtgccctgagacaaagctacaatggagaaatgtattatatattacagtgcttgtaggttgtatttgtccgttggactttggcttgaagtggtaaaactttttgtaaccgtattgagatttcagacatcaggtaatcgagatgatgcatcctgaaagctggatatcgaaaaattgttattattgctattgcaggcaataaaatgacctgttggttggtcgcaagctcttgctgttattttctgcctgtattgatattttccttaattctcgtgctgtgttctttaaactgagctttgtaatgttttgtgggattaagaatttccattacgtc

SEQ ID NO: 1497 - DNA, 455 bp, Solanum melongena
attgttgacccttcaaggttttcgtctctctgctgctattagttgatattatcaatggattctcaacctgttgaacctgtcagctacatctgcggagattgtggacaggagaataccctaaagcctggtgatgtgatacagtgtcgtgagtgtggatatcgtattctctacaagaagaggactcgcagaatcgtgcagtatgaagctcggtgatgcttaacagtcaactggaaacaaccgcaagtgctctgctcgtatggaagtagctactgttgaatatcacgcgtttcagcgtggccattgtatgttttttcctttctgcgtgtgatttcttcctgggacatgttgctagtctatatagcagagttcaacttaaactcagtgtggttgaatattgtagagacactattgtggaaaatctgtttatgtcaaagaaatttctttcttgaacttat

SEQ ID NO: 1498 - DNA, 643 bp, Pennisetum glaucum
tgtggtgtggtgctggggaacggaggggaccaggtcgtggttgtgacgttttctcgtcgctcccgttccgtccgtgcacggcgacggctgctggcaacgacaaaccctcctcccctccgttccccagcaccacaccacccgccgccggaaaaccctagatcgcccgacccatggacccgcagcagccggagcccgtcagctacctctgcggagattgcggagctgagaacacgctgaagccaggtgacgtcattcagtgccgtgagtgtggctaccgcatcctctacaagaagcgtacccgccgcattgtccaatacgaagcgcgctgaagacaaggaagactacaatgcttttagtcttccctctacctacgcaacgagcttcctgagggaaatgaaaatgtaatacacaaacacaatgtttgaatatggtgtgcgtccattggacaatgtttgagatgttgcactaatacgattggtatgggtgttgaatcgaaaaacttggtagcatgctatagtttgatctactggtgccgatgtgcagaggttttttatgtttattacatggccgtatcgttgctaatgaccaacgttgagctactgttcatccaatcattcagctagaactgacgaaagcttggtgc

SEQ ID NO: 1499 - DNA, 788 bp, Zea mays
gcaggccgcgttccggccttccgggccactacttatccctcgtgttccgttctgacacggcgccgactgggactgagaagaaacctccaaacacctacctctctacgaactacctgccgccggaaaaccctagagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatggatcctaagtggcgaatctaatgcatgcgtgttatgccagcgttattttttgttacttgtttgcctccaatggtacggctggagggttgcttgcgtccatagttacgccgtcgttcatccattcattcagaagtgatgaaaactgtgacggactgacggggtgtgattcggttgtatgcttgtattgctagattactttttttttgcctgtacattgacaacacatttgccgttcataaccagtcacggcgaaactttgggttcgttcgaaatcgcatttta

SEQ ID NO: 1500 - DNA, 773 bp, Zea mays
cgcgttccggccttccgggccactacttatccctcgtgttccgttctgacacggcgccgactgggactgagaagaaacctccaaacacctacctctctacgaactacctgccgccggaaaaccctagagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatggatcctaagtggcgaatctaatgcatgcgtgttatgccagcgttattttttgttacttgtttgcctccaatggtaaggctggagtgttgcttgcgtccttagttacgccgtcgttcatccattcattcagaagtgatgaaaactgtgacggactggcggggtgtgattcggttgtatgcttgtattgctagattactttttttttcctgtacattgacaacacatttgccgttcataaccagtcacggcgaaactttgggttcgttcgaaatc

SEQ ID NO: 1501 - DNA, 539 bp, Nuphar advena
  misc_feature (381)..(381): n is a, c, g, or t
  misc_feature (386)..(386): n is a, c, g, or t
gacaagaagaagaagaagaagaagggatcagccctttctttctcggtgtcctctcactggtaaggaatagtcggaaaggagatggacccacagcagcctgaaccagtgagctacatatgtggagattgtggggctgagaatacattgaagcccggggatgtgattcagtgtcgagaatgtgggtaccgcatcttgtacaagaagcgcacacgccggattgttcaatatgaggcacgctaaagatcggacagaagatcagtatatcagtgtgaacgtaatatgcgtctaagtgttttttgagtccttagagattgttgtatatgcgataggtatagtgtgtacaagagaccctatgaaggattgttaggctatcgggaaggntttgnacaaattgcttgtgtgctggctgatttgagcagtggcatctggtctcggtgatagtgtgaaatggaaaatttgcagtaaaggtcgtttcttttttattaacctgctcataatgggggactagttgctgtttgccaaatattgacagacatttc

SEQ ID NO: 1502 - DNA, 443 bp, Capsicum annuum
ctcagctacatacagttgaattgtcaatggattctcaaccagttgaaccagtcagctacatctgtggagattgtggacaggagaatacgctaaagccaggagatgtgatacagtgtcgtgaatgtggataccgtattctctacaagaagcgcactcgcagaatcgtgcagtatgaagctcggtgatgcttgaagccatttggaaaaacagcatgtgcttgctcgtatggaagtagatgttaaaaaacgtaatagctactgttaaaaatcacgcgtctcagcgtggctattgtgtgtttttacctttttacgtctgattgcatcgtgggtgcatgttgttagtctaatttggcaaattcaacacaaactcagcgtggttgaatattgtagaaatggtttaaaagacgatgtcttgttgtggtctcttgtggaaaatctgttaag

SEQ ID NO: 1503 - DNA, 449 bp, Solanum tuberosum
gttgatcatcaatggattctcaacctgttgaaccagtcagctacatctgcggagattgtggacaggagaataccctaaagcctggtgatgtgatacagtgccgtgaatgtggttatcgtattctttacaagaagaggactcgcagaatcgtgcagtatgaagctcgttgattcttgaagtcatttggaaaaaaacagcaagtactctgctcttatggaagtagatattaaaaacgtaatagctaccgttaaaaatcatgcgtttcagcgtggccattgtgtgtttttacgtttctgcgtgtgatttcttcatggcatcatgttgttaagtctatatagcaacttcgacttgaactcagcgtggttgaatattgtagaaattccttaaaaactatgtcttgtgatctattactgtggaaaatctatttcaagttcgagtcttgagatact

SEQ ID NO: 1504 - DNA, 446 bp, Solanum tuberosum
cgtctctgcttacagttgatcatcaatggattctcaacctgttgaaccagtcagctacatctgcggagattgtggacaggagaataccctaaagcctggtgatgtgatacagtgccgtgaatgtggttatcgtattctttacaagaagaggactcgcagaatcgtgcagtatgaagctcgttgattcttgaagtcatttggaaaaaaacagcaagtactctgctcttatggaagtagatattaaaaacgtaatagctaccgttaaaactcatgcatttcagcgtggccattgtgtgtttttacgtttctgcgtgtgatttcttcatggcatcatgttgttagtctatatggcaacttcgacttgaacccagtgtgattgaatattgtagaaattccttacaaacatagtcttgtggtctattatcgtggaaaatctgtttcaagtt

SEQ ID NO: 1505 - DNA, 580 bp, Oryza sativa
accaccaccaacctcgtctcgcttgacaagagtcgtcgtcgtcgtcgaaaccctagccgcgcgcgccgccgcctcctctcccgcccggcgcctgcagccgtcgtcttgcctcgcgccgcctccggccgaccgccgcgctccaccagcgccgctgcgtccgatggatccgcaacaacctgagcccgtcagctatctctgtggagattgcggagctgagaacacactgaagccaggagatgtgatccagtgccgtgaatgtggctatcgcatcctctacaagaagcgtacccgccggattgttcaatatgaagcacgctgaagataagggaaggcatcagtctttctaaagcaatgtaatgagtgacccctcaaaagtatgttagtggaactgtatggtattcagttgtaggcccgtatggccattggactttcgatagaagtggttaaatccgagctgtgttttgagatttgagaaatttaaggtgatgccacgcttatattgcctgagatcttgaaatcaaatgcatagttttattgcagttgccaacgagcagcaacgtgctgcctcaattggttattg

SEQ ID NO: 1506 - DNA, 557 bp, Solanum phureja
ccctttcaagtttttcgtctctgcttacagttgatcatcaatggattctcaacctgttgaaccagtcagctacatctgcggagattgtggacaggagaataccctaaagcctggtgatgtgatacagtgccgtgaatgtggttatcgtatcctttacaagaagaggactcgcagaatcgtgcagtatgaagctcgttgattcgtgaagtcatttggaaaaaaacagcaagtactctgctctcatggaagtagatattaaaaacgtaatagctactgttaaaaatcatgcgtttcagcgtggccattgtgtgtttttacctttatgcgtgtgatgtcttcatggcttcatgttgttaagtctatatggcaacttcgacttgaactcagcgtggttgaatagtgtagaaattccttaaaaactatgtttcaagttcgagtcttgagatactatgttttttcctttctttcttgaactttgagctattaatcaaacaacatcatataaaatgaaacggaggaagtaatatttattacacaacatcaaatcttgaaaacat

SEQ ID NO: 1507 - DNA, 734 bp, Sorghum bicolor
gttgcgggctactactacttgttgccgctcgcggtccgttccgcacacggcgacgactggggactgggaagaaaccgctacctcgccccctccaccagccgccggaaaccctagagcgcccgacacccatggatccgcagcagccggagcccgtcagctacctctgcggagattgtggagctgagaacaccctgaagcccggagatgtcatccagtgccgtgagtgtggctaccgcatcctctacaagaagcgcacccgccggattgtccaatatgaagcgcgctgaagagtgaagacaagggaaaacactaaagatggttgatctattactcgccactgtgtacctatgtaaagagtcttgtgatggaaatgaaaatgtcagacataatgtttgaaatgtcgtatgcctcctttggacttgagctttagtctgtaacgcttgaactggggactgatttgagaattgagatactgcagtaatatgttgatgggtcgtggcgaatctaatgcatgcgtgttatgcctgcgttatttattgaccatttgtttccatgctatgatccaaaaatcatgggtgttcagcagaggtatatctttttatacggctggaatattgcttgtgtccttgtgccgtcgatcatccattcattcagaactgatgaaaactatgtgacaaggctcaaaactgatgaaacttgattcacagttgtatcttgtatgcttgtattgttac

SEQ ID NO: 1508 - DNA, 532 bp, Sorghum bicolor
atctctctccgctgctgctccgtcgccaatccctccttcccttccacaagaaagacaaaccctagtccctagctcgcgcggctcgccggacggatggaccctcagcagccggaacccgtcagctacctgtgcggagattgtggagctgagaacacgctgaagccgggagatgttatccagtgccgggagtgcggctaccgcatcctctacaagaagcggacccgccgaattgttcagtatgaggcacgctgaagacaagggagcaacatgctatatgctgtgtaaggtgttggttgtgcctctagcagtgtaacaagtgtcttgggagaatgactcctgggaaatagaattacaattactatgtgtgtaaccaaccgtgcattgaacttggtctgaaagtgctgaaacgttcgagattttcagagacttgtgttgaagctacatgattgatacgttttgacctctggcaggtcaggtccgaattttctacgcttgcactactgttaatctgctggcctttgccatacagcag

SEQ ID NO: 1509 - DNA, 610 bp, Saccharum officinarum
cttgccgctcgtgtgccgttccgcacacggcgacggctgggaagaaacccccaaacccccctctgctacctctcctccacggaccacctgccgccggaaaccctagagcgcccgacccatggatccgcagcagccggagcccgtcagctacctctgcggagattgcggagctgagaacaccctgaagcccggagatgtcatccagtgccgtgagtgtggctaccgcatcctctacaagaagcgcacccgccggattgtccaatatgaagcgcgctgaagagtgaagacaagggaaaacactgaagatggttgatctattactcgccactttattacctatgtaaagagtcttgtgtgggaaatgaaaatgtcatacataatgtttgaatggcgtgtgcctcctttggacttgagctttaatctgtaatgcttgaactggggactgatttgagaatggagatgctgcagtaatatgttgatgggtcctaaaatgaaaaaaagcctattgaagagaaacaaatgagaaaaggggcggccagtctaaaagatccaagcgggggggcgcgtgcaagggaaccaagcttaccttcccggggttgcgcaaatataa

SEQ ID NO: 1510 - DNA, 640 bp, Saccharum officinarum
  misc_feature (241)..(241): n is a, c, g, or t
cttgccgctcgtgtgccgttccgcacacggcgacggctgggaagaaacccccaaacccccctctgctacctctcctccacggaccacctgccgccggaaaccctagagcgcccgacccatggatccgcagcagccggagcccgtcagctacctctgcggagattgcggagctgagaacaccctgaagcccggagatgtcatccagtgccgtgagtgtggctaccgcatcctctacaagaancgcacccgccggattgtccaatatgaagcgcgctgaagagtgaagacaagggaaaacactgaagatggttgatctattactcgccactttattacctatgtaaagagtcttgtgtgggaaatgaaaatgtcatacataatgtttgaatggcgtgtgcctcctttggacttgagctttaatctgtaatgcttgaactggggactgatttgagaatggagatgctgcagtaatatgttgatgggtcctaaaatgaaaaaaagcctattgaagagaaacaaatgagaaaaggggcggccagtctaaaagatccaagcgggggggcgcgtgcaagggaaccaagcttaccttcccggggttgcgcaaatataatttttttttaggggcccctaaaatgaaatg

SEQ ID NO: 1511 - DNA, 682 bp, Saccharum officinarum
taggaaagagctgctgcttcgtctgatccctccttccacacgaaagacaaaccctagtccctagctcgcggctcgcggatggaccctcagcagccggaacccgtcagctacctatgcggagattgcggagctgagaacacgctgaagccgggagatgtgatccagtgccgggagtgcggctaccgcatcctctacaagaagcggacccgccgaattgtgcagtatgaggcacgctgaagacaagagaacaacgtgctatgctgtgtaaggtgttggttgtgcctctagcagtgtaacaagtctcttgggagaatgactcctgggaatcacaactacaattacaatgtgtgtaaccgtgcactgaacttcgtctgaaagtgttgatgaaacgttgggaactgtcggtagatttcagagacttgtgttgaagttacatgattgatacgtttttgacttgtggctaaggctggacgaaaaactcaaagctcgctagctcgcgagccatagttttaggaaaaaaagtcatcataacttatattatgtttgtattacttcatgtctggcaccctgcaaatggttgatatgctagctcatacgaatattttattcaatttaaggctatgggatatattatttttggattattactatttttaagcttttgataaatacaaatattaaa

SEQ ID NO: 1512 - DNA, 723 bp, Saccharum officinarum
  misc_feature (597)..(597): n is a, c, g, or t
  misc_feature (658)..(658): n is a, c, g, or t
  misc_feature (675)..(675): n is a, c, g, or t
tagtgtctagtgtacgcctgctgtcccggtccgggattgacggatgcatccacgcgtctgatccctccttccacacgaaagacaaaccctagtccctagctcgcggctcgcggatggaccctcagcagccggaacccgtcagctacctatgcggagattgcggagctgagaacacgctgaagccgggagatgtgatccagtgccgggagtgcggctaccgcatcctctacaagaagcggacccgccgaattgtgcagtatgaggcacgctgaagacaagagaacaacgtgctatgctgtgtaaggtgttggttgtgcctctagcagtgtaacaagtctcttgggagaatgactcctgggaatcacaactacaattacaatgtgtgtaaccgtgcactgaacttcgtctgaaagtgttgatgaaacgttgggaactgtcggtagatttcagagacttgtgttgaagttacatgattgatacgtttttgacttgtggctaaggctggacgaaaaactcaaagctcgctagctcgcgagccatagttttaggaaaaaaagtcatcataacttatattatgtttgtattacttcatgtctngcaccctgcaaatggttgatatgctagctcatacgaatattttattcaatttaaggctatnggatatattatttttgnattattactatttttaagcttttgataaatacaaatattaaattttgt

SEQ ID NO: 1513 - DNA, 552 bp, Panicum virgatum
ggccgtgtgcgcggtgcgacggctgggacagggaagaaaccacccaaaccctcctcttctccccttctccgcgcgtcacctgccaccggaaaccctagatctgccccgacccatggatccgcagcagccggagcccgtcagctacctctgcggagattgcggagctgagaacaccctgaagccaggagatgtcatccagtgccgtgaatgtggctaccgcatcctctacaagaagcggacccgccgcattgtccaatatgaagcgcgctgaagacaaggagaaaacacaatgctgttagtcgtccctctaccaatgtaatgagcttcctggggaaaatggaaatgtaagactgcaatttttgcatgctgtgtgtggccattgtactagagagatattgcagtaatatgattggtgatgggccttgactcttgagtggtgcagatcgattagcatgcgtcatacctgtattattcacgggcattcgccccccatgatctaaaactgatggaaactttgttgtcggcgtagacatgcatttgccattcacaacc

SEQ ID NO: 1514 - DNA, 474 bp, Panicum virgatum
gctccgtgctccttccccagagagagagagcgaaaccctagctcgcggctcgccggatggaccctcagcagccggaaccggtcagctacctctgcggagattgtggagccgagaacacgctgaagccgggcgatgtgatccagtgccgcgagtgcggctaccgcatcctctacaagaagcggacccgccgaattgtccaatatgaagcgcgctgaagaaaagggggcaacatcctgtgctgttggcggtgcctcaagcagtgtaacaggccgcctgggagaaggaatgactagtggtgattcgtatggtaactcgtgtgtactaggttgtaaccgtgcactggactgcacctggaagcgttgaaacactctgaaatatggatggatgtcagacacttcacaagtattgaaatagcttatgatttgctgggaacctaaatacccaataagatgggggggtcgtttgcgtcttgct

SEQ ID NO: 1515 - DNA, 516 bp, Panicum virgatum
ccgcgggcccctctcaaaaaaaaaaatctctctccccgcaggctgctgctccgtgctccctccccagagagagagaaaccctagctcgcggctcgccggatggatcctcagcagccggaaccggtcagctacctctgcggagattgtggagccgagaacacgctgaagccgggtgatgtgatccagtgccgcgagtgcggctaccgcatcctctacaagaagcggacccgccgaattgtccaatatgaagcgcgctgaagaaaagggagccatgttggttgtgcctcaagcagtgtaacaggccgcctgggggaatgaatgactcgtggtgattcgtatggtaactcgtgtgtactaggttgtaacggtgcactgtactgcacctggaagcgttgaaacactcggaaatgtggatgggtgtcagatataccctataagtattgaaatagtatgattgcttggaacctaataagtacctaataagtgggggtcttttgcgccttgctttgcgctgtt

SEQ ID NO: 1516 - DNA, 529 bp, Nicotiana tabacum
gctctcgctctgtttggtcttcatctctttctctgctaatagttgttaatattattaatggattctcaacctgttgagccagtcagctacatctgcggagattgtggacaggagaataccctaaagcccggtgatgtgatacagtgccgtgaatgtggttatcgtattctctacaagaaacgaacccgcagaattgtgcagtatgaagctcggtgatgcttgaaaccaattcagcgtcaatacgcaattgattaagaaaggcagcgagcccttttcctatggaagtacaaatttagcatgtaatagctattagctacggtgcttttctcgtgtggtcattttgtgttgttacctttcagcgtgggctttctttgtgggcgcattggcaagttcaatgtaaactcactgttgtgtcatgtggaaagctcaaatttaaaacaagatcttgtgcaacatttggtatattaaaaccttcgtaactttgtgtttccttgtgaatgtgaattttcattttatttgcatattggtt

SEQ ID NO: 1517 - DNA, 627 bp, Solanum lycopersicum
accgaatcacatacgaaaccctctatataaaccctataaacccaccaaaatccatcaattttttgccctaataatttcttcgtctctgctaattgttgatcatcaatggattctcaacctgttgaaccagtcagctacatctgtggagattgtggacaggagaatactctaaagcctggtgatgtgatacagtgtcgtgaatgtggttatcgtattctttacaagaagaggactcgcagaatcgtgcagtatgaagctcgttgattcttgaagtcatttggtaaaaacagcaagtgcctgctcttatggaagtagatattaaaaacgttagctaactactgttaaaaatcacgcgtttcagcgtggccattgtgtgtttttacctttctgcgtgtgatttcttcatgttgttagtctatatggcaacttcgacttgaactcagcgtgattgaaatattgtagaaattccttacatagtcttgtttcaagttcgagtctctgagatactatgttttttttccctctttcttgaactttgaagctagtaatcaaacaacatcatataaactgaaacggaggaagtagtattttattacacaacatcaaatgttggaaacattttggact

SEQ ID NO: 1518 - DNA, 571 bp, Solanum lycopersicum
atcggccgaattgcctaacaatttcttcgtctccgctaattgttgatcaccaatggattctcaacctgttgaaccagtcagctacatctgtggagattgtggacaggagaatactctaaagcctggtgatgtgatacagtgtcgtgaatgtggttatcgtattctttacaagaagaggactcgcagaatcgtgcagtatgaagctcgttgattcttgaagtcatttggtaaaaacagcaagtgcctgctcttatggaagtagatattaaaaacgttagctaactactgttaaaaatcacgcgtttcagcgtggccattgtgtgtttttacctttctgcgtgtgatttcttcatgttgttagtctatatggcaacttcgacttgaactcagcgtgattgaaatattgtagaaattccttacatagtcttgtttcaagttcgagtctctgagatactatgttttttttcctttcttgaactttgaagctagtaatcaaacaacatcatataaactgaaacggaggaagtagtattttattacacaacatcaaatgttggaaacattttggact

SEQ ID NO: 1519 - DNA, 593 bp, Triticum aestivum
ccacgcgtccgcaagcaaggtgctgatctaacggcccagagaggccagcccgttaagcgttgccttccctatttcaccccgctcgcggcgccgcccctcacgaaccctaacttttccaaaccctactccacccactttgcgacactctactggtctccccgatggatccacagcagccggaacccgtcagctatctgtgcggagattgcggagctgaaaacacgctgaagacaggggatgtgatccagtgccgtgagtgtggctaccgcatcctctacaagaagcgcacccgcaggattgttcaatacgaagctcgctgaagacaaaagaacaaacatcattcactgttggttcgtgcctcgatttgatggagtgtgtgcccgagacaaagctacaatggagaaatgtattatatacagtacttttaggtcttatttgtccgttggactttggcttgaagtggtaaaacttgtcgtaaccgtattgagactttagacgtttgagaatccagattatgcatcctgaaagctggatatcgaaaaatggttattattgctattgccagcaataaaatgctctgttggttggttgca

SEQ ID NO: 1520 - DNA, 513 bp, Triticum aestivum
cgcggcgccgcccctcacgaacctaacttttctaaaccctactccatcctctttgcgaccctctactggtctccccgatggatccacagcagccggaacccgtcagctatctgtgcggagattgcggagctgagaacacgctgaagacaggggatgtgatccagtgccgtgagtgtggctaccgcatcctctacaagaagcgcacccgcaggattgttcaatacgaagctcgctgaagacagaagaaaaaacatcattcactgttggttcgtgcctcgattgatgtggagtgtgccctgagacaaagctacaatggagaaatgtattatatacagtacttttaggtcttatttgtccgttggactttggcttgaagtggtaaaacttgttgtaactgtattgagattttagacgtttgagaatccagattatgcgtcctgaaagctggatatcgaaaaatggttactattgctattgccagcaataaaatgctctgttggttggttgcagcct

SEQ ID NO: 1521 - DNA, 463 bp, Triticum aestivum
  misc_feature (194)..(194): n is a, c, g, or t
  misc_feature (296)..(296): n is a, c, g, or t
cttcccaccgagcagcccctcacgaaccctagcttgctaaaccctactccttcccttccccgatggatccgcagcaaccggagcctgtcagctatctgtgcggagattgcggagctgagaacacactcaagacaggggatgtgatccagtgccgtgaatgtggttaccgcatcctgtacaagaagcgcacccgncggattgttcaatatgaagctcgctgaagacaagaaacaaatatcattcactgttaagtgtgtgccctgagacaaagctactacaatggagaaatgtattangcagtactcgctcctaggaatgaagtgccctgttggttgcacgcaggctctggctgttatttgctgcctttgtcgttattactacctgtgtaactattttaagacgtttttgtagttcaaattgaaatgtaaaaatgtcttatatttagttacgaaggtagtacctt

SEQ ID NO: 1522 - DNA, 466 bp, Solanum tuberosum
cgtctgtgcttacagttgatcatcaatggattctcaacctgttgaaccagtcagctacatctgcggagattgtggacaggagaataccctaaagcctggtgatgtgatacagtgccgtgaatgtggttatcgtattctttacaagaagaggactcgcagaatcgtgcagtatgaagctcgttgattcttgaagtcatttggaaaaaaacagcaagtactctgctcttatggaagtagatattaaaaacgtaatagctaccgttaaaaatcatgcgtttcagcgtggccattgtgtgtttttacgtttctgcgtgtgatttcttcatggcatcatgttgttagtctatatggcaacttcgacttgaactcagtgtgattgaatattgtagaaattccttaaaaactatgtcttgtgatctattactgtggaaaatctgtttcaagtttgaaaaaaaaaaaaaaaaaa

SEQ ID NO: 1523 - DNA, 409 bp, Ipomoea nil
gctttcaattctgctgccaaaacagaagcgacaatggatgctcaacccgaacccgtcagttatatctgtggagattgtggacaagataatactctgaagcaaggcgatgtgattcagtgccgtgaatgtggttatcgtattctctacaagaagcgaacccgcagaattgtgcaatatgaagctcgttgacacttaaggtttgggtgccaacaaactggaatgctgcattacctatagtctctatttcttaaggacacagtattagatattattaggtatgtaatggtgctatgtttgaaaaaactgcttcctgcttctctatgccttttgtttgcaactgtcgttatattgtgatttcttgaagtgatttgcaggcagcttgtttgctgcaatttggttaaaaaaaaaa

SEQ ID NO: 1524 - DNA, 494 bp, Quercus alba
cagttggggtcggcgaatagagacagagagaaaaacccgaaaagccctagaagatttcttgatggatcctccaccggaacaagtcaactacatctgcggagattgtgggatggagaacactctgaagccaggtgatgtgatacagtgccgagagtgcggttaccgcatcttgtacaagaagcgcactcgccgcattgttcaatatgaggcacgctgaagaagagaagtgaggagggaggcatgggcatgcagcagcaacaacaaagacaacaaagactatctgtattgggtccattttacaacttgttaatatggtggtttagtatgtagtcatagaagactaaattataagttgcactgtctaagtttgggatcattggatttgatcttctatgattaaatttatttttttggaccttaacgttatatagtacttagattccgatttgattccttccgtttatgccaaggttttaaattccgattcgttccaa

SEQ ID NO: 1525 - DNA, 536 bp, Quercus alba
atagcagtcgttcacttgaacatagacagagagagagacccgaaaagccctagaagatttcttcatcaacaccctgatggatcctccaccggaacaagtcaactacatctgcggagattgtgggatggagaacactctgaagccaggtgatgtgatacagtgccgagagtgcggttaccgcatcttgtacaagaagcgcactcgccgcattgttcaatatgaggcacgctgaagaagagaggtggggaggcaggggcatgcagcagcaaacaacaaagactatctgtattgggtccattttacaacttgttaatttggtgatttagtcatagaagactaaattataagttgcactgtctaagtttgggatcattggatttgatctctcatgattaaaaatttttatctggaccttaatgttatatagttacttagattccgatttgattacttttgtttatgccaaggttttaaattccgtttccttccaatgctcacgaactccagcagttccagtctctcaattccaaaaaaaa

SEQ ID NO: 1526 - DNA, 465 bp, Quercus alba
aatggggatatattgggtaaaacgaagacatagcagtcgtttacttgaatatagacagagagagagccgaaaagccctagaagatttcttcatcaacaccctgatggatcctccaccggaacaagtcaactacatctgcggagattgtgggatggagaacactctgaagccaggtgatgtgatacagtgccgagagtgcggttaccgcatcttgtacaagaagcgcactcgccgcattgttcaatatgaggcacgctgaagaagagaggtggggaggcagggacatgcagcagcaacaacaaagataacaaagactctgtattgggtccatttcacaacttgttaatttggtgatttagtatgtagtcatagaagactaaattataagttgcactgtctaagtttgggatcattggatttgatctcccatgattaaaattttttatctggaccttaatgttatat

SEQ ID NO: 1527 - DNA, 408 bp, Triphysaria pusilla
ccctagccccttccatcttcttctccaatcttcgattatcaatggatgcccagcctgaaccagtcagctacatctgtggagattgtggtcaagataacacactgaaaccaggggatgtgattcagtgccgtgaatgtggctatcgtattctctacaagaaacgtacccgcagaattgttcaatatgaagctcgttgaagcggttttctgaaggtccagatgttatcacgaggcatctctgctgtattataactgcaattatgaaatatttgagttctgattggcactaatctatattgtgatgaactttatttggtcgtttgtttaatatttgggaacttgttgaatggtttgatgcactgaaaagatttgggtataaattgttcttgaagatttcatcatattttct

SEQ ID NO: 1528 - DNA, 352 bp, Triphysaria pusilla
ttcttctctgcgctttgataatcaatggatgcccagcctgaaccagtcagctacatctgtggagattgtggtcaagataacacactgaaaccaggggatgtgattcagtgccgtgaatgtggctatcgtattctctacaagaaacgtacccgtcgaattgttcaatatgaagctcgttgaagcggttttctgaaggtccaaatgtcatcgagaggcgtctttgctgtattataaattggaattgtgaaatatttgagttctggttggcactaatctatgttgtgatgtacttttttcgtttgtttaatatttgggaacttgttgaaatttgatctatgaaacttgatttggg

SEQ ID NO: 1529 - DNA, 483 bp, Ocimum basilicum
  misc_feature (127)..(127): n is a, c, g, or t
  misc_feature (129)..(129): n is a, c, g, or t
  misc_feature (382)..(382): n is a, c, g, or t
  misc_feature (418)..(419): n is a, c, g, or t
  misc_feature (422)..(423): n is a, c, g, or t
gcacgaggacccactctgagctagcggcggcctcaaaaacctcaactcgaaatttcttcaaatccaataatggatgcgcagccagaacccgttagctacatctgtggagattgcgggcaggaaaacncnctgaagccaggggatgtgattcagtgccgtgaatgcggttatcgtattctctacaagaaacgcacccgcagaattgtccagtatgaagcgcggtagagcaatttccaaggtcctcgtatgatgttgaggagtattttcccccttactgcaggctacacttgtgttatgtgatgatctagtgatgttgataaatggtgatatgaggacatgtgatatatggtgtttcacattttatgttctgtggttggctggntgctcatgaaacaaagaaatgaaattcttcatgtgnnagnnatatatatattcatgacatgattgctagttacttgttcatatctatcaaatctttgctgc

SEQ ID NO: 1530 - DNA, 691 bp, Bruguiera gymnorhiza
  misc_feature (118)..(118): n is a, c, g, or t
  misc_feature (122)..(122): n is a, c, g, or t
  misc_feature (128)..(128): n is a, c, g, or t
  misc_feature (185)..(185): n is a, c, g, or t
  misc_feature (230)..(230): n is a, c, g, or t
gatcttctggccggcctaaaacctcactcttctcctccgcggccctcaccggaactacttcaacggcgcagccaaaccccaccgtcccctttttcattattccttacaggacctccantatngttggnagataattgaagatggatcctcaagcagagcctgtgagctacgtctgtggagattgnggaacggagaacactttgaagcctggggatgtcattcagtgccgngagtgtggctaccgaattctttacaagaagcgcacccgtagaattgttcagtacgaggcacgctgaaggcaatggcttcatgaattttgtgtatgtcatacggacatcgacttggtatgtccgttaaatatgtactttgcacttcattgggttctatcaaccagcactatatcatattcaatgttgaatataaccttatttgcattagttttattgctactacttttcaagaggggggggggagaaaatataagataatgctaaaaaattataaaaagtggtccgcggccccggatcccccctttggggggggttaattgggacccaaaaaatgaaaagttcccttgggagggtttgggacaaaccacaacttagaagtcggggaaaaaaaatggcttttattttggaaaattttggggagggcaagtggccttatattgtggaaccctttaaaagaccgg

SEQ ID NO: 1531 - DNA, 417 bp, Castanea mollissima
acttaaaacgaaaacatagatgatagagcagttggggtgggcgaatagagagagacagagagagaaacccgaaaaaccctagaagatatcttgatggatcctccaccggaacaagtcaactacatctgcggagattgtgggatggagaacactctgaagccaggtgatgtgatacagtgccgagagtgcggttaccgcatcttgtacaagaagcgcactcgccgcattgttcaatatgaggcacgctgaagaagagaagtggggaggcatgggcatgcagcagcaacaacaaagactatctgtattgggtccattttacaccttgttaatatggtggtttagtatgtagtcatagaagactaaattataagttgcactgtctaagtttgggatcattggatttgatcttctatgatt

SEQ ID NO: 1532 - DNA, 453 bp, Castanea mollissima
caaaaacatagcggtcgttcacttgaatagagacagagagaaccccgaaaagccctagaagatttcttcatcaactccttgatggatcctccaccggaacaagtcaactacatctgcggagattgtgggatggaaaacactctgaagccaggtgatgtgatacagtgccgagagtgcggttaccgcatcttgtacaagaagcgcactcgccgcattgttcaatatgaggcacgctgaagaagagaagtggggaggcaggggcatgcagcggcaacaacaaagactatctgtattgagtccattttacagcttgttaatttagtggtttagtatgtagtcatagaagactaaattttaagttgcactgtctttgggatcattggatttgatcttctatgattaaattttttaatttggaccttaatgttatatagtacttagattccaatttga

SEQ ID NO: 1533 - DNA, 485 bp, Quercus alba
agactgaactcaatatagtatatatattgggtaaaacgaagacatagcagtcgttcaggttaatagagacacagagaaaaacccgaaaagccctagaagatttcttgatggatcctccaccggaacaagtcaactacatctgcggagattgtgggatggagaacactctgaagccaggtgatgtgatacagtgccgagagtgcggttaccgcatcttgtacaagaagcgcactcgccgcattgttcaatatgaggcacgctgaagaagagaggtggggaggcaggggcatgcagcagcaaacaacaaagactatctgtattgggtccattttacaacttgttaatttggtgatttagtatgtagtcatagaagactaaattataagttgcactgtctaagtttgggatcattggatttgatctctcatgattaaaaatttttatctggaccttaatgttatatagttacttagattccgatttgc

SEQ ID NO: 1534 - DNA, 755 bp, Arachis hypogaea
gtctctcacgcatttgcttccccctctcaaagaaaaccctagcctccgtcactctcctcttcaagctgtgtcaccgccaccgtcctaccgccgccgtcgaatctgatccagccgtcgtccctactgcttcactcgaccatgcctcccagtctctcactcgaccagaagccagaactctgaagtgtgaatcactcccccttctccaaccctagcctctcttctcttcgagccagtgccgccgcccgtccgttaagccagtgccgccgtccgtccgttgagccattgcccccaagtctccaacccctgctctcttcttccgccgtcgtctggtcaatcaacgttctgtcggcatcgtcttcgaagtgtgttgctggctgcaccaaaacctgaaacttaaaatctttgagtctctcgatcactcagaaacccgcgccatcgatggatcctcaagctgagccagttagctacatctgcggagattgtggtatggagaatacgctgaaaccaggtgatgttatacagtgcagagagtgcggttaccgtatcctttacaagaagcgcactcgtcgcattgtccagtatgaggcacgttgacaaaaactgctgtggcgttggcaagtattttccaatgcaaccgttatagacttgtaatgaaattgtgatgtgaatgtgctgttctgtttacagatttattgaagtcttatgaaactgaaacttaactatcaatgatccttcgagtcttgaactattcaaat

SEQ ID NO: 1535 - DNA, 250 bp, Pisum sativum
tttccttcatccgcctccacgatccatctgcaattcgaaataccatatccaagacatggatcctatgcctgagccagtcagttacctatgcggtgattgtggaattgagaatactttgaagactggtgatgttattcagtgccgtgattgtggttatagaatcctttacaagaagcgcaccagacgtattgtgcagtatgaggctcgttaaggaacttttttgttccatgttataactaatattggtgtg

SEQ ID NO: 1536 - DNA, 521 bp, Euphorbia esula
cgccgatagtgtctgaaggaaaaaaaaaaccaccgcgcgaattcatggatcctcaacccgagcctgtcagctacatctgtggagactgtgggatggaaaatactttgaagacgggagatttgattcagtgccgggagtgtggttatcgtattctgtacaagaagcgcacccgtagaattgtccagtacgaggcacgctgagcagaaatgagatgctgaagtgggagcatggaattgaagaatgtcatttccttctaagcatgtataagcagatgtgttgtgtctaactctagtttttaaagacactttgttcgatacattggaacagttaatgcctttatgagtatatgtctctatgtgtttcgtatcgtaccagatgcacctgccttttatgtagatttgggtttctgtgtttatcgtattagtaacaacactattacgttattggtattgctatgtaaatgagaaatttgttggtttgctgatactaatatgatgttgtgagcagattgactgactcct

SEQ ID NO: 1537 - DNA, 651 bp, Cryptomeria japonica
tagtaatctcgtcttttggaactgttggaagatatttagcaggttttgaacttttgagtactatggatggacctgcagtgcctgaacctgtcggttacatttgtggagactgtggagctgagaatgcactgaagcctggcgatgtaatccagtgcagagaatgtggttaccgtatcttgtacaagaaacgcacaaggaggattgttcaatacgaagctcgctgaactgattccatagagtctggattattgtgggcaaattttgaatcatgtttgatcttgtggataaaattgtaaatgaaaaataattcttgttttacgatacaaaactttatacagattgactcagtatatagttctttgcaagccctcagtcttgtgtagggttattttgactcagtatatagttctttgcaagccctcagtcttgtgtcgggttattttgaagaacattgttatatttggaccgtttttaatgatgtttctctcatctactttgagcaatcatactggggataaacaatacataatttttattatatagagctaaggaaactttcataaagaaagttttaatggtcctctatttctaatcactttatattaagattattgaacttgattgaatgaagcagccaactgtaaacctaga

SEQ ID NO: 1538 - DNA, 761 bp, Picea glauca
  misc_feature (82)..(82): n is a, c, g, or t
  misc_feature (114)..(114): n is a, c, g, or t
ccacacgtattaatgagatatctccattgcacgttgctttgcagcaagtcttccatgcagtttagatcggcttgaaccctcngccatgatgcgtagaccacgctttccagcttngatgccacaaacacattgtcgaagcaagaagtgatggctctcgccgcttgctgaaagctctctggagacttcttatgcacgtgaacacaataaatattatggggggtgtaaacagctctcaaaagcctttcgaacatctcgatataatccccccccccccccgatattcacacacagagcttccagctaagattcgaagttgtctctgcaacaggcaattgctaaatcttcacctccaatacgataccagctttaatcaggctttaagctaccatggatggacctgcagtgcccgaacctgtgagttacatttgtggagactgtggagctgagaattcactaaagcctggtgatgtaattcaatgcagagaatgtggttatcgcatcctgtacaagaaacgtactagaagaattgttcaatatgaagctcgctgagatcattttgcaattgtcacactgattattgagggcatgttttggaacatttctagattcgggaatggatgagaatgtaaattttgatctgaaaatatggaaaacttaaaacacttttagttgatagtcttgtctttgtcgccacttcatacagatttcaagttagtttgtaaaacattattatattatttaaaacaggttgtttgttaaat

SEQ ID NO: 1539 - DNA, 620 bp, Zamia vazquezii
gctaccgggttgaggagtggtcgcagtcttccctttgccgcttgctggaacgtgaccttgcagcacggtggagcctcgaccagggtaacacaagtttaagtacccatggatggacctgcaccaccggagccagtgagttacatctgtggagattgtggagctgagaatacattgaagcctggtgatgtaattaatgtcgagaatgtggctatcggattctctataaaaaacgcactagaagaattgttcaatatgaagctcgctaaagctgttttattaacaaaggccatggagggtggcaatcaaaacattcctgatttgggtgtgtgtacatatatgtgtgcatggaaaaacactagctttttcaaatgatgatatgatatggaaatctgtatggagaatttcaactgatggtgatttttttgttggctttcgcagcttgttagaaatacttgtgttgaatttaagcagctttgaaactggaattattttaaacttgcatgttctttaatactatctaacgtgtattctatttttgaggggaccggtgggacccatttatttgtaaacgtatgtacatccagcaacatataaagctgtctaaatgtcagttattggtg

SEQ ID NO: 1540 - DNA, 465 bp, Pinus taeda
gttgttttctgcaatacacaatacccaaatcttcatatacaatacgatcccacttttattcaggctataagctaccatggatggtcctgcaatgcctgaacccgtcggttacatttgtggagactgtggagctgagaattcactaaaacctggtgatgtaattcaatgcagagaatgtggttatcgcatcctgtacaagaaacgtactagaagaattgttcaatatgaagctcgctgaggtcattttgatattctcacactgatcattgagggcatgctttggaacatttctagattaagggatggatgagaatgtagattttcatgttacaatgtggaaacttaaaggcttttagttgatccccctgtctttgtcaccactttatacagatttcaagttagttgtaaggcacaactatcttatttataacaccccgcttgttaaccgtccttatgtaactgtct

SEQ ID NO: 1541 - DNA, 647 bp, Pinus taeda
  misc_feature (34)..(34): n is a, c, g, or t
  misc_feature (299)..(299): n is a, c, g, or t
cattcacagagtgagctcccaactagtattcgangttgttttctgcaatacacaatacccaaatcttcatatacaatacgatcccacttttattcaggctataagctaccatggatggtcctgcaatgcctgaacccgtcggttacatttgtggagactgtggagctgagaattcactaaaacctggtgatgtaattcaatgcagagaatgtggttatcgcatcctgtacaagaaacgtactagaagaattgttcaatatgaagctcgctgaggtcattttgatattctcacactgatnattgagggcatgctttggaacatttctagattaggggatggatgagaatgtagattttcatgttacaatgtggaaacttaaaggcttttagttgatagttctgtctttgtcaccactttatacagatttcaagttagttgtaaggcattactatattatttataacaggttgcttgttaaatgtccttatgtagttgtctctacgattctgtttcaggaaaacaactgcatatggataagtgaaagttttgctccatttataatagaagaacttctacaaagaatttcagttgataatcttatatttgctagccttaatataataaagctttgactttccttatttct

SEQ ID NO: 1542 - DNA, 451 bp, Cynodon dactylon
gccggggggccgagtcatccttctagaatacctgcttcgcggcgcccgcaccgcacaaaccctccgctctgccgcaggaaaccctagctcggcgaccagatggacccgcagccgccggagcccgtcagctacctctgcggagactgcggaactgagaacacactgaagccaggagacgtcatccagtgccgtgactgcggctaccgcatcctctacaagaagcgcacccgcaggattgttcagtatgaagcacgctgaagacaagcggacacaacatcctatgctgtttgcgtgcctctagctgaatccatgagtctccttggagaactgcacctgggaacatgtatggtattgcaatgtgtgtcggttgtaataactgttaagtgcacttggctgtggtgaaactcgaactgttgacagagctgtgacaatatattgttgacctgtcctg

SEQ ID NO: 1543 - DNA, 478 bp, Amborella trichopoda
  misc_feature (63)..(63): n is a, c, g, or t
  misc_feature (230)..(230): n is a, c, g, or t
ccaggttctctctctctctaagaagaagaacgagcttctctctctttctctctctctctcctntcaagtgattgaaaagctgttcggaaacagataataagagcagtcataagctcccatggatcctcctcaaacagaaccagtaagctacatctgtggagattgtggagtcgagaatacgttgaagcctggggatgtgattcaatgcagagaatgtggttaccgtattntgtataagaaacgcacccgtagaattgttcaatatgaggctcgttgaagctgtaatggattggaatgtctaccggtgatctccaaatctagctttcaatgataatgtccgtttttcgtttgtatacataactatggatgaactgtttttccacagagaacttaagcctagaaatacttactgtcattcatgtatggagctgactgagcagatggttgtatagtagagagttacagacttcttaaattc

SEQ ID NO: 1544 - DNA, 1650 bp, Arachis hypogaea
aacatacctttgccgaatcaagtggactactacatcaaagtgcaagggcaattgacccaacaaataggaggatctgcacttcagtgtcatctctcgaaatccatctttgttgttgtgattggaagcaacgatctctttggttacttcaactcaaaggatcttcaaaataaaagcacccctcaacaatacgttgattccatgacttcctccctaaaactgcaactacagagattatacgagcaaggtgcaaggaaatttgaaattgcgggaattggtgcaattggatgctgtccttcaaacaggcttaagaacaaaacagagtgcttctcggaagccaattattgggcacttaaatataatgaagatcttaaaaccttgttgaagaattggcaattggagaaaaaggacataagatactcctacttcgatacttatgccgctatcgaagatctcattcagagcccaatttcttatggatttagagaaataaaactgcttgttgtggaattggtaagctgaatgctgaacttccatgtctcccaatttccattgtttgttccaacagacaagactatcttttctgggatcctgtccatcctaccgaagctgctactcgcatctttgtcgatagactttttgatggaccttcaagatatgcatctcctattaccatgagacagcttgtagctgcttgaatttcttttttctttttccattttatatcttaatttgtcctcaataatacaatatgccattgttcttttaacttgtgattgtcaagtagctcaaaaagttcaaaaaggctgaccaaaaggaaatagaagagagggggcaacaatgatagagtaaagaggaaacatagtttacatatatgttttgtctttataaatttgggttatgttgatttgttatcctattttttttttacttttttcttatcatgccatatagtagtaggtgatccatttgctttaaaaagtaagaattattttaatagttcaaaactcgaaggatcattgatggttatatttcacaagacttcgcagcacattcacatcacaatttcattaagtctataacggttgcattggaaaatacttgccaacgccacagcagttttcgtcaacgtgcctcatactggacaatgcgacgagtgcgcttcttgtaaaggatacggtagccgcactctctgcactgtataacatcacctggtttcagcgtattctccataccacaatccgcagatgtagctaactggctcagctggaggatccatcgatggcgcaggtttctgagtgatcgagagactaaagattttaagtttcaggttttggtgcagccagcaacacacttcgaagacgatgccgacagaacgttgattgaccggacggacggcggcactggctcaacggacgcgcggcggcactggctcgaagagaagagaggctagggttggagaagggggagtgattcacacttcagagttctggcttctggtcgagtgagagactgggaagcacggtcgcgtaaagcagtagggacgacgggtggaccagattcgacggcggcggtaggacggtggcggtgacacagcttgaagaggagagtgacggaggctagggtttcttagagagggggaagcaaatgcgt

SEQ ID NO: 1545 - DNA, 782 bp, Arachis hypogaea
tacggcactacccctctctctctgtctctcagccagcagcccctctctctctctctcagccagcagcaacagcagccaccgccgtcgccgaactgttcacgtcagccagagggtgcctcgccgacggcagtgacagatagaaggtcagctcgaagctcttggccgtccatcctcttctcctccccgtcgtcgcctttggacttgcagatcgaagctcgtggccgtcttctctacatcgtcttcgtcttcgtcttcgtcgtcgtggacttgcagatcgaagcgcggtcggttggatttctgtttggttcctctctcgtcgttagcgtgttgctgccttgctgcaccgaaacctgaaactgaaacttaaaatctttgggtctctcgatcacttagaaatctgcgccattgatggatcctcaagctgagccagttagctacatctgcggattgtggtatggagaatacgctgaaaccaggtgatgttatacagtgcagagagtgcggttaccgtatcctttacaagaagcgcactcgtcgtattgtccagtatgaggcacgttgatgaaaactgctgtggtgttgtcaagtattttccaatgcaaccgttatacacttaatgaaattgtgttgtgaatgtgctgtttgtttgtgaagtcttatgaaactgaaatttaaccatcaatgatccttctactcttaaaactattaaaatgattcgtactttttaaaacaaatggatcacctattactatatgcctatatggcatgttaagaaaaagtac

SEQ ID NO: 1546 - DNA, 583 bp, Eucalyptus gunnii
  misc_feature (83)..(83): n is a, c, g, or t
  misc_feature (85)..(85): n is a, c, g, or t
  misc_feature (88)..(88): n is a, c, g, or t
  misc_feature (495)..(495): n is a, c, g, or t
cggccggggcttcttcaaagcgatttctcaagaaatctccgcgacctcgctccccgctcgcaccggcaaaaaccctaaccggnancantggacccgcagcctgaaccggtcagctacatctgcggagattgcgggatggagaacacgctgaagcccggggacgtcatccagtgcagggagtgcgggtaccgcatcctctacaagaagcgcacccgccgaatcattcagtatgaggcccgttgaaagagcttgaggatgtgggcttcaatttccatacagacttatttgtcattgtgactggggtacgtggtatgtctttggaaggtagtcatgaaaagaagagaggtaactgctatgcagtcttgtaagcatgtgtgagtgccaacttgtcaagagcgtggataatgttgatataattttggttaaatgtgtaccgtgacaccagctcgttccaattcttcttctgtattgggagcagtttttatctgtcaattnattcgtctttgtaaacctggtgatggaagcacacatgacaaaattgatgcaatcagatcagcatcgaactatcacataggtttgcgct

SEQ ID NO: 1547 - DNA, 705 bp, Arachis hypogaea
acgcatttgcttccccctctcaaagaaaaccctagcctccgtcactctcctcttcaagctgtgtcaccgccaccgtcctaccgccgccgtcgtccctactgcttcactcgaccatgcctcccagtctctcactcgaccagaagccagaactctgaagtgtgaatcactcccccttctccaaccctagcctctcttctcttcgagccagtgccgccgcccgtccgttaagccagtgccgccgtccgtccgttgagccactgcccccaagtctccaacccctgctctcttcttccgccgtcgtctggtcaatcaacgttctgtcggcatcgtcttcgaagtgtgttgctggctgcaccaaaacctgaaacttaaaatctttgagtctctcgatcactcagaaacccgcgccatcgatggatcctcaagctgagccagttagctacatctgcggattgtggtatggagaatacgctgaaaccaggtgatgttatacagtgcagagagtgcggttaccgtatcctttacaagaagcgcactcgtcgcattgtccagtatgaggcacgttgacgaaaactgctgtggcgttggcaagtattttccaatgcaaccgttatagacttaatgaaattgtgatgtgaatgtgctgacagttttattgaagtcttatgaaactgaaacttaactatcaatgatccttcgagtctt

SEQ ID NO: 1548 - DNA, 864 bp, Pinus taeda
tggaatgtgtttctcaatgtcacctttatttatcttattaattacattaccctcgtgccgaattcggcacgagggtgatcgagtaatgttataaattgagaaattcagagccctttacctagattcgaggaccgagttcttagcggagacttgaagctgtctgcaacacgcaatcgccaattcttcctctgcaaacgcttgcggctgttaatcagactctaaggtaccatggatggacatgcagcgcccgagcctgtaagttatatttgtggagactgtggcgctgaaaattcactaaagccgggtgatgtaattcaatgtagagaatgtggttaccgtatcctgtacaagaaacgtactagaagaattgttcaatatgaagctcgctgagatctttttctatatgtcacactgatcatcgagagcatgtttctgaaacgtttctcgatttggggatgtatgaatgtagactttttgggcatgtatgaatgtggacttatgattttacaataaggaaacttgtaaaaagacttttagttgatagtcctgtctctgttagtattttgtatatattacaagttggtttgaagaacattattatattatctaaagcaggtcgtttgttaaatgtctttatgtaatcgtgtctacggttcttttcgaggagcacaactgcagatagataaaataatagttgtgtgatgtagtaatagaaagccttacagagaattttggttgatactctcatctttgtaagcattttgtgttgacttcacaatattatttttaattatttgggactacatttgaagcagctaaattgggaaatctttttatgcatgatgtaaaaaaaaaaaaaaaaaa

SEQ ID NO: 1549 - DNA, 752 bp, Pinus taeda
gcacgagggtgatcgagtaatgttataaattgagaaatttagagccctttgcctagattcgaggaccgagttcttagcggagacttgaagctgtctgcaacacgcaatcgccaattcttcctctgcaatacgcttgcggctgttaatcagactctaaggtaccatggatggacatgcagcgcccgagcctgtaagttatatttgtggagactgtggcgctgaaaattcactaaagccgggtgatgtaattcaatgtagagaatgtggttaccgtatcctgtacaagaaacgtactagaagaattgttcaatatgaagctcgctgagatctttttctatatgtcacactgatcatcgagagcatgtttctgaaacgtttctcgatttggggatgtatgaatgtagactttttgggtatgtatgaatgtggacttatgattttacaataaggaaacttgtaaaaaggcttttagttgatagtcctgtctctgttagtattttgtatatattacaagttggtttgaagaacattattatattatctaaagcaggtcgtttgttaaatgtctttatgtaatcgtgtttacggttcttttcgaggagcacaactgcagatagataaaatattagttgtgtgatgcagtaatagaaagccttacagagaattttggttgatactctcatctttgtaagcattttgggttgacttcacaatattatttttaattatttgcgactacatttgaagtagct

SEQ ID NO: 1550 - DNA, 1017 bp, Picea glauca
agattcaaggagcgagttcccagccgagacttgaagctgtcgctgcaacaagcaatcgctaattcttcctctgcaatacgatattcaccgagcgagttcccagccgagacttgaagctgtcgctgcaagacgcaatcgccaattcttcctctgcaatacgatattcaatgagccagttcccagccgagacttgaagctgtcgctgcaacacgcaatcgccaattcttcctctgcaatacgatattcaaggagcgagttcccagccgagacttgaagctgtcgctgcaacacgcaatcgccaattcttcctctgcaatacgatcacacaagttaatcagactctaagctaccatggatggacatgcagcgcctgagcccgtgagttacatttgtggagactgtggagctgagaattcactaaagccgggtgatgtaattcaatgtagagaatgtggttaccgtatcctgtacaagaaacgtactagaagaattgttcaatacgaagctcgttgagatcattttgtatggcacaatgatcattgaggacatgcttttcaaacgtttctggatttggggatggatgagaatgtagacttttgatgttaaaatatggaaacttgtaaaaagacttttagttgatagtcctgtctttgttggtattttgtatatagatttcaagctggtttgcagaacattattatattatctaacgcaggtagtttgttaaatgtctttatgtaatagtgtttacggttcttttcgaggaacacaactgtcagatagataaaataatagttttgtgatgtagtaatagaaatctttacaaagaatttcagttgatactctcatctttgtaagcattttgtattgactcaaagattatttttaagaattactactacatttgaggcagctaaattggtgaatctctttatgtgagatgtatcaatgagttattttgaggaattcacgaggaaatttccaaaatgatataatacaaagttcatgtgcattcaa

SEQ ID NO: 1551 - DNA, 425 bp, Helianthus annuus
  misc_feature (424)..(424): n is a, c, g, or t
ttaatttgcagtaatcaatcaatggatccagcacctgagccagttacttacatttgtggagattgtgggcaggagaatactttgaaggttggtgatgtcattcaatgccgagagtgtggttaccgcattctctacaagaagcgaactcgtcgaattgtgcaatatgaagcccgttgaagaacacactgcaagtgaagctcacattggcattatcaagtatgattgaagtattgtgtaataagtgggaaatttggatcttatctgtgtcaaatgtttgaatgctatgtgaactttttcatcgtagatgtcatgtcaatagtttataacattaagtatcgacaattggtggttcattccatgtttctctgtttgtagacaaaaaacacaaaattgaccatggttttgaaaagcgttttagaatgtna

SEQ ID NO: 1552 - DNA, 672 bp, Pennisetum glaucum
ccccttgatgtgctcccctccccgtcgcctccctcatcatctagcaaaccttatcacttcaactcagattgcattctctctctctctctacctgcgtcgtgctctgttccgttctcccccaaagaggaagagagaaaccctagctcgcggctccccggatggaccctcagcagccggaacccgtcagctacctctgcggagattgtggatctgagaacacgctgaagccgggagatgtgatccagtgccgtgactgcggctaccgcatcctctacaagaagcggatccgccgaattgttcagtatgaagcgcgctgaggacaaagagacgacatcctaggtggttggttgtgtgccgcaatcagtgtagcaggtcgcctgggagaaccgactcgactcatggtatggtagggtaacttgtgcgtaggctgtaaccatgctctagacttcatctggaagaattggaacttgaaagaccctctgaaacgttgatggatgtcagagaccttataagtactgattgaagtagtatgatcgcagcgaacctaagatatctggcttcgtatgtcttgccttatcgctgttaatctgctggtttcgccatatggctttttgagtgcgacattggttgaagtgctgtccaggttcgcatatctcgagtgttatccgacag

SEQ ID NO: 1553 - DNA, 535 bp, Papaver somniferum
atttgattacttggagttgttgattattgtctggttttataaacgaggttaagaaattacccctttctgttcttcaatttggaatcgattggtgagttaaagccagaagcccagaagtacttttcatttccatcagagagtaagtgagaaacccttaatcctccgactttgtcatccatggattctcaacctgctgaaccagtcagttacatctgtggagattgtgggatggagaacacactgaagccgggagacgtgattcagtgtagggaatgtggatatcgtatcctttacaagaagcgaaccaaacgaattgtgcagtacgaagctcgctaaatacgaagggcaacaaattactcacggatattaaaggctatctaatggtgttagatattaaactgaaattgtagtctaatgcgttgtttggagaaatgcgctgtttgatattgttcgtcaagtaattctctgtagtactctcctttgatattgttcgttaagtaattctctgtagtagtctcctgctgcactttactta

SEQ ID NO: 1554 - DNA, 1132 bp, Prunus persica
tttttttttctttggtctaatttactagactacaaacataacatgtacatataattttctaaattctcacttgtaaaggtgtgatctagttcattgtaatagaagctaattatgagacctacataccaataaactgaagttattgaactataccatttcaagtaaaaccaccgttcaattcaatagatacttgaactattgcattgaaattaaactattgaacaatcattatagatactctaatagtaataaatccactgcctgcaatgcgatgtgagtgtcaatttgccaatttgccaaattgccaaacacaaaacaaaattgtgactggtctggtttggtagcagcaccctcgtccctctactctttctttcccttgcattttgaaattttatcactaaaagccgctgggttgggtgtacaagttacaaactagaaagacaagcttcggctgtccctaaatcccaagttgctatctgactaacaatccagtccaatttgtttgggcttaaaactccaagtccaaaccaatttccgaccacgatggagccatccaacaatcaatgcatgtcgtatatatacacacgcgtatatacaatacagtcaaaaacgagaacccctcgaaacgaaactaattctgctcgaatatcataaaccctagaagtagaaagccctttttgaacgtaatctcatggatccgcagccagagccagtctactacatctgtggagattgtgggatggagattcccttgaagccaaacgatgtgattcaatgccgtgaatgcggctaccgtatcttatacaagaagcgcactcgtcgcattgttcagtatgaggcacgctgaagaagagacttggtgtgcttgtgtcagtcaatgatccgtgtattgaatctgtttgatgtctttgaacttaagtctcagtgagatgtttgtataatatctgtacattttcggctacttgttaatattgttttgtactaaatcttgctctttacatggttgtataattattgagattcacaaaataattggcattttggtcatacatgggtttgataaatatatacaagggacaatatgtctgtccccgaacaggatgtgaatgctgagtctgagtggtggttcttc

SEQ ID NO: 1555 - DNA, 445 bp, Papaver somniferum
cggaagccgtcttctagtttctttgtttttttgttcaggaaccctgaaatctctagcttctatccatggatcctcctcaagatccagtcagttacatctgtggagactgtgggatggagaacacactgaagccgggcgatgtcattcagtgtagggagtgtggttatcgcatcctttacaagaagcgaaccaaacgaattgtgcagtatgaagctcgctgaatacaaagggagagcaacaaaatagcaatggatattaaaggctgttaatggtgttagatattaaactgataactatcattgtaatctaatgggttgtttggagaactgcgatattgttcgttaagttatactctagtactatcctgcagcattgcacttgtaatagtaatatggtgcttaattctattttgaacctagcagacaggttgatcagtatcattgtg

SEQ ID NO: 1556 - DNA, 529 bp, Prunus persica
atgacacatgtcaagcaaaaaaaggagaaagtccaaaggagaagaaaaaccctcttcttcttctggcttcttcgctcgcctccgccaccgacgtcttcatctgcttcgctcggctactgtggaggtaatctcatggatccgcagccagagccagtctactacatctgtggagattgtgggatggagattcccttgaagccaaacgatgtgattcagtgccgcgaatgcggttaccggatcttatacaagaagcgcactcgtcgcattgttcagtatgaggcacgctgaagaaggacagaggagaagcaagcttcttagagagtttcaaggggattttgtgtaattttatatacttccagttttctgaaagatacttggattccaaatgaactgaaattttccaagtgaactgaaattgcttattttggttgatggccaatattttgtaatattttgtgaactgaagttggccttcactttctattgcggtttctagtttctggttgttggccaatatattgtgaactga

SEQ ID NO: 1557 - DNA, 558 bp, Prunus persica
ggcacgaggagaaaccctcttcttcttctgctccgccaccgacgtcttcatctgcttcgctcggctactgtggaggtaatctcatggatccgcagccagagccagtctactacatctgtggagattgtgggatggagattcccttgaagccaaacgatgtgattcagtgccgtgaatgcggttaccggatcttatacaagaagcgcactcgtcgcattgttcagtacgaggcacgctgaagaaggacaaagaggagaagcaagcttctgagagagtttcaaggggattttgtgtaattttatttacttccagttttctgaaagatacttggattccaaatgaactgaaaatttccaagtgaactgaaattgcttattttggttgatggccaatattttgtaatattttgtgaactgaagttgccttcactttctattgcggtttcaagtttctggttggccaatatattgtgaactgaatttgcatattgtgttataactgtaacatgcctttgatttgttatgcaaccttttgttatgagttcgttgtaaaaaaaaa

SEQ ID NO: 1558 - DNA, 457 bp, Prunus persica
  misc_feature (38)..(38): n is a, c, g, or t
  misc_feature (42)..(43): n is a, c, g, or t
cggcacgagaaaccctagaagtagaaagccctttttgnacgnnatctcatggatccgcagccagagccagtctactacatctgtggagattgtgggatggagattcccttgaagccaaacgatgtgattcaatgccgtgaatgcggctaccgtattttatacaagaagcgcactcgtcgcattgttcagtatgaggcacgctgaagaagagacttggtgtgcttgtgtcggtcaacgatccgtgtattgaatctgtttgatgtctttgaacttaatatctgttcattttctgctactcagtgagatgtttgtataatatctgttcattttcggctacttgttaaaattgttttgtgctaaatcttgctctgtacatggttgtataattattgagattcacaaaataattggcattttggtcatacatgggtttgataaatatatacaaggggcaata

SEQ ID NO: 1559 - protein, 603 aa, Prunus persica
GGCTGCAGGCTCGAACGAAACTAATTCTGCTCGAATATCATAAACCCTAGAAGTAGAAAGCCCTTTTTGAACGTAATCTCATGGATCCGCAGCCAGAGCCAGTCTACTACATCTGTGGAGATTGTGGGATGGAGATTCCCTTGAAGCCAAACGATGTGATTCAATGCCGTGAATGCGGCTACCGTATCTTATACAAGAAGCGCACTCGTCGCATTGTTCAGTATGAGGCACGCTGAAGAAGAGACTTGGTGTGCTTGTGTCGGTCAACGATCTGTGTATTGAATCTGTTTGATGTCTTTGAACTTAAGTCTCAGTGAGATGTTTGTATAATATCTGTTCATTTTTGGCTACTTGTTAAAATTGTTTTGTGCTAAATCTTGCTCTGTACATGGTTGTATAATTATTGAGATTCACAAAATAATTGGCATTTTGGTCATACRTGGGTTTGATWAAKAAAYWAGRSMYRAKATTYTGWYSYYKAAYWKKWYKTGWMTGSTKWKKSKGAGGSWKGTYYTKCCMRRMTCMASYTAAWKYWMKYMSKSWGCAKSATWRWKMMSATKSWGTTSWKRWTWGATWWATRWRKWGWSYTSAWWRTKMCMTGYT

SEQ ID NO: 1560 - DNA, 647 bp, Raphanus sativus
gggcctcttagctcgtgtttgtagttcagcctaaaccctagctttgttcgactcgagttgatagcaatggatcaacagcccgaaccagttacttacgtctgcggcgattgtgggcaggagaacactttgaagtctggggatgtgatccaatgcagagagtgtggctaccgtattctctacaagaagcgtacccgtagaggtgaacgttgttaatataaaatactaatccttactcctcctctggttttaggtttccttgacgactctctttttggtcttgttcttattgagtcttatcacactgatatgacatgatttttgattaggttcgtgtaaataagtttgtgtatagtctactactttttgtttgtttgtttgcagtgctaatctatcaactttctgactacttatgtcgttgttgattctcttgcagttgttcaatacgaagctcgctgagaacacaatcccaaaagatgattgcaagtctgttaagatgactctttcctgcctatgtttgtaatataacctcgactagaaaatctgtcgttgtttttgctaagtggcttggtttggtgtgatttgattacaattgagcgtgcctttgtaataatctctttgcctttttggtaaaaaagaaatgttatgct

SEQ ID NO: 1561 - DNA, 1190 bp, Eragrostis curvula
acccccccttttttgaagacgccaggcccgataggatccgcagcacgccggagcccgtcacctacctctgcggagattgcggagctgagaacaccttgaagccaggagatgtcatccagtgccgtgactgtggctaccgcatcctgtacaagaagaggacccgccgaattgttcaatatgaagcccgctgaagacaaggcgacccttactatggtgtgtctctagatatgtaatgaactccctgagataaagctagtggacagcggaaatgtgttgcatgtacaatgtttgaaggttgtatgtgtccattggacttagcataagttgtaaacttttaacttgagtgaagctgatttgaagacctgagatactgcaatgatctggttgatctatcttgagtggtgtcaggtgtcattttattgcccgtattctcagcgatagtgcaactctgcctctactaattcttgagattaaccttggttgtttccccccatttttttctgtctttacgctgttgagttacttctggtatccctgtgtattgttcatcttacagtgttgcgctcgtctgataattggtgtgttagaactgagttgatgaaagttacaggacatttcagttgggaatcttgggatgggtaatctgttttgcttcagtgcattctgttgaataactaacctcgattgatattttgtcactaacaaaggatccgtttattttctaatcgcgctccacttttctctttcacattcttgctttatacctcccaccttcattccacaattggttctcggctttcaaatcctggtttattcccccactgtatttccgaccccccgccagcctcacatttggaaaaccccccccgcctcggacgccacctcaacaattcccctatgtcccatacacacttggctaacccggggcaaaccggtttccggtgagaattgtttctccctcccattcccccctatacacaacctcggaataataaacttaagccctggggggccaatggatggcataatctcttaatttggtttccgccacgcggcccctttcaccgtgcgaaaacagtttgggtcgctgatctatttgaatcaccactacccacggggagaggggttttagaattcgtccactctctcccctcctcccaatagtaccacccctgcctcgaggcttaccc

SEQ ID NO: 1562 - DNA, 591 bp, Mimulus guttatus
ggaagaaaacctttataaaccctaaaatttcagagtctctggttatcgatcgccgaaaacaatggatcctcagcctgagccagtcagctacatctgtggagattgcggccaagaaaacacactgaagcaaggggatgtgattcagtgtcgtgaatgtggttatcgtattctctacaagaaacgtacccgccgaaacgagccgagatgttatgtttcttgtattctcgaatcttggtatttcgcaattatttgcatggttagattgctttatattcttacacttcggactgaaacaatatcgttaggactcgatcgtcatttggtaaaaagattgaaggaacttcggaagttgttcaatatgaagctcgttgaagtcaacatcaaagtcccaccatgtagcggttgttcggtatgaagctcgtttaagcagtatgaagtaggtctccatgtattataactgctgcaaattgtgttatataatgttctacttttatactcgtaaccgtaatatgtgatcgtgtgttttctcgtgtgagtagtctatgttcgaacgagtaatctggaaaaagatttggtttttaatatttgcta

SEQ ID NO: 1563 - DNA, 452 bp, Solanum phureja
cgtctctgcttacagttgatcatcaatgggattctcaacatgttgaaccagtcagctacatctgcggagattgtggacaggagaataccctaaagcctggtgatgtgatacagtgccgtgaatgtggttatcgtattctttacaagaagaggactcgcagaatcgtgcagtatgaagctcgttgattcttgaagtcatttggaaaaaaacatcaagtactctgctcttacggaagtagatattaaaaacgtaatagctaccgttaaaaatcatgcgtttcagcgtggccattgtgtgtttttacgtttctgcgtgatatttcttcatggcatcatgttgttagtctatatggcaacttcgacttgaactcagtgtgattgaatattgtagaaattacttacaaacatagtcttgtggtctattatcgtggaaaatctgtttcaagttcgaaa

SEQ ID NO: 1564 - DNA, 739 bp, Arachis hypogaea
tggcgccaacacgaggctcctaccctctcctcgcgcgcctgagtctcatcagtcatcccgttcgcaatcgcaacattgtcatcgccgctgacccagccaaggagaacatcttcgtcgccgcctgacccagccgaggcagcagcgtcgcttcagaaactcttcgcatcttcgcctctccgcgtcttctcgtcttcacgttttcgcctcttcgccttgtcgccgatcttcaccgtcagctcagggtgttgctgccttgctggctgcaccgaaacctgaaactgaaacttaaattttcttgtctctcgatcactcagaaaccctcatcatcaatggatcctcaagctgagccagttagctacatctgcagattgtggtatggagaatacgctgaaaccaggtgatgttatacagtgcagagagtgtggttaccgtatcctttacaagaagcgcactcgtcgcattgtccagtatgaggcacattgacgttaacaaaaactgctgtggcgttggcaagtattttcgaatgcaaccgttaaagacttaatgaaattgtgatgtgaatgtgctggctgtttgtgcagtcttacgaaactaaaatttaaccattaatgatccttcgagtcttgaactattaaaatgattagtactttttaaaacaaatggatcacctactactatatgcctatatggcatgttaagaaaaagtacaaaaaaaaggaataaaagttcaacataactc

SEQ ID NO: 1565 - DNA, 881 bp, Marchantia polymorpha
  misc_feature (784)..(784): n is a, c, g, or t
ctcggtacgctcgcgcccctgtccccgggtttcaattcaatgctttgatttgtgttctagtgatgcgaaatgtgagctgcgaattcgtcctcaagagatctcttcatctctcgggaactgatctgccatcatggatcacgggggacccgctccacccgagccagtcacatatttgtgtggggattgtggagctgacaatactcttaagcctggagatgtcatccagtgccgtgaatgcgggtatcgcatcttgtataagaagcgaacccgacgaattgtgcaattcgaggcgagatgatcgattggttgtcggtcagcactcctggagttttagacatgtcaagccgagcatgtacttgccctttcagaatgggatctacattgaagcgattgacgaagggcctggatcaacttcctggaatgaggtttcttcagactcaaaggtgtgtacttagtatatgaatcgctggagtttgactattatcgtcggcagaatggaatttaggctctgagtggcgctcagagcttggactatgaatttattggacaaaacgctgctacaatcgtcgcctgctctgaatttcgcattttctaggaggtagaaaatgcaacctatggatgtattattgattgcaagacctacattaaacatccgattttgattagagagagcaaacgttacgcgatgttggatcagtaacatgtagtaacgaagattcagatcattagctggttacatcttttttctcttcatatgtgagttcctccgcgactttcggaaganagaaggtgttgtctttcacctagtttctgcattgccatcaaacgatgcacgttacgaatacacaaatatggaaattatcatatattttgtgcttgca

SEQ ID NO: 1566 - DNA, 666 bp, Physcomitrella patens
aaaaccctaacgctaccacgctcgaccattaggctcgttttcgtcgtctctctcccatcgaggttgcgaattttggacccccttgggaaattttcggttgtgcccaggcgacgttattgtttgttgcgatggacggtagcatgtctgctccccctcccgagcctgtcacctacctttgtggtgactgtggagcagacaataccttgaaacctggggatgtgatccagtgtcgggagtgtggttatcgcatcctttacaagaagaggacaaggcgcattgtccaatttgaggctcgctgaagagagttccagctctagttgaagcaaaatctgtttcctgagtggaatctgatgtcaaccgcctcctttcgcaatgaaaagagggcttttggattgcttacggacaatttcgacttagtttgacagatattaggatgtggaattttaggcacctgtatttcaacatgtgctcttaaatccggcaggttgctacataggtgtattattagtaattaaagctaaaagaaaatatgacgcgaacattataggcactgtgatcgttatttatcctccgtctctctactatcttgcctttttggtagattattggaatttgaaaaatgcgtatgtttacaaataactgaaggtatcgttgtatttctaacat

SEQ ID NO: 1567 - DNA, 477 bp, Malus domestica
gaagcagcaaaaccctagacatctaacagccttttcgagctcttctcatggatcctccgccgccagaggccgtctactacatctgtggagattgtgggatggaggtgcagctgaaatccaacgacgtgattcagtgccgcgagtgcggttaccgtatcttatacaagaagcgtactcgccgcattgttcagtatgaggcacgctgagaaacccgcgcagagctcctcagtagatgacatgaaaggtagagtatcgcatgttaaatacctccatggttgatacaacttggggagccaactcaaaatagcgcaattgggcaaggtaattcagtgtaacaaacgcagctgtagtgacattaaaattgaacatattgttgtgaaatataatgtttggcgatgaatggaacatcaatatgtctgtttggagccgtataattgagataatggttgacaaatattcagtttctttcaaaaaaaa

SEQ ID NO: 1568 - DNA, 555 bp, Zingiber officinale
  misc_feature (9)..(9): n is a, c, g, or t
  misc_feature (47)..(47): n is a, c, g, or t
  misc_feature (85)..(85): n is a, c, g, or t
  misc_feature (183)..(183): n is a, c, g, or t
  misc_feature (202)..(202): n is a, c, g, or t
  misc_feature (220)..(220): n is a, c, g, or t
  misc_feature (269)..(269): n is a, c, g, or t
  misc_feature (296)..(296): n is a, c, g, or t
  misc_feature (300)..(300): n is a, c, g, or t
  misc_feature (372)..(372): n is a, c, g, or t
  misc_feature (374)..(374): n is a, c, g, or t
  misc_feature (527)..(527): n is a, c, g, or t
gcacgaggnctcgtgccgaattcggcacgagggctagggtttcgacnaattcgtccttcgaaggtgcgatctataaaagcgccgnccaccttcccctcgccaacaatctgatacttcttgttcagctggggttttgggtgcttctttgctcgacgaattcgtccttcaaaggtgtttattgcnaacctagcttttggtcctnggtgtcatggatcccttncagcctgagcctgttagttacatatgtggagattgtggagcagagaacnccctgaagccaggggatgtcatacagngcanggagtgcggatatcgtatcctttacaagaagcgcactcgcagaattgtgcaatacgaagcccggtgagagcnangagcacaatccttaaggggcaagtcactgcttaagagatctatgtgttaaaagagaacttttgtagtattacgctttaaaagtgtgatccactgtgctatgtgataagtaaaacctcaaatatgctaatagttgtggaagtgatttattaccnttagctcacctctttttgttttaaaaac

SEQ ID NO: 1569 - DNA, 467 bp, Panicum virgatum
gctgctccgctccctcccagagagagagagaaacccttagctggcggctcgccggatggatcctcagcagccggaaccggtcagctacctctgcggagattgtggagccgagaacacgctgaagccgggtgatgtgatccagtgccgcgagtgtggctaacgcatcctctacaagaagcagacccgccgaattgtccaatatgaagcgtgctgaagaaaagggagcaacatcctgtgctgttggttgtgcctcaagcagcctaacaggccgcctgggggaaggaatggctcgtggtgattcgtatggtaggtaactcgtgtgtactaggttgtaaccgtgcactggacttcacctggaagcgttggaacactctgaaatgtggatggctgtcagataccctacaagtattgaaatagtatgattgctgggaacctacatacctaataagatggggtcttttgcacct

SEQ ID NO: 1570 - DNA, 749 bp, Adiantum capillus-veneris
ggcgcgcgctcgtttctcttcaaggtgcgcgcgcgcgcacacacacacacacagaagaagaagaggaagagagttttaacgtcgtaggaatctatcccaagagaccttaaagatctagccgagagagagagagagagagagagagattcgttgctttgcatcaatcaaagtttttgtaccgttgtttaatccaagtacgaatctatggatggaggaatggctcaacctcctcctgaaccagtctcatacttgtgtggagactgtggagctgataatgcattaaaacccggggatgtgatacagtgtcgagaatgtggataccgtattctttacaaaaaacgaactcgacggattgttcaatatgaggctcggtagcctgtaggtattggtacatgtacgtaatgtggttgccgtcgtgcttgttgctgctacctccaagtattcgatacaaagatatgtgtatctccactacacaatcacagcattttcaatgatctccgttggctcctaggcacgatcatcctctacctaggtccgctttcaaaacaagttgacagtagcattgcttaaaaacccctttttgcaaccgaggaaaatctcaaggatgcatgcgtagacaaaagctattccatgtttggaagcatggctattaccaaatttcaaggtaccaggcaggaagtccctgaatctaattatagctttattaattctttaagtttagtttgaagttactctcccaaaaaaacaaa

SEQ ID NO: 1571 - DNA, 467 bp, Adiantum capillus-veneris
acattttgtgagaccgttgatcccgcctaaatattgaggctgtccaagggcactctgctgcgctcaccagtggtacgagcaggtgtccgtgtcgcatagcaggtagtcatggatggaggaatggctcaacctccgcccgagccagtttcctatttgtgtggagactgcggggctgataatgcattgaagcccggggatgtgatacagtgtcgagaatgtggttaccgtattctttacaagaaacggactcggcgcattgttcaatatgaggctcggtagcatgcggctcttgggacacatgcaatgtgattgggagaggcatttgttggcactacatgtgaatatgctgtgtacaaagatttgcctccttgggaagaattgctattcagatgggtctgtttcaaacttttaggcagggaggtcttgcatgtacctatagccttatcagtcccatgaagttagtctag

SEQ ID NO: 1572 - DNA, 872 bp, Lactuca sativa
cgggggaatctctatgttgttcgaaattaagatatttcttcactttaaccgtctggatgttcgttattagtcctaatttttctcttaaatattgtttttcctttgtacagtgatcgtggatttgcttattcgtgcgtctaatcaatggatcctccaccagaaccagttacctatatctgcggagattgtgggcaagaaaacaccttaaaagttggtgatgtgattcaatgccgagaatgtggttatcgtatcctatataagaagcgaacccgtagaagtaagtcatctcatctgtgttacttatcctttatgtaattgcaaaacttgtaaaaggtatgagtctcaggagttgcaatgtgggagtttcagttccaatgtggaatgtggattgaactccttatgaagactagactcttatgtcagccacccaggagacaattgtgtacttgattgacatctcacatgatgctcattgggcagtgtgggccaactaaggggtagttggaagaataaccctttagcagaaactcttgtattataattttataagaagtgaaatccatagatgttgagaataggcgcctaggaaatatttttaaaatgacgttattaaccttgattaccttcatcttgtttagtcgttcaatacgaagcacgttgagcagaacaacacaatggatatggtaacattatgaagcatgtattctagacatggttttaatcaaagtttgcaatttaagatatatgatgttgcattttttttgtcaaatcggttccatttgctttaaaaactagaactggtattatactattatctcatgtaatatgttacaaggttttgcattaaattttaatcatatttcttgaaaaac

SEQ ID NO: 1573 - DNA, 764 bp, Lactuca sativa
agtgatcgtggatttgcttattcgtgcgtctaatcaatggatcctccaccagaaccagttacctatatctgcggagattgtgggcaagaaaacaccttaaaagttggtgatgtgattcaatgccgagaatgtggttatcgtatcctatataagaagcgaacccgtagaagtaagtcatctcatctgtgttacttatcctttatgtaattgcaaaacttgtaaaaggtatgagtctcaggagttgcaatgtgggagtttcagttccaatgtggaatgtggattgaactccttatgaagactagactcttatgtcagccacccaggagacaattgtgtacttgattgacatctcacatgatgctcattgggcagtgtgggccaactaaggggtagttggaagaataaccctttagcagaaactcttgtattataattttataagaagtgaaatccatagatgttgagaataggcgcctaggaaatatttttaaaatgacgttattaaccttgattaccttcatcttgtttagtcgttcaatacgaagcacgttgagcagaacaacacaatggatatggtaacattatgaagcatgtattctagacatggttttaatcaaagtttgcaatttaagatatatgatgttgcattttttttgtcaaatcggttccatttgctttaaaaactagaactggtattatactattatctcatgtaatatgttacaaggttttgcattaaattttaatcatatttcttgaaaaac

SEQ ID NO: 1574 - DNA, 215 bp, Orobanche aegyptiaca
cctagccccttttcaaaacgaccgtaaaacctaatttctacagtctctgattatcgccgttcgattaacaatggatcctcagcctgagccagtcagctacatctgcggagactgcggtcaagagaatacgttgaagccaggggatgtgattcagtgccgtgaatgtggttaccgtattctctacagaacgaccgcagatgtcagtatgaagctcg

SEQ ID NO: 1575 - DNA, 720 bp, Solanum tuberosum
gctgcgcccctgtttcttggctgcataaaaagaagatctttcttattactactcctcttgggccctataaaaagggcagaactaaaattttgagctctgtctaaactctaaagtaatctctcatgctgataaaatttgaaattagaggcaaatgcagcagcctatattaaaccgtttaactgaatcagtgttttcgacattgaacatgtatgtacctgtaatccaatacaaagcatcaatcattcaattgtgcgtttgcctcagcctgagaccttatcttcagctttgatttccaaaagtaggattttctttttggtaagatcgatgttgtcatacttcaatttgatcactgcctgttttggccttaacttaagctaacgcgggaaccagagagaccgagatcgtgaaagggcacaagccaggggaaaccacaagtccaagacacctaaaaatgatggattaacccctgaacaacgacgagaaagggatgcaaaggcacttcaagagaaggcgaaaaagaaagcagcacaggcgggagatggatggaacatagacaaatcggaaagtcataacatcaagaagaaatagttgggaaatgagtaaaaagggggcatgagttatagattcttgaggttcatgtgtctggcatgtatgtttggcttttgtaccctttcatttgtgtcttgatctgcaatgaaatttcctcttgtgattactctt

SEQ ID NO: 1576 - DNA, 349 bp, Solanum tuberosum
cttaacttaagctaacgcgggaaccagagagaccgagatcgtgaaagggcacaagccagggaaaccacaagtccaagacacctaaaaatgatggattaacccctgaacaacgacgagaaagggatgcaaaggcacttcaagagaaggcgaaaaagaaagcagcacaggcgggagatggatggaacatagacaaatcggaaagtcataacatcaagaagaaatagttgggaaatgagtaaaaagggggcatgagttatagattcttgaggtcatgtgtctggcatgtatgtttggcttttgtaccctttcatttgtgtcttgatctgcaatgaaatttcctcttgtgatt

SEQ ID NO: 1577 - DNA, 493 bp, Solanum melongena
ttaataaccaaattattataaagcttgtgctcaaatttcaatctgaggctaacaaattctcctccataggatttttatctagagctatttgacctttgatctttgcttggctgtcggagaatcaagaatgtctcgcgggaaccagagagaccgagatcgtgaaagggcacaagccagggggaaccacaagcccaagacgcctaaaaatgatggattaacccctgaacaacgacgagaaagggatgcaaaggcacttcaagaaaaggcgaaaaagaaagcagcacaagcggcaggtggatgcaatattgacaaaccggaaggtcatattatcaagaagaaatagttggcatgagttatggattcttgaggtcattgttcatcatgtcatttccgaacctttttatctcagtaattcttgtgtctggcatgtatgtttggattttgtacctttgatttgtgtcttgttctgcaatgaaatttcctattcccatcg

SEQ ID NO: 1578 - DNA, 719 bp, Solanum tuberosum
gctgcgcccctgtttcttggctgcataaaaagaagatctttcttattactactcctcttgggccctataaaaagggcagaactaaaattttgagctctgtctaaactctaaagtaatctctcatgctgataaaatttgaaattagaggcaaatgcagcagcctatattaaaccgtttaactgaatcagtgttttcgacattgaacatgtatgtacctgtaatccaatacaaagcatcaatcattcaattgtgcgtttgcctcagcctgagaccttatcttcagctttgatttccaaaagtaggattttctttttggtaagatcgatgttgtcatacttcaatttgatcactgcctgttttggccttaacttaagctaacgcgggaaccagagagaccgagatcgtgaaagggcacaagccaggggaaaccacaagtccaagacacctaaaaatgatggattaacgacgagaaagggatgcaaaggcacttcaagagaaggcgaaaaagaaagcagcacaggcgggagatggatggaacatagacaaatcggaaagtcataacatcaagaagaaatagttgggaaatgagtaaaatgggggcatgagttatagattcttgttcatcgtgtcatttcaagtgtctggcatgtatgtttggcttttgtacctttgatttgtgtcttcatctgcaatgaaatttccttcttgtgattactctt

SEQ ID NO: 1579 - DNA, 370 bp, Solanum phureja
tataaacttctcttctcccacgaactcctcacttctccaatttaattaattaataatcaaattattaaacctctgtgctctaatttcaatcttaagctaacaaattatagtccatagttcaatcagatttttgtttagagctatttgtctttagatctgtgctttgctgttggagaatcaagaatgtctcgcgggaaccagagagaccgagatcgtgaaagggcacaagccaggggaaaccacaagtccaagacacctaaacatgatggattaacccctgaacaacgacgagaaagggatgcaaaggcacttcaagagaaggcgaaaaagaaagcagcacaggcgggagatggatggaacatagacaaat

SEQ ID NO: 1580 - DNA, 933 bp, Solanum phureja
tataaacttctcttctcccacgaactcctcacttctccaatttaattaattaataatcaaattattaaacctctgtgctctaatttcaatcttaagctaacaaattatagtccatagttcaatcagatttttgtttagagctatttgtctttagatctgtgctttgctgttggagaatcaagaatgtctcatatccttctgatatgtttctttcttttctctgattatttaaaaattagagctttttctagtgtaatctcattctctttccgtcccaatccaagtgttttagtttgataggatatttttgagatattattgtccctgtcatcgtattttggagatattggtactgctgccgttatactttggggacgttgatgttcctgttctttcatgcatatatgttctaatttatggacattaatgtattaatgtttcaaaagaatgatggagaatatttgcataccagtttggggatatatttgtgcttttttcctaaaataaaagaactttttgctcctgttggttgctaaaaagggggcggaagtaaaattttagcttaagtctaaagtaatgtcaagctgattcgaggcaaatgcagcctaacattgaacatgtatgtacctgtaatccaatacaaagcatcaatcattcaattgtgcgtttgcctcagcctgagaccttatcttcagctttgatttccaaaattcaatttgatcactgcctgttttggtcttaacttaagctaacgcgggaaccagagagaccgagatcgtgaaagggcacaagccaggggaaaccacaagtccaagacacctaaacatgatggattaacccctgaacaacgacgagaaagggatgcaaaggcacttcaagagaaggcgaaaaagaaagcagcacaggcgggagatggatggaacatagacaaat

SEQ ID NO: 1581 - DNA, 3987 bp, Arabidopsis lyrata
acaacgaggtcggaaccgaccagtcacggtcttctctctgcttttctctgttcggttggtttcacgtaaaaaataaaactttgaggttcaatggtaggaggtggaacaaagagaagaagaagaagattacaactaagtaagttatatacactaacatgtgctcaagcatgttttaagcaagaccattctcaaatcggaggacctggtttctctcgtgttgtgtattgtaatgaacctgattcacctgaagctgattcaagaaactactgtgataattatgtgaggactactaagtatactcttgctacttttttacctaaatcactgtttgagcaatttaggagagttgccaatttttactttttggttactgggatcttggcttttactcctcttgctccttatactgcttcgagtgctattgttcctcttcttttcgttattggtgctactatggttaaagaaggtgttgaagattggcgccgccaaaagcaggataatgaggtgaataataggaaagttaaagtgcatagaggcgatgggagtttcgattcgaaggagtggaagactttgagtattggagatatagtgaaggtagagaagaacgagtttttcccggcggatcttgtgttgctctcttctagctatgaagatgctatttgctatgtagagacgatgaaccttgatggggagactaatcttaaagttaagcaaggacttgaagtaacttcgtccttgcgtgacgagtttaacttcaaggggtttgaggcttttgtcaaatgcgaggatccaaatgctaatttgtattcttttgttggaaccatggagcttaggggagccaaataccctctctcactgcaacagcttcttctgagagactcaaaactcaggaacacagatttcatctttggagcggttatcttcacgggtcatgacacaaaggttattcagaattcaacagatcctccatctaagagaagcatgattgaaaagaagatggataagattatctacctaatgttcttcatggtggttactatggcatttattggttctgttatctttggagttacaacaagagatgatttcaaggatggtgtgatgaagagatggtacttgagaccagatagctccaggatcttctttgaccccaaaagggctcccgttgctgcggtctatcattttctaaccgcgattatgctatacagttatttcattcctatatccttatatgtctcaatagagattgttaaagttcttcagagcatcttcatcaaccaggatattcacatgtactacgaggaagctgacaagccagctcgtgcgcgaacctctaacctgaatgaagagcttgggcaagtggatacaattctctcagacaagacgggaacattgacgtgtaactccatggagttcatcaagtgttctgttgcagggacagcttatggtcgtggtgttacagaggtggagatggctatggggacgagaaaaggtggtcctttggtgtttcaaagcgatgagaatgatatggaatatagtaaagaggcaattactgaagaatcgacggtgaaaggattcaactttagagatgaaaggataatgaatggaaattgggtcactgaaactcatgctgatgtcattcagaagtttttcagattacttgcggtatgtcatactgtgatacctgaagtggatgaagatacagagaagatctcttatgaagctgagtcgcccgatgaagcagcattcgttattgcagcaagggagcttgggtttgaattttttaacagaactcaaactaccatatcggtaagagagctcgatctggtgagcggcaaacgagttgaaaggttgtacaaagtcttgaacgttcttgagttcaacagcacgaggaaaagaatgtcagttgttgtgcaggatgaagatggaaaactcttattactttgtaaaggagcagataatgttatgtttgaaagactttccaagaatggtagagagtttgaagcggaaacacgggaccatgtgaacgagtatgctgatgcagggttgagaactttgatacttgcatatcgtgaacttgatgagaaagaatacaaagttttcaatgaaagaatcagtgcagccaagagttcagtgagtgctgatcgagaatcgctgatagaggaagtcaccgagaaaatcgagaaagacttgattcttcttggagctactgctgttgaagataaacttcaaaatggagtccctgattgcattgacaagcttgctcaggcaggaataaagatttgggttttgactggtgataaaatggagactgctatcaatattggattcgcttgtagtttgctcagacaagacatgaagcagatcataatcaacttggagacccctgaaatccattcactagaaaaaaccggagaaaaagatgtcattgcaaaggtatcaaaagaaaatgtcttgtcgcagataattaatggaaaggctcagttaaagtattctggtgggaactctgatgcttttgctttaatcattgatggcaaatcacttgcttacgcgttggatgatgatataaagcacatcttcctggagctagctgttggttgcgcgtctgtcatttgctgccgttcatcaccaaaacagaaagccctggtgacaagactagtaaaatctggaaacggtaaaacgacattagcaattggtgatggtgcaaatgatgttgggatgcttcaggaagcagatataggtgttggtattagcggtgtggaaggaatgcaggctgttatgtccagcgacattgcgattgctcaattcagatatctggaacgtttgttactagtccatggacattggtgttacaggcggatctcgacaatgatttgctacttcttctacaagaacattacattcggtttcacactcttcttatatgaaacatacacaacgttctcatcgacacctgcctacaacgactggtttctatctctttataatgtctttttctcgtcccttccggttattgctcttggtgtcttcgaccaggatgtctctgcacggtattgtctaaagtttccgctgttataccaagaaggtgtacaaaatgttttgttcagctggcgcaggatacttggctggatgttcaacggattttacagtgcagttatcattttcttcctctgcaaaagttctctccaatctcaagcttttaaccacgatggaaaaaccccgggaagagaaatactaggcgggacaatgtacacatgcattgtctgggttgtgaatttgcagatggcattggctatcagttacttcactctgatccagcacattgtgatttggagctccattgtcgtttggtactttttcatcatggtgtacggagaacttccatcaagaatatcaaccggtgcatataaagtctttgttgaagctctcgcaccttcactttcttactggctcattaccctctttgtggttgtagcgacattgatgccatacttcatctactctgcacttcagatgagttttttcccaatgtaccatggtatgatacagtggctaaggtacgagggtcagtgtaatgaccctgagtactgtgatatggtaaggcaaagatcaataaggcctacaacagttgggttcaccgcaagattagaagctaaaaagagatcagtgaggatctctgagcctgcatcatgacaacggaaactaaccaaacatcaacctgactcgcagaacgtaaatagaaccataaatatatggaagtaagaagctttcttgcttcagactggatcgataaaggctgtccaaccagttgttgtacattctgattcttgcggccttgcctggttacgaaaggagatcttacagttaagtccagtgaattgtgtttacagaacagctgaagatgattatacatcggagtctcagtagagagatttccaattgtcttttctcttcattttctcttccaagattgccattagtccttta

SEQ ID NO: 1582 - DNA, 3866 bp, Arabidopsis lyrata
ggtgttgaaattgagagacaatggcgacagtgagtggaaggagacgcaaaaggaagatacaatttagcaagcttttcacattgacaggtgctaaagcttgtttcaagccagaccattcgaaaattggacgatctggtttctctcgtgtggttttctgcaaccaacctgattcccctgaagctgaatcaaaaaactactgtgacaactatgtgaggaccactaagtatactctcaccactttccttcctaaatcattgtttgagcagttcaggagagttgccaatttctacttccttgttgttgggatcttgtcttttactcctcttgcgccatataccgctgtgagcgccattgttccgctgactttcgtcattctcgctactatgtttaaagagggtgtagaagattggcgccggaaacagcaggatattgaagtgaatagcagaaaagttagagtgcaccgaggcaatgggaatttcgatcttagggaatggaagacactaagagttggggatatattgaaggtagagaaaaacgagttttttccggcagaccttgtcctgctttcttctagctacgaggatgctgtttgctatgtagagacaatgaaccttgacggggaaacaaatctgaaacttaaacaaggactagaagtaacattgtcattgcgtgaagagctcaatttcagggattttgatgcttttatcaaatgtgaggacccgaatgctaacttatactcgtttgttggtactatggatcttaagggagcaaagtaccctctctcaccacagcagcttcttctgaggggctcaaaactcaggaacacagactatatctatggggttgttatcttcacaggacctgatacaaaggttgtccagaattcaacagagcctccgtctaagagaagcatgatcgagaggaagatggataagattatatacctgatgttccttatggtattttcattagctttttttggttcggttttatttggaatatcaacgagagatgatttccagaatggcgtaatgaaaagatggtatctgaaaccggatgattccagcatcttctttgacccaaagagggcacctatggctgcgatatatcactttctaacggccctaatgttaaacagttattttattcctatatccttgtatgtgtcgatagagattgttaaagttcttcagagtatcttcatcaatcaggatatccatatgtattatgaggaagctgacaaaccagcgcatgcacgtacttccaatctaaatgaagaacttgggcaagtgggtacaattctttcagataagacgggaacattgacttgtaactccatggagttcatcaagtgttctattgctgggacagcctatggacgtggtgttacagaggtggagatggctatggataggagaaaaggttctgctttggtgaatcagagcaatggaaatagtactgatgatgctgttgctgcagaaccggctgtgaaaggattcaactttagagatgaaaggataatggatggaaactgggtcacggaaacgcgtgctggtgtcattcagaaattctttcaattactggcagtatgtcatacagtcatacctgaagtggatgaagatacaggaaagatctcctacgaggctgaatcaccggatgaggcagcatttgttattgcagcaagggagcttgggtttgaatttttcactcgaactcaaacaacaatatccgtcagagagctagacctggtgactggggaacgagttgaaaggttgtataaagtcctgaacgttcttgaattcagtagctcaaggaaaagaatgtcagtaatagtgcaggatcaagatggcaaactgcttttactttgtaaaggggcagacagtgtcatgtttgaaagactttccgaaagcggtagaaagtatgaaaaggaaacccgggaccatgtgaacgagtatgctgatgctggattgagaactttgatacttgcctatcgtgaactcgacgaaaatgaatacgaggtattcactgagagaatcagtgaagccaagaattcagttagtgctgatcgagaagcactgatagatgaagtaacagagaagattgaaaaaaacttggttcttcttggagctactgctgttgaggataaacttcaaaatggggtccctgattgcattgataagcttgctcaagcaggaataaagatttgggttttgactggagacaagatggagactgccatcaatattggctttgcttgtagtttgctcagacgagacatgaagcagatcataattaacttggagactcctgaaatccagcagttggaaaaatccggagagaaagatgccattgcagcggctttaaaggaaaatgtactgcatcagataactagtggaaaggctcagctgaaagcgtctggtggaaacgccaaggcttttgctttaatcattgatgggaaatcacttgcttatgcattggacgaagatatgaaaggcatcttccttgagctggccattggttgtgcttcagtgatttgctgccgttcatcaccaaaacagaagacactggtaacaagactagtcaaaactggaagtggtcagacgacattggcaattggtgatggcgcaaatgatgttggaatgctccaggaagcagatataggagttgggatcagcggcgtggaaggaatgcaggctgtaatgtccagcgacattgccattgctcagttcagatatctggagcgtttattactggtccatggacactggtgttacagacggatcgcaaaaatgatttgttatttcttctacaagaacatcacatttggtttcactctcttcttatatgaggcatacacatcattctcagcgacaccggcttacaatgactggtatctatctctatatagtgtccttttcacgtctcttcctgtaatttgtttgggcatcttcgaccaggatgtatctgcaccgttttgtctcaagttccccgtattgtaccaagaaggtgtacaaaatctcctttttagttggcgccggatactcagctggatgttccatggcttctgcagcgcaataatcattttctttctctgcaaaacctctcttgaatctcaagctttcaaccacgaagggaaaaccgcagggagagatattctagggggaacaatgtacacatgtgtggtgtgggttgtgagtttgcagatggtcttgacgatcagttacttcacactaatccaacatgtcgtcatttggggatccattgttatatggtacctttttctgatggtgtacggatcccttccaataagagtatctacagatgcctatatggtctttcttgaagctcttgcgcctgcaccttcttactggatcaccactctctttgtagtgctatccacaatgatgccttacttcatcttctgtgctattcagatgaggtttttcccaatgtcccatggaaccatacagctgcttagatacgaggatcagtgcagcaactctgggaactttgaaatggggaggcagagatcagtaaggcctacattggtcatgaggtctcatcagccagaatcttgataattgatgaacgaataccgatatttatctcctcagatgatttgggctttagtgactttgcaggatgtaaataagactaatcaaagtgtagactggaggagatccggtacaagactgaagaacagaggctctttaactggtttgtatagcataagcgtgtaaattctgattattgcggccttgaccagtaaaaataaaacaagagtttatagagtttgtctgtcaagaaacatctaattatattagaaatcaggggaagattttcagtttagataagagcagacaaaa

SEQ ID NO: 1583 - DNA, 3886 bp, Arabidopsis thaliana
atggcgacagtgagtggaaggagacgcaaaaggaagatacaattaagcaagcttttcacattaacaggtgctaaagcttgtttcaagcctgaccattcgaaaattggacgatctggtttctctcgtgtggttttctgcaaccaacctgattcccctgaagctgaatcaaggaattactgtgacaattatgtgaggaccactaagtataccctcgccactttcctccctaaatcattgtttgagcagttcaggagagttgccaatttctacttccttgttgttgggatcttgtcttttactcctctggcgccatataccgctgtgagcgccattgttccgctgacgttcgtcattctcgctactatgtttaaagagggtgtagaagattggcgccggaaacagcaggatattgaagtgaataacagaaaagttagagtgcaccgaggcaatgggaattttgatcttagggaatggaagacactaagagttggggatatattgaaggtagagaaaaacgagttttttccggcagaccttgtcctgctttcttctagctacgaggatgctgtttgctatgtagagacaatgaaccttgacggggaaacaaatctgaaacttaaacaaggactagaagtaacattgtcattgcgtgaagagctcaatttcagggattttgaggcttttatcaaatgtgaggacccgaatgctaacttatactcgtttgttggtactatggaccttaagggagaaaagtaccctctctcaccacagcagcttcttctgaggggctcaaaactcaggaacacagactacatctatggggttgttatcttcacaggacctgatacaaaagttgtccagaattcaacagatcccccttctaagagaagcatgatcgagaggaagatggataagattatatacctgatgttccttatggtattttcattagcattttttggttcagttttatttggaatatggacgagagatgatttccagaatggcgtgatggaaagatggtatctgaaaccggatgattccagcatcttctttgacccaaagagggcgccaatggctgcaatatatcactttctaacggcgctaatgttaaatagttatttcattcctatatccttgtatgtgtcgatagagatcgttaaagttcttcagagtatcttcatcaatcaggatatccatatgtattatgaggaagctgacaaaccggcacatgcacgtacttccaatctgaatgaagaacttgggcaagtgggtacgatactttcagataagacaggaacattgacttgtaactccatggagttcattaagtgttctattgctgggacagcctatggacgtggtgttacagaggtggagatggctatggataagagaaaaggttctgctttggtgaatcagagcaatggaaatagtaccgaggatgctgttgctgcagaaccggctgtgaaaggattcaactttagagatgaaaggataatggatggaaactgggtcacggaaacgcatgctgatgtcattcagaaattctttcaattactggcagtatgtcatacagtcatacctgaagtggatgaagatacaggaaagatctcctacgaggctgaatcaccggatgaggcagcatttgttattgcagcaagggagcttgggtttgaatttttcactcgaactcaaacaacaatatccgtcagagagctagacctggtgactggggaaagagttgaaaggttgtatagtgtcctgaacgttcttgaattcagtagctcaaagaagaggatgtcagtaatagtgcaggatcaagatggcaaactacttttactttgtaaaggggcagacagtgtcatgtttgaaagactttccgaaagtggtagaaagtatgaaaaggaaacccgggaccatgtgaacgagtatgctgatgctggattgagaactttgatacttgcctatcgtgaactcgacgagaatgaatacgaggtattcactgagagaatcagtgaagcaaagaattcagttagtgctgatcgagaagcactgatagatgaagtaacagagaagattgagaaaaacttggttcttcttggagctactgctgttgaggataaacttcaaaatggggttcctgattgcattaataagcttgctcaagcaggaataaagatttgggttttgactggagacaagatggagactgccatcaatattggcttcgcttgtagtttgctcagacgagacatgaagcagataataattaacttggagactcctgaaatccagcagttggaaaaatccggagagaaagatgccattgcagctttaaaggaaaatgtactgcatcagataactagtggaaaggctcaactgaaagcgtctggtggaaacgctaaggcttttgctttaatcattgatgggaaatcacttgcttatgcattggaggaagatatgaaaggcatcttccttgagctggccattggttgtgcttcagtgatttgctgccgttcatcaccaaaacagaaggcactggtaacaagactagtcaaaactggaagtggtcagacgacactggcaattggcgatggcgcaaatgatgttggaatgcttcaggaagcagatataggagttgggatcagtggcgtggaaggaatgcaggctgtaatgtctagcgatattgccattgctcaattcagatacctggagcgtttgttactggtccatgggcactggtgttacagacggatctcaaaaatgatttgttatttcttctacaagaacatcacatttggtttcactctgttcttatatgaggcatacacatcattttcagcgacaccggcttacaatgactggtatctatctctatatagtgtctttttcacgtctcttcctgtaatttgtttgggcatcttcgaccaggatgtatctgcaccgttttgtctcaagttccccgtattgtaccaagaaggtgtacagaatctcctatttagttggcgccggatactaagctggatgttccatggcttctgcagcgcaataatcattttctttctgtgcaaaacctctcttgaatctcaagctttcaaccacgaagggaaaaccgcagggagagatattctagggggaacgatgtacacatgtgtggtgtgggttgtgagtttgcagatggtcttgacgatcagttacttcacattgatccaacatgttgtcgtttggggatccgttgttatatggtaccttttcctgatggtgtacggatcccttccaataagaatgtctacagatgcctatatggtcttccttgaagctcttgcacctgcgccttcgtactggatcaccactctctttgtagtgctatcgacaatgatgccttacttcatcttctctgctattcagatgaggtttttcccaatgtcacatggaaccgtacagctgcttagatacgaggatcagtgcagcaactctgggaactttgaaatggggaggcagggatcagtgaggcctacactggtcatgagatctcatcagccagaatcttgataactgatgaacgaataccgatatttatctcgtcagatgatttgggctttagttactttgcaggatgtaaataagctaatcaaactttagactggaggagatccggtacaagactggaagaacagaggctctttaactggtttgtatagcataaaaaagaaaacaagagtttatagagagttctgattattgcggccttgaccagtaaaaataaaacaagagtttatagagtttgtatgttaagaaacatctaattatattagaaaatagaggaagactatacatcagtttagatcagagcagataaaagatatacagtaactttgtcttc

SEQ ID NO: 1584 - DNA, 2153 bp, Arabidopsis thaliana
aaaatatcataaggctgagagcttatcagagaagaagaagatatttctgtaagcgagaaaaatggcgagagaacatgcgatcggagaagccaccggaaaacgaaagaaacgcggcagagttgaagaagcagaagaatactgtaacgatggaatcgaagaacaagtagaggatgagaagcttccgttagaggttgggatgttctattacccaatgactccgccttcgttcattgtttccgatgctctggagccagattttcctttgatctatgtcaacagagtcttcgaagtcttcactggctatcgtgccgatgaagttcttggtcgtaactgtcgattcctacagtacagagatcctcgagctcaaaggcgtcacccattggttgatcctgtggttgtatctgagattaggagatgtcttgaagaaggtattgaattccaaggagagcttcttaatttcagaaaagatggtactcctttggttaacagactacggcttgctccaatacgtgacgatgatggaaccattacacacgtaattgggatacaggtcttctctgaaacgactatagaccttgaccgtgtctcgtatcctgtgttcaaacataaacaacagcttgatcaaacatctgagtgcttgtttccaagtggaagcccgaggtttaaggagcatcatgaagatttctgtgggatattgcagctatctgatgaagttttggctcataacatcttatctcggttaactccaagggacgttgcttcaattggttctgcttgcaggaggttgaggcagttgacgaagaacgagagtgtgaggaagatggtatgtcagaatgcgtggggaaaagagataactggaacactggagattatgactaagaagctaagatggggtcggttagctagagagctcaccactcttgaagctgtgtgttggcgtaaatttactgttggagggattgtacaaccttcccgctgcaatttcagcgcgtgtgctgttgggaaccggcttgtgctatttggtggggaaggggttaacatgcagccattggatgatacttttgttctcaatcttgatgcagagtgtcctgagtggcagcgtgtgagggtgacgtcgtcgcctccaggacgttggggacacacactctcgtgtctcaacgggtcgtggttggtagtctttggagggtgtggaagacaaggattgcttaatgatgtatttgtgcttgatctagacgctaagcatcccacatggaaggaagtagcaggaggaactcctccattgccaagatcttggcacagctcgtgcaccattgagggctctaaactggttgtctcaggtggctgcacagacgctggagtgcttctcagcgacaccttcttgttggatctgacaacagataaaccgacatggaaagagatcccgacatcatgggctcctccttctagacttgggcattctttatcggtctttggtcggactaaaatcctaatgtttggcgggcttgcaaatagtggtcatctaaagctaaggtcaggggaggcatacactatagacttggaggatgaagaaccaagatggagagagcttgagtgtagcgcattcccaggcgtggttgtaccgcctccaagactagaccatgtggctgtgagcatgccgtgtggtagggtcatcatctttggagggtcgattgcagggcttcactctccttcgcaactgtttctaatagatcctgcagaagagaaaccgtcatggaggatcctgaatgtccccgggaaaccgcctaagttagcttggggacatagcacatgcgttgttggaggaactagagtattggtccttggtggtcacactggtgaggaatggatactcaatgaattacatgaactctgcttggctagccggcaagactcggatctgtaaagactctttccttcttcatttggtttgtggttttgtatctgtcacattccaaactcttacgacatgtagaagagatatatcagaagctagaagcgtgtgtacatagtaaattagtgattgttgtacgctttagatagatattcatgtaatgttaatggttttgctgtatgaagatccttctataatatacttctccttgttactcgaccatgcaggatttgatttttgacgt

SEQ ID NO: 1585 - DNA, 3997 bp, Arabidopsis lyrata
agagcttgaagacgacgacgatgatcgagcctttaaataaccttctcttctcgtcaacgcgtttccttcttctccacctcctctcctgtttatggtggatgggagttggatatcctcttccacttccgccggacaagaaccgtcgggaggttaataaaccgccggatattgcgtcgacttcttcctcctccgcttcggcggtgaatgctcggttgtccgatgctcccattcttttgtttgtttacttccacaaggctttccgtgcgcagctagcggagctccactttctggccggtgataccgtccggtccggttccgatctagcggtggagctccggtataagtttgattttcttaagcttgtatataagtatcattccgcagctgaagatgaggttatattttcagctttggacactcgtgtgaagaacattgttttcaattactcgcttgaacatgatgccacagatgatcttttcacttctgtttttcattggctaaatgttcttgaagaggagaaagggaacagagcccatgtacttcgtgaagttgttttatgcattggcacaattcagtcatccatatgtcaacatatgcttaaagaagagcggcaggtgtttcctttgatgattgagaacttctcctttgaagaacaggcatcgttagtgtggcagttcatttgtagtgttccagtgatggtgttggaagaaattttcccttggatgacttctttactctctcccaaggagaaatctgaagttgagaattgtgtgaaagaagttgtcccaaaagaagtcaccttgcaactggttataaactcttggctagttgatgatattccatcttctttgacggctcttacaaagatcatgaaaggagtccagtatgtagaagtgtctgtaaatatgaacaactcttcatcatcaagtgggatgtttcaacgtttttggcagtggagtaaaatgtcattttctagtccaaatacaggacatactttggttcatggtatccagctttggcataatgcaattaaaaaagatttggtagacattcaaaaaggattatgccaattgacatttccaagcctttcgttggacctcaatgtgctcgtggttcggctaaacttccttgctgatgtccttatcttttatagcaatgcattaaagaagttcttttacccagtgtttgaagaaatggtggatcaacaacactcttccttttccaaacaattcaccatagatgaccatgtggaaaacttcaagaagtcactagaccttgaaactagaacagggagtgacaattttgtcataacgcttcaggagaaactggagtccctaatattgacagtaaccaagcagttttctatagaggaaacagaggtattcccaatcatcagcaagaactgcaacattgaaatgcacaggcaactcctatacagaagccttcatgtcctgcctcttggattacttaagtgtgtcataatgtggttctctgctcagttgccagaagatgaatgtcactcaattattcacttcttaagttcggaagattcttttctgaataaaccttttgcacacctcttgttgcagtggtttcgcttcggttattctggcaaaacgccagttgaaagtttctggaatgagctttcctttatgttcaaaccgagatgttccgttgaagaggaacacactgaagaagcttctggatctttcgtccatcaatcacagccgcaactatgcaaaggatctgatccttatttgcttaaaaataagtcctctacctatttccaatcaatggatccacctcttggttacatgaatgaaacaccttactcgagtgcgatgaatcagcaaatacttatcccaggaaagctcaggccacttcaacatcttcctgatatttttggtaacaagaatattggagagcacttaaatatggatttgaaaccaatcgatctgattttcttcttccacaaggcaatgaagaaagatctagactaccttgtatgtggttcagctcggctcgcaacagattgtagcttcctcggggagtttcatcagcggtttcatcttataaagttcttgtatcaaattcactcagatgcagaagatgagattgcatttccagccttggaggcaaagggtaaactacaaaacattagtcagtcatacagtattgatcacgaactggaagtcgaacacctcgacaaagtatcattccttttgaatgagatggctgaattgaacatgttggtactagaccacaagaatgtgaagtatgagaagttgtgtatgagccttcaagatatatgcaaatccattcataagctactgtctgagcatctccaccgagaagaaactgagctctggtgtttattcagagactgcttcactattgcagaacaagaaaaaatcatagcatccatgcttggaagaataagtggagaaatattgcaagatatgattccatggttaatggaatctttgatccctgatgaacaacatgctgtgatgtccctgtggcgacaagcaacaaggaaaactatgtttggtgaatggctaacagaatggtacaattctcatattgtagaagaggaaacagaggaagcaaataaggatccatctgagaattcagatccattagatattgtttggagttatctcgttgaaggagctgctgatgaggacaaagtgagcatttgcagcaaacctctagaagagacagagttaaaaggtctcatgaataagccacttggaaatgcttctcctaataacaagggagaatttggaaacaaagaggagaatcatcgggaaatttcagaaagtaaaaaggtgtgtacaggagctgatgaaaggaagtacaaagaacaaaccgacagcaacgcgcaagcttttcagatgttgcagaatactagccaatctggccatgacagtagatatgagtgcttgttatcaatgagtcaagaagatgtggaggccacaattagaagaatatctcgcgactctgccctggatcctcagaagaaatcatatatcatccagaacttgttaatgagccgttggattgctacacaacggatatacaatcttgaaccatccattctctcaagcaatagggaagcagttcctggtcagaatccatcttatcgagatcctcacaaattgatctttggttgcaaacactacaagagaagttgcaagcttcttgctccgtgttgcaacaagctctacacgtgtatacgatgccatgatgaagaggttgatcacttattggatagaaaacagatcacaaagatgatgtgcatgaagtgcatgataattcagccagtaggtgctagttgctcaaatacttcatgcaattcatcgatgggaaaatactactgcaaaatatgcaagttgtttgacgatgatagggaaatctatcattgtccatactgcaatctctgccggctaggaaaaggactgagcattgactactttcattgcatgaaatgcaacgcttgtatgtcgcgaaccttagtagaacatgtatgcagagaaaagtgcttagaagataattgcccgatttgtcatgaatacatatttacctcaaattctccggtgaaggctcttccatgcggtcacgtgatgcattcaacatgctttcaggagtacacatgttcgcattacacatgccctatttgcagcaagtcacttggagatatgcaggtttactttagaatgttagacgcactgctcgcagaacaaaagatgccagatgaatacttaaaccaaactcagataatactatgtaatgattgtgggagaaagggaaatgctccttaccattggctctatcacaagtgctcttcttgtgcctcctacaacaccagacttttctagttccattctccaattttccttctttgtctttaacaattttttcttttctttttggaagcatttgattttgtatgaaagaaaatattctacatattattaaatctagatgattgttt

SEQ ID NO: 1586 - DNA, 622 bp, Solanum tuberosum
ctccaatggcgaaatccacaaaaattctctcatcaatcctccttctcttcttcattttcactttattttcttcatcaaacgcattaggcggaaaactcggcggaagaacacaaatcaaagacgtgaaaacaaatcaggaaattcaagatctaggtaagtactgcgtcgaagaacacaacagaaatttgcggaaacaaaatggtgctttgagttctttattgagtttttctcaagttgttgaagcagaaaaacaagttgtttctggtgttaaatattacctaaaaatatcagctattgttaaatcatctagttcaccaaaattgttcgatgctgttgtggttgttaaatcttgggagaagaagaaggaggaattgcttacgttttttccttctccttcaccggctacgaaatgaatttgtgatggttgtagtggctaaaagttaaaacttctactagtgctaatgtttaaaatgaggttgttaatctaattttgaagtactttactttgtagcctttttattttataacctattttgagttcacttgtgtactatgtgatgcaataatcaatgaatgacatatgtattagtatgttgttatagataaaaaaaaaaaaaaaaaa

SEQ ID NO: 1587 - DNA, 610 bp, Solanum tuberosum
ctccaatggcgaaatccacaaaaattctctcatcaatcctccttctcttcttcattttcactttattttcttcatcaaacgcattaggcggaaaactcggcggaagaacacaaatcaaagacgtgaaaacaaatcaggaaattcaagatctaggtaagtactgcgtcgaagaacacaacagaaatttgcggaaacaaaatggtgctttgagttctttattgagtttttctcaagttgttgaagcagaaaaacaagttgtttctggtgttaaatattacctaaaaatatcagctattgttaaatcatctagttcaccaaaattgttcgatgctgttgtggttgttaaatcttgggagaagaagaaggaggaattgcttacgttttttccttctccttcaccggctacgaaatgaatttgtgatggttgtagtggctaaaagttaaaacttctactagtgctaatgtttaaaatgaggttgttaatctaattttgaagtactttactttgtagcctttttattttataacctattttgagttcacttgtgtactatgtgatgcaataatcaatgaatgacatatgtattagtatgttgttatagataaaaaa

SEQ ID NO: 1588 - DNA, 625 bp, Solanum phureja
aaaaaaaatccccaatctccaatggcgaaatccacaaaaattctctcatcaatcctccttctcttcttcattttcactttattttcttcatcaaacgcattaggcggaaaactcggcggaagaacacaaatcaaagacgtgaaaacaaatcaggaaattcaagatctaggtaagtactgcgtcgaagaacacaacagaaatttgcggaaacaaaatggtgctttgagttctttattgagtttttctcaagttgttgaagcagaaaaacaagttgtttctggtgttaaatattacctaaaaatctcagctattgttaaatcatctagttcaccaaaattgttcgatgctgttgtggttgttaaatcttgggagaagaagaaggaggaattgcttacgttttttccttctccttcaccggctacgaaatgaatttctgatggttgattgtggctaaaagttaaaacttctactagtgctaatgtttaaaatgaggttgttaatctaattttgaagtactttaatttgtagccttttattttataacctattttgagttcacttgtgtactatgtgatgcaataatcaatgaatgacatatgtattagtatgttgttatagataaatt

SEQ ID NO: 1589 - DNA, 603 bp, Solanum melongena
aattaaaaaaaaaactcctttctcaatggcaaaatccagaaaattcctctcatccatcctacttgtcttcttcattttcaccttattttcttcatcaaacgcattaggcggaaaagtcggcggaagaacacaaatcaaagatgtgaaaacaaatcaggaaattcaagatctaggtaagtactgcgtcgaagaacacaacagacatttacagaaacaaaatggtggtttattgagtttttctcaagttgttgaagcagaaaaacaagttgtctctggtattaaatattacctgaaaatctcagctatttccaaatcatctggttcaccacaaatgtttgatgctgttgtggttgttaaagcttgggagaagaagaaagaattgcttactttttctccgtctccttctccggctacgaagtaaaatttgtggtggttgctagtggctaaaaattaaaaacttctactggtgctaatgtttaaatgatgatgttaatctaattttgaagtgtcttttattttgtagcctttttattttgtaacctattttgagttcacttgtgtactatgtgatgcaataatcaatgaatgatatatctaatcagt

SEQ ID NO: 1590 - DNA, 670 bp, Arabidopsis lyrata
attgaaccctaaaccctaattgatcgttgtgcgataatggagggtctggagaagttttacagcaagatggtgaaagatgcaaaatcggcagtttcttcttcgtcgtcttctctatctgattttgcggataatctgatgcaggacaaacgaggcgccggcagcaatttgacttcatacgacgcaggatccggcgttctagtcaacagacctccgagcggagtttcggtctggacgtgctcaaagttgtgcgctgttttctttgtcgctggagtgtttgtgggttatacccttaagagacgggttcgacgctgggcttctaaattgctcagaagaataaaggatgattaactccaacctctgttttgtcttctactgcgagttttggtactgttatcacataggcattactctatgttccttcttgaatgtgtttcagtaccaatatactgtgcttgaggcaccttgttgatgaaacttttttgtttacttttctgcctctgtgactagtagtagcttgtggtaatggaaagagagattggatcatcttgggaaagacgcgtatattatttcgtatagagtaacttatatttgttattttcatgcctttaggcgggtctatacaaacaggcaagacaatgtttgtgacatagtgtatataatctactttgct

SEQ ID NO: 1591 - DNA, 538 bp, Raphanus sativus
  misc_feature (533)..(533): n is a, c, g, or t
ggagtcaaaccctaaaaccctaaatcgttttggcggatcgatggagggagtagagaagtttttcagcaagatggtgacagatgcgaaatcggcagcttcttcttcctcctcttctctttctgatttcgctgataatctaatccaggagaaacgagccggcggcggcggaaactcgacttcatacgaaagttctggaattttggtcacaagacctcccagtggagtatcgggatggacgtgttcaaagctgtgcgcggttttcttcgtagctggagtgtttgtgggttatacgcttaagaggcgtgtccgaagctgggcttctaaacttctcagaagaatcagggatgattgattaaactacataccctctctctcgtttgcttcttgaatgcgttttagtacccgatttactgttgtgctcaaggaactctttctttcttgtttaatattctcatcctcttgtcacagtttgtggaccgtaatggatatactgattgggatatcacctcgtaaaaaactaacaaaaagtttcncctga

SEQ ID NO: 1592 - DNA, 1183 bp, Arabidopsis lyrata
aggctcactccaactccaactccaactccaactaacaacactcttcttcattcttcttcaatcaatggaatctgaaatcgcctctgagtttcctcccttctgccggatttacaaagacggtcgtgtcgaacgactcatgggcaccgaaaccatccctgcgtcgctagatccaacacacgacgtcgtttcaaaagacgttatatactcaccggaccataacctctccgttcgtctcttcctccctcacaaatccacaaaactcaccgccggtgaaaaactccctctacttatctacatccacggcggagcttggatcatcgaatcacctttctccccaatctaccacaattacctcactgaagttgtcaaatccgctaactgcctcgccgtctcggttcagtaccgtcgtgcaccggaagatccggttccagcttcgtatgaagatgcatggtccgcgattcaatggatcttctctcattctaacggatctggtcctgtggattggattaacaaacacgccgatttcgataaagtttttctcgccggagatagcgccggcggtaacatatcacatcacatggcgatgaaagctggtgaagagaagaatctagatctgaaaatcaaaggtattggtgttgttcatccagctttctggggaacagatccggttgatgaatacgatgttcaagatagagaaacgagaatcggaatcgcggacgtttgggagaaaatcgtgagtccgaatagtgttaacggaacggatgatccgttgtttaatgtaaacggatccgggtcggatttttctggattgggatgtgagaaggttttggttgcggtggccggaaaagatgtgtttgtgaggcaaggtttggcttatgcggcgaagctggagaagagtgagtggaaaggaactgtggaggtggttgaggaagaaggtgaaggacatgtgtttcatttggagaaacctagttctgataaggctttgagattcttgaagaagtttgtcgagtttattattggttgatgaatgttttttttttttttgtgtaaatgttgttgatgatttatgtaatcttgcttttaagacgtaaacacacatgaatttcagactgtgtaagagttatatgatcctgttaaatttgtattattattttcttcacctaatagaaattgtgtaagatat

SEQ ID NO: 1593 - DNA, 565 bp, Arabidopsis lyrata
acataataaaccaaacccaacaaagaaaagaaaatttcaaaaccaaaaaaaaaaaaatgagaactttagaagaatcgaagatctctattgtcttcttgttacttcttctcttctcaatcttcatcagtttcagtcaccaggcaaatgaggtattaccatctgaaggagagaagatgatggtgccattgatggaggagaagtttatggtaatgaatgaaacaagaaggaagcttggaagttttcagatatgttctgtttgtacttgttgtggtggtgctaaaggtctttgcttgccttctccttgttgctatgctattaactgcaacatccctaatagaccctttggttactgttctttcactcccaaaacttgcaattgctttggttgccatatctgagatcttctacttcattgaatgtttgattcagggcaatctaaatcttgcttgattcatctacaagtgtgaaagggaggaaaaaagaagcatatctgttcttggtttggttcttatttttaatttttgtctataatttatttttcagtcttcattaaatttcattacct

SEQ ID NO: 1594 - DNA, 1069 bp, Thellungiella halophila
gagtagaagaaagaaaattaaggcattcgctactttaccaaaatccctcaaaacacataaaccccacaaactctttcacaaagaaaaagaaaatattggtaaagaaaaaagatgagagctttagaagaatccaggatctctattgttttgttgcttctttgcttctcaatcttcatcactttcagtctccaggcgaatgagctaataccatcatctaaagaagaaggagagatgaggatggtgccattaatggaagagaagtttatggtgatgaatgaaacaagaaggaagcttgggagtttccagatatgttcagtttgtacttgttgtggaggtgctaaaggtctttgcttgccttcaccttgttgctatgcaatcaactgcaacatcccaaatagaccctttggttattgctccttcactcccaaaacctgcaattgctttggttgccatatctgagatctttcgttggcagagataagctgaatctcaacatcgtgattcaactgcaagtatgaaagggaagaaaaaaaaagaatgaatatctgttcttggtatggttcttttttttatatataatttattttcagtcttcattaaatttcattacctactatcctcagcaacatcatcatcctcattaattagttatcttgttgcattgccatttaaaaatttagtggagtatcttgttacccttcaaacaagattttttttttttttccttctttcttcaatcaattctatatctgtctctttttttccttcttttgtgtactccaatttgtttctcatgggttagtattgtatcattaggattgtaattgtaacatatttttgggaagagtcaacattttttttgttaaactggcaaatggaagaatataatatgatgatgatgatgatgatgatgatgatgatggtgttgatggtgatggtagtgatgttgaagctgtttaaagttaagcctttgtgatgagtgatatgtcaagaattttaagaaatggatcgagtttagtgctctgttatgctgtactgctctgataagatctaagtgcctgttttcaat

SEQ ID NO: 1595 - DNA, 659 bp, Brassica napus
ccacaactcgttcacagacaaaaaaaaaacgatgagtgctttagaagaatcgaaggtctctattgttttgtggcttctctgcttttcaatcttcttcacttcaagtctccaggcaaacgagctaacaacaccatctaaagaagaaggagagatgaggatggtgccattaatggaggagaagtatatggtgatgaatgaaacaagaaggaagcttgggagtttccagatatgttcagtttgcacttgttgtggaggtgcaaaaggactttgcttgcctttaccttgttgctttgcaatcaactgcaacatcccaaatagaccctttggttattgctccttcactcccaaatcttgcaattgctttggttgccacatctgatatctttcactggatagaggaaagtaaatcgacatcttgatttcatctgcaaagtgtgaaagggaagaaaaaaataaatatgtgttcttggtttggttctttatttttatatttttgttcataattctatattcagccttcattaaattgcattacctactagcttcagcaacatcatcatcctcattaattaattatcttctttttggattgccatctgatagagaaactagggccttttatggaggatcttgttcacacttcaagctagatttgtttt

SEQ ID NO: 1596 - DNA, 758 bp, Brassica rapa
  misc_feature (564)..(564): n is a, c, g, or t
gaaatgtttaacaaataattgagaaagtagctcaagagaagtagcacgaagaaagtgaaagaagagaaagcatcaagtcattcactacttgagcaaaatccctaaaccccacaactctttcacaggcaaaaaaaaaacgatgagtgctttagaagaatcgaagggctctattgttttgtggcttctcttcttttcaatcttcttcacttcaagtctccaggcaaacgagctaacaacaccatctaaagaagaaggagagatgaggatggtgccattactggaggagaagtatatggtgatgaatgaaacaagaaggaagcttgggagtttccagatatgttcagtttgcacttgttgtggaggtgcaaaaggactttgcttgcctttaccttgttgctttgcaatcaactgcaacatcccaaatagaccctttggttattgctccttcactcccaaatcttgcaattgctttggttgccacatctgatatctttcactggatagaggaaagtaaatcgacatcttgatttcatctgcaaagtgtgaaagggaagaaaaaaatanatatgtgttcttggtttggttctttatttttatatttttgttcataattctctattcagctttcatttaatttcattacctactagcttcagcaacatcatcatcctcattaattaattatcttctttttgcattgccatctgatagagaaactagggtcttttatggaggatctttgtcacacttcaagctag

SEQ ID NO: 1597 - DNA, 1014 bp, Raphanus sativus
gagagcattaagtcattcactactttagcaaaatccctaaaccccacaactctttcacaaagaaaaaaaaaagatgagtgctttagaagaatcgaaggtctatatttttttgtggcttctctgcttttcaatcttcttcacttcgagtctccaggcaaatgagctaacaacaccatctaaagaagaaggagagatgaggatggtgccattaatggaggagaagtttatggtgatgaatgagacaagaaggaagcttgggagtttccagatatgctcagtttgtacttgttgtggaggtgctaaaggactttgcttgccttcaccttgttgctttgcaattaactgcaatatcccaaatagaccctttggttattgctccttcactcccaaatcttgcaattgctttggttgccacatctgatatctttcactgtgcagagaaaaaaaagtaaatcaacatcttgatttcatctgcaaagtgtgaaagggaagataagaaggaatatgtgttcttggtttggttctttatttttatatttttgttcataattctatattcagctttcattaaatttcattacctactatcttcagcaacatcatcatcctcattaatttaatatcttctttttgccttgccattatgataaagaaatttgggtctttcatggaggatcttgttcacacttcaagctagatttgtttttctttgcctctcttcaatcaatttatgtatcttttttttctttttccttcttctgtttactccagtttttttctcatgggttagtattttatcaccaggattgtacttgtagcatattttgggaagggtctttttgttttgttttgttaagttggcaattggaactggaagattaatatgatgatgatggtgttgatggtagtgatgctgaagctgcctgttaaagctaagtcttttgtgatgtgatatgttaagattattaagaaatggataaagttaagtaagtagttctctgttctgatctgata

SEQ ID NO: 1598 - DNA, 1688 bp, Arabidopsis lyrata
agtcagcagttgattctaggacggcgacttgacctgacacctgaaaaatccttaccgtgtttgatagtttttcgataaaccctttaaattgtttcatcttctttaaatcttgagattttacaaaacctggcttgctcttgtttttggttttgtgcttataggaaatttggaaacttgtgggatttgattgataagagttgttaagatggcaaatgacgctgctgcgtgtgcagaaagggctacaaatgatatgctgattggtccagattgggctattaacattgaattgtgtgatattatcaacatggatcctagtcaagcaaaagaagctgtgaaagtgctcaagaagcggttaggaagtaaaaactctaaagtccagattcttgcactttatgcattggaaactttaagtaagaattgtggcgaaaatgtgtaccagcttttcattgaccgtgatattttgatagacatggtcaaactagtgaagaaaaagccggacctgaatgtgagggaaaagatactaagtttgttagacacatggcaagaagcttttggtggacgtggaggtcgatacccacaatactacaatgcctataacgatctcaggtctgctggaattgagtttccacctcgaacggaaagcagtctgtcgttctttactccaccgcagactcagccagatgatgatgctgctattcaggcgtcgttgcaaggagatgttgcttctagcctcagcttggaagagattcaaagcgctgagggatcagttgatgttttgatggacatgcttggagcacttgatcccgggaatcccgagagtttaaaagaagaagttatagttgacttagttgagcaatgtcgtacttatcaaagacgtgtaatgactcttgtgaacactacaacagatgaggaacttctgtgtcagggattggcattaaacgataatttgcagcgtgttcttcagcgtcacgatgatatcgcaaaggtcagctctgttccttcaaatggaaggaatactagagctcctcctccagttcagattgccaacatcaatcatgatgttgaagatgacgaatcagatgatgagtttgctcggcttgctcacagaccaccaccaccacctacaatgagaccagtacatggtagtgattcgggtatggtggatttccttagtggggatgtctataaacctcaaggctcctcctcgcagggagtaaagaagcctcctcatgcttcttcttctcctgttttcgatgatgcaagtccacaaagcaaatcctctgaggtaattaggaatcttccacctccgccttcaaggcacaaccagaggcaacagttctttgagcatcaccactcgagtagcggctcagattcctcttacgagggactgacccggaaccttgctttgacaactagtgaaccgaagaaagaagagaaaccagaggatttgcttttcaaagacctggttgagttcgccaaaaccaggtcctccaagcccaacaataggtcgctttgagtcatttgcttgtggctttaccattcaagtttttgtttttttttttggttttcagagagtgatgatgatattagagtgtgccttattttttagagatagtatccgacaataccaacaaccatacgttttacttgtctaacttcacactcaaccgacacagctttaaaatact

SEQ ID NO: 1599 - DNA, 564 bp, Brassica juncea
tacgcggggaaaacaacaacttgtgtagggttcctccttcgtgtctcgatctgctctccctcccaaccagattacagcttccgattgatttttccgacatggcagaggatgaagttgttgatccaaagaagtaccttgaggaatcttgcaaaccaaaatgtgtgaagccactactcgaatatcaggcgtgtgtgaagagaatccaaggtgatgaatctggccacaagcattgcactgggcagtacttcgactactggcattgcattgacaaatgtgttgcacccaagctttttgcgaaactgaaatgaaaacaaggtgaagctggacatggtattgtcttgagtctgcttcgtgtggtttgaaggcgatgtataaaacgcagtagatgttgaataactgcaaacctgaatatgccaaatggcttttgtttctatcgccatgtgcggttattacatttttttgctacagatccttttttaagtaattgcatgcctaataacaagaatttgtctttatcttggtcttaatgtctctcgagagacgaatgaacaaattgatcaggct

SEQ ID NO: 1600 - DNA, 533 bp, Brassica juncea
caagttgttctgtaggtttcctccttcgtctctcgatctgctctccctcccaaccaggttacagcttccgattttgactttcagacatggcagaggatgaagttgttgatccaaagaagtaccttgaggaatcttgcaaaccaaaatgtgtgaagccactactcgaatatcaggcgtgtgtgaagagaatccaaggtgatgaatctggccacaagcattgcactgggcagtacttcgactactggcattgcattgacaaatgtgttgcacctaagctttttgcaaaactgaaatgaaaacaaggtgaagctggacatggtattatcttgagtctgcttcgtgtggtttgaaggcgatgtataaaacgcagtcgatgttgaataactgcaaacctgaatatgccaaatggcttttgtttctatcgtcatgtgcggttattacatttttttgctacagatccttttttaagtaattgcatgcctaataacaagaatttgtctttagaaaaaaaatgtaataaccgcacatggctt

SEQ ID NO: 1601 - DNA, 597 bp, Cleome gynandra
tgtgagagtgatctagagaaatcggaacaaagcattagggttcctctctccgctttctgctacctctattgggttataggtccagcttctgcgatccttgttcgacttttatctcgcgatggcagacgaggaggttgttgacccgaagaagtaccttgaggaatcttgcaagccgaaatgtgtgaagcctctgcttgaatatcaggcatgtgtgaagaggatccaaggtgacgagacaggccacaaacattgcactggacagtactttgattactggcactgcgttgacaaatgtgtcgcacctaagttgtttgcaaagcttaaatgactgagggacaaagcgagatactgtctgtttccatggtttataaataccaactttctgcaaaccagattgtgaaggtccctttggttttgtttcactagaattttgcatttcattttttgcttacagttgactttgtgatatcaactgatatggaaataagagagagacctgattctatgcttattgatctggattacatacatacacttatgttccttctaaacattacgggaggaaaacactgatgtggccaatttcggattctaagt

SEQ ID NO: 1602 - DNA, 434 bp, Cleome spinosa
gggttcctccgacgactctccggtgctctctgctatctctgcccggttatatagctcccgcttctgcgatccgttgtttggccgttttctcgccatggcagatgaagaggttgttgaccagaagaagtaccttgaggaatcttgcaagcccaaatgtgtgaagcctctacttgaatatcaggcttgcgtgaagaggatacaaggcgacgaaactggccacaaacattgcactggacagtactttgattactggcattgcattgacaaatgtgttgcacccaagctgtttccaaagctgaaatgagtggcttgcgtttgtctccgtttccaaaggtttatatttttataaacgcaaaccaaaatgtgagggttggttgcttggttttgatcaattatattttggtaccgttggtggtttcactctgttatgtaat

SEQ ID NO: 1603 - DNA, 367 bp, Prunus persica
atggtcagttctgaatgttcacagtactggatccttccattaatagttggcactggtagttcagtttcttgctctagcgatattacaataatgtattctccaacgcctgtgtgtaaaacctatgatatcgtcgatgttgggctgtttgtcttttgtatggcggacgaggaacctgttgatcaaaagaagtaccttgaagagtcttgcaagccaaagtgtgtcaaaccactactcgagtatcaggcatgtgttaagagaatccaaggtgatgaaagcgggcacaagcattgtactgggcaatatttcgactactggtcttgtgttgacaaatgcgttgcaccaaagcttttcccaaaactgaagtgat

SEQ ID NO: 1604 - DNA, 482 bp, Brassica rapa
  misc_feature (26)..(26): n is a, c, g, or t
ggactcgaaacacaaaacaaatctgnagggttcgttgtctccttaaggtctcgatctcctctccaggacagtttctacaagcttcaaatttgacttctcgccatggcagatgaggaagttgttgatccaaagaagtaccttgaggaatcttgcaaaccaaaatgtgtgaagccactactcgaatatcaggcgtgtgtaaagagaatccaaggtgatgaatctggccacaagcattgcactgggcagtacttcgactactggcattgcattgacaaatgtgttgcacccaagctttttgcgaaactgaaatgaaaacaacgcgattctggacacagtatcttcttgagtttgcttcatgttatttttaagaggatgtataaaacgcagtggatgttgaataactgcaaacctgaatatgccaaatggcttttgtttctatcgccgtctgcggttattacattttttttgctacagattttttg

SEQ ID NO: 1605 - DNA, 714 bp, Castanea mollissima
ccctcatctcttttaaagtcttgactctttgagaatctgagatcgagagagagagagacacacacacagagacagaagcttctatacacaaagagtcaggtgaggtgacccagtaggcttctctgtgctctgagttgttgtttgtcttgtccatatattgctatggcggaagaggaacctgttgatcagaagaaatattttgaagagctttgcaagccaaagtgtgtgaagccattacttgaatatcaggcatgtgttaagaggatccagggagatgaaagtgggcacaagcattgcactggacaatattttgattactggtcttgtgttgacaaatgtgcggcaccaaagatattctcaaaactgaagtaatggggagatgattttgcagcatcttaatttgcatttctactttcaaatcgtaataactgtttctgaacatttaatctgttctgtaaactaggaatgcctatatggttttctccatgaggacttttgcatttttttagctatggagaccttgagttgtggtcaataaaaaagaatactgtgcattagatttggccaatcgcagtgtgtacaaggttttctctccccccacaccccaaaaaaacagaaattgatgaattacgcatgcatccagtgagtgttgaactcaaaaaccttagtctccatcgtaaattaggaaaaagtcaactgtatttttaagaaaaa

SEQ ID NO: 1606 - DNA, 1308 bp, Citrus sinensis
caattggtcaaacataaatcacaggatcctttattaatcataaaccaatgcttccatagtacaaaaccttaggaatcttttccctatccctcccgtatgcaacaatatcagggtctcaaccataaaggaatgactaattgagggtacacaagggtttttgaatctaaaacaaaaaagcatagtacaatgaataacaaaattttactccccatcacttcagtttctgaaatagctttactgcaacgcatttgtcaatacatgaccaataatcaaaatattgcccggtgcagtgcttgtgcccactttcatcaccttgtatcctcttaacacatgcctgatattcaagcaacggtttcacacactttggtttgcatgcttcttcaaaatacttcttctgatcaacaagttcctcatccgccattgcaaatgaagggcaagtaaatgtcaagagagatggctggatcacctttcagggcggagcactttgtataataagagtataactctctctcttcatgtgcgaaagtttgagccattccttttcgctagcttgctcttgagtctcgtgtttttttttctttttacagtcatcctctcgttctcctaagaaattaaaaaagttgtctgctttttatctgagcaacaaatatttctgcctttgaccttgcaacacacacacacacatatatatatatatatacggtttaagatcacatcatcttcttaatttgagcgagatagcagcagatattgtgattggtggtggatgacatatatatctatctgtatatttttgcatgaagatggaagttgagattcatcccaataacaagacggtcgttgagtatcaagaggaatatataaggaatgcaagaggggtgcagctttttacttgcagatggttgcttttctctactccaaaggctgttgtttttctttgccacggttatggcatggaatgcagtggtttcatgagagaatgtggaaccaggctagccagtgctggatatgctgtgtttggtattgattatgaaggacatggtcgatccagaggtgctcgttgttacatcaagaagttcgagaacatcgttaatgactgtgatgattttttcaagtccgtctgtgcacaggaagagtacacggataaggccagattcttgtatggggagtctaatgggaggagcagttacccttctgcttcacaaaaaggacccttctttttggaatggtgctgtccttgttgcaccaatgtgtaagatatcagagaaagtgaagccacatcccgtacttgtgaatatattaactaga

SEQ ID NO: 1607 - DNA, 204 bp, Arabidopsis lyrata
agggcagaagaagaagatgttgatcagaaaagatactttgaggaatcttgcaaaccaaaatgtgtgaagccacttcttgaatatcaggcatgtgtcaagagaattcaagatgatgagtctggccacaaacattgcactgggcagtattttgattactggcattgtgttgacaaatgtgtcgacctaagttgttcgcgagattaa

SEQ ID NO: 1608 - DNA, 236 bp, Artemisia annua
  misc_feature (29)..(29): n is a, c, g, or t
ccctatcatttgcaatggcagacgaagancccgttgatcccaagaagtatcttgaagagtcatgcaagcccaagtgtgtgaagcccttactcgagtatcaggcatgtgtaaaaaggatccaaggcgatgaatctgggcacaagcactgtaccgggcaatatttcgattactggtcctgtgttgacaaatgtgtggctccaaaactatttgataagctgaagtgatatagagacacg

SEQ ID NO: 1609 - DNA, 539 bp, Brassica juncea
caatgaaatgaatctagagaagactgacttcaacaacacaacaagttctgtagggttcctcctccgtgtctcgatctaatctcccttccaaccagtttacagcttccgatttgactttccgacatggcagaggatgaagttgttgatccaaagaagtaccttgaggaatcttgcaaaccaaaatgtgtgaagccactactcgaatatcaggcgtgtgtgaagagaatccaaggcgatgactctggccacaagcattgcactggccagtacttcgactactggcattgcattgacaaatgtgttgcaccaaagctgtttgcaaaactaaaatgattaaaaagccaaggtggagacgaaactgtcttgattctgcttcatgtggtttgaaattgaaaggatgtataaaacgcagtgaatgtttgaatctttttttcgtaactgcaaacctcaatgtgccaaatggctctctgctcctctgttttgtttctataccgcagacattgttattgtgctctcatcatgcctaataacttgaaaaa

SEQ ID NO: 1610 - DNA, 489 bp, Brassica napus
cgcagagtacggcgggaaaacaacaaagttctgtagggttcctccttcgtgtctcgatctgctcttcctcccgaccaggttacagcttccgattttgactttccgacatggcagaggatgaagttgttgatccaaagaagtaccttgaggaatcttgcaaaccaaaatgtgtgaagccgctactcgaatatcaggcgtgtgtgaagagaatccaaggcgatgactctggccacaagcattgcactggccagtacttcgactactggcattgcattgacaaatgtgttgcaccaaagctgtttgcaaaactaaaatgattaaaaagccaaggtggagacgaaactgtcttgattctgcttcatgtggtttgaaattgaaaggatgtataaaacgcagtgaatgtttgaatctttttttcgtaactgcaaacctcaatgtgccaaatggctctctgctcctctgttttgtttctataccgcagacattgtt

SEQ ID NO: 1611 - DNA, 447 bp, Brassica napus
tccttcgtgtctcgatctgctctcccttccgaccaggttacagcttccgatttgactttccgacatggcagaagatgaagttgttgatccaaagaagtaccttgaggaatcttgcaaaccaaaatgtgtgaagccactactcgaatatcaggcgtgtgtgaagagaatccaaagcgatgactctggccacaagcattgcactggccagtacttcgactactggcattgtattgacaaatgtgttgcaccaaagctgtttgcaaaactaaaatgattaaaaagctaaggtggagacgaaaatgtcttgattctgcttcatgtggtttgaaattgaaaggatgtataaaacgcagtgaatgttgaacaactttttttttcataactgcaaacctcaatatgccaaatggctctgctcctctgttttgtttttataccgcagacattgtt

SEQ ID NO: 1612 - DNA, 683 bp, Quercus alba
ggagagagagagagagacagaagcttctatacacaaagagtcaggtgaggtgacccagtaggcttctctgtgctctgagttgttgtttgacttgtccatatattgctatggcggaagaggaacctgttgatcagaagaaatattatgaagagctttgcaagcctaagtgtgtgaagccattacttgaatatcaggcatgtgttaagaggatccagggagatgaaagtgggcacaagcattgcactggacaatattttgattactggtcttgtgttgacaaatgtgcggcacccaagatattctcaaaactgaagtaatgggggagatgattttgcagcatcttaatttgcatttctactttcaaatcgtaataactgcttctgaacatttaatctgttctgtaaactaggaatgcctttatggttttctccatgaggacttttgcatttttttagctctggagaccttgagttgtggtcaataaaaaagaataccgtgcattagatttggccaatcgcagtgtgtacaaggttttctctccccctgcaccccaaaaaagagaaattgatgaattacacatgcatccaatgagtgttgaactcaaaaaaccttactctcccatcgtaaattcggtagaagtacaagaactgtattttaagaaaaaaatgttgacgcttttaaga

SEQ ID NO: 1613 - DNA, 739 bp, Quercus alba
agacaaaggtgagtagagttgccctcatctcttttaaagtcttgactctttaagaatctgagatcgagagagagagagagagagagagacagaagcttctatacacaaagagtcaggtgaggtgacccagtaggcttctctgtgctctgagttgttgtttgacttgtccatatattgctatggcggaagaggaacctgttgatcagaagaaatattatgaagagctttgcaagcctaagtgtgtgaagccattacttgaatatcaggcatgtgttaagaggatccagggagatgaaagtgggcacaagcattgcactggacaatattttgattactggtcttgtgttgacaaatgtgcggcaccaaagatattctcaaaactgaagtaatgggggagatgattttgcagcatcttaatttgcatttctactttcaaatcgtaataactgcttctgaacatttaatctgttctgtaaactaggaatgcctatatggttttctccatgaggacttttgcatttttttagctatggagaccttgagttgtggtcaataaaaaagaataccgtgcattagatttggccaatcgcagtgtgtacaaggttttctctccccccgcaccccaaaaaaaagaaattgatgaattacacatgcatccaatgagtgttgaactcaaaaaaccttactctcccatcgtaaattcggtagaagtacaagaactgtattttaagaaaaaaat

SEQ ID NO: 1614 - DNA, 351 bp, Brassica juncea
  misc_feature (121)..(121): n is a, c, g, or t
  misc_feature (315)..(315): n is a, c, g, or t
agagacatctaaaggaaagactgactcaaaactcaaaacaaatctgtaaggttcgttgtctccttcaggtcttcgatctccgctctaggacagttgtatagcttcagatttgacttttcgncatggcagaggatgaagttgttgatccaaagaagtaccttgaggaatcttgcaaaccaaaatgtgtgaagccactactcgaatatcaggcgtgtgtgaagagaatccaaggtgatgactctggccacaagcattgcactgggcagtacttcgactactggcattgcattgacaaatgtgttgcaccaaagctgnttgcaaaactaaaatgattaaaaagccaaggtggag

SEQ ID NO: 1615 - DNA, 546 bp, Brassica juncea
tggtatcaacgcagagttatgcgggggaaaatagaatcaggacatccagggttcatagtttggcgatcaatcagtgaagcttgcgttcctttctttccaacttcaccatgggcgatgtagaagttgttgatccgaaaaagtgccttgaggaatcttgcaaaccaaaatgtgtgaagccactacttgaatatcaggcctgtgtgaagaggatccaagatgatgagtctggacacaaacattgcactgggcagtattttgattactggcaatgtgttgacaaatgtgtcggacctaagctgtttgcggaactaaaatgatgaaagttggagtattgagtctgtgtcttgtattttttttttttcttctccaggtattatataaaatgcagtggatactgaacattactgcaaaccagattgcaactggttcttcttggttttgcttctctagcaaagctgcgaatcctttgtttgtctgttgggaggaaacttgtattgagtttgtgatgcttcattaatgcgtaataaatgaaaataagaatgcgat

SEQ ID NO: 1616 - DNA, 523 bp, Brassica juncea
caacaagttctgtagggttcctcctccgtgtctcgatctaatctcccttccaaccagtttacagcttccgatttgactttccgacatggcagaggatgaagttgttgatccaaagaagtacctcgaggaatcttgcaaaccaaaatgtgtgaagccgctactcgagtatcaggcgtgtgtgaagagaatccaaggcgatgactctggccacaagcattgcaccgggcagtacttcgactactggcattgcattgacaaatgtgttgcaccaaagctgtttgcgaaacttaaatgatttcaaagcaaagttggtgaggatgttgttttgagtctgcttcatgtggtttgaaaggatgtataaaacacagtggatgttgaacttttttttgtcataactgcaaacctgaatatgccaaatgactctgctcctccgttttgtttctatcgcagttttcggttactatttactaataccacacacattgttattgtgctctcatgcctaataactacaagaatttgc

SEQ ID NO: 1617 - DNA, 292 bp, Brassica juncea
  misc_feature (286)..(286): n is a, c, g, or t
tagggttcctcctccgtgtctcgatctaatctcccttccaaccagtttacagcttccgatttgactttccgacatggcagaggatgaagttgttgatccaaagaagtacctcgaggaatcttgcaaaccaaaatgtgtgaagccgctactcgagtatcaggcgtgtgtgaagagaatccaaggcgatgactctggccacaagcattgcaccgggcagtacttcgactactggcattgcattgacaaatgtgttgcaccaaagctgtttgcgaaacttaaatgattncaaagc

SEQ ID NO: 1618 - DNA, 431 bp, Brassica oleracea
gatccttcgtgtctcgatctgctctcccttccgaccaggttacagcttccgatttgactttccgacatggcagaagatgaagttgttgatccaaagaagtaccttgaggaatcttgcaaaccaaaatgtgtgaagccactactcgaatatcaggcgtgtgtgaagagaatccaaagcgatgactctggccataagcattgcactggccagtacttcgactactggcattgtattgacaaatgtgttgcaccaaagctgtttgcaaaactaaaatgattaaaaagccaaggtggagacgaaaatgtcttgattctgcttcatgtggtttgaaattgaaaggatgtataaaacgcagtgaatgttgaacaactttttttttcataactgcaaacctcaatatgccaaatggctctgctcctctgttttgtttt

SEQ ID NO: 1619 - DNA, 531 bp, Brassica rapa
gaaaacaacaaagttctgtagggttcccccttcgtgtctcgatctgctcttcctcccgacgaggttacagcttccgatttgactttcagacatggcagaggatgaagttgttgatccaaagaagtaccttgaggaatcttgcaaaccaaaatgtgtgaagccgctactcgaatatcaggcgtgtgtgaagagaatccaaggcgatgactctggccacaagcattgcactggccagtacttcgactactggcattgcattgacaaatgtgttgcaccaaagctgtttgcaaaactaaaatgattaaaaagccaaggtggagacgaaactgtcttgattctgcttcatgtggtttgaaattgaaaggatgtataaaacgcagtgaatgtttgaatctttttttcgtaactgcaaacctcaatgtgccaaatggctctctgctcctctgttttgtttctataccgcagacattgttattgtgctctcatcatgcctaataacttgaagaatttgcctctctttcaacctataat

SEQ ID NO: 1620 - DNA, 588 bp, Brassica napus
aacaaagttctgtagggttcctccttcgtgtctcgatctgctcttcctcccgaccaggttacagcttccgattttgactttccgacatggcagaggatgaagttgttgatccaaagaagtaccttgaggaatcttgcaaaccaaaatgtgtgaagccgctactcgaatatcaggcgtgtgtgaagagaatccaaggcgatgactctggccacaagcattgcactggccagtacttcgactactggcattgcattgacaaatgtgttgcaccaaagctgtttgcaaaactaaaatgattaaaaagccaaggtggagacgaaactgtcttgattctgcttcatgtggtttgaaattgaaaggatgtataaaacgcagtgaatgtttgaatctttttttcgtaactgcaaacctcaatgtgccaaatggctctctgctcctctgttttgtttctataccgcagacattgttattgtgctctcatcatgcctaataacttgaagaatttgcctctcatgagttgcacaaaaactgtttgaaaaaactaaaaatgaattaaaaaggcaaggtggagacgaaactggtcttgat

SEQ ID NO: 1621 - DNA, 481 bp, Brassica napus
tccttcgtgtctcgatctgctctcccttccgaccaggttacagcttccgatttgactttccgacatggcagaagatgaagttgttgatccaaagaagtaccttgaggaatcttgcaaaccaaaatgtgtgaagccactactcgaatatcaggcgtgtgtgaagagaatccaaagcgatgactctggccacaagcattgcactggccagtacttcgactactggcattgtattgacaaatgtgttgcaccaaagctgtttgcaaaactaaaatgattaaaaagctaaggtggagacgaaaatgtcttgattctgcttcatgtggtttgaaattgaaaggatgtataaaacgcagtgaatgttgaacaactttttttttcataactgcaaacctcaatatgccaaatggctctgctcctctgttttgtttttataccgcagacattgttattgtgctctcatcatgcctaataacttcaagaa

SEQ ID NO: 1622 - DNA, 609 bp, Brassica napus
ggaatctagagaagactgacttcaacaaaacaacaaggttccgtagggttcctccttcgtgtctcgaactactctccattccgaccaggttacagcttccgatttgactttcagacatggcagaagatgaagttgttgatccaaagaagtaccttgaggaatcttgcaaaccaaaatgtgtgaagccactactcgaatatcaggcgtgtgtgaagagaatccaaggcgatgactctggccacaagcattgcactggccagtacttcgactactggcattgtattgacaaatgtgttgcaccaaagctgtttgcaaaactaaaatgattaaaaagccaaggtggagacgaaaatgtcttgattctgcttcatgtggtttgaaattgaaaggatgtataaaacgcagtgaatgttgaacaactttttttttcataactgcaaacctcaatattgccaaatggctctgctcctcttctttgtttctatgtttctataccgcagacattgttattttgctctctcatcatgcctaataacttcaagaatttgcctctctttgaacaaatcaaattattaggcttcgagtttcaataaaggtagattttcacca

SEQ ID NO: 1623 - DNA, 559 bp, Quercus alba
gttgccctcatctctttaaaagtcttgactctttgagaatctgagatcgcgagagagagacagaagcttctatacacaaagagtcaggtgaggtgacccagtaggcttctctgtgctctgagttgttgtttgacttgtccatatattgctatggcggaagaggaacctgttgatcagaagaaatattatgaagagctttgcaagcctaagtgtgtgaagccattacttgaatatcaggcatgtgttaagaggatccagggagatgaaagtgggcacaagcattgcactggacaatattttgattactggtcttgtgttgacaaatgtgcggcaccaaagatattctcaaaactgaagtaatgggggagatgattttgcagcatcttaatttgcatttctactttcaaatcgtaataactgcttctgaacatttaatctgttctgtaaactaggaatgcctttatggttttctccatgaggacttttgcatttttttagctatggagaccttgagttgtggtcaataaaaaagaatactgtgcattagatttggccaaaa

SEQ ID NO: 1624 - DNA, 534 bp, Raphanus sativus
  misc_feature (75)..(75): n is a, c, g, or t
  misc_feature (222)..(222): n is a, c, g, or t
  misc_feature (247)..(247): n is a, c, g, or t
  misc_feature (291)..(291): n is a, c, g, or t
  misc_feature (306)..(306): n is a, c, g, or t
  misc_feature (314)..(314): n is a, c, g, or t
  misc_feature (429)..(429): n is a, c, g, or t
gggggggaaaatcgaatcacaacaattagggttcatcgtttggcgatcgatcagtgaagcttgcgatcctttatntccaatttcaccatggcggatgtagaagttgttgatccgaaaaagtgcctcgaggaatcttgcaaaccaaaatgtgtgaagccactacttgaatatcaggcgtgtgtgaagaggatccaagatgatgagagtggccacaaacattgnactgggcagtattttgattactggnaatgtgttgacaaatgtgtcggacctaagctgtttgcggaactnaaatgatgggagagnaagttggngtattgagtctctgtcttgtgtttttatttttcacaagggttttatataaaatgcagtggatagtggacactactgcaaaccaggttgcaactggttccttcttggttttgtttntctgggaaagctgtgaatcctttgtttgtctgtcgggaggaaacctttattatgtttgtgatacttcattagtgcctaataaaagaaaagaagaatgcgattaca

SEQ ID NO: 1625 - DNA, 761 bp, Euphorbia esula
  misc_feature (8)..(10): n is a, c, g, or t
  misc_feature (25)..(25): n is a, c, g, or t
  misc_feature (44)..(44): n is a, c, g, or t
gcaacttnnnaatccagaaacaaanatttctctacctccgatcngcgatacaggaatttcctttttgacatcaagtgagttgctgctccatttattttagttcaatggctgatgaggaacctgttgatcagaagaggtattatgaggaagcttgcaagcctaaatgtgtgaagcccctgcttgaatatgaggcgtgcgttaagaggattagaggtgatgagagcgggcacaagcactgcacagggcagtactttgattattggtcttgtgttgataaatgtgtaagtaatcatttcatagttagtacgagttcataaaggcttatgttatgtaacgttgacattatttcctattatttgggtgtttctattaattaggagtcttattattgattaggcagatttacatgttctattgtctagcagttttatattatttaggagtttaattatttaagagtttattgtttaggagtttattattttagggttttattatttgggatttctattaagattctacttcctattttgtagtgaatttgttctatttataggacaacacagttaataaaacattaagcaatattttatcgattaactcatagtgagttcaggagatcggattctctctttaacgaggtccaaggtttcagtctcccttcgacgagctgaaaaggtttcagtctccctttaacgagctgaatattatccaaattagtcctacaagacccgtgacgagatcctattcgtgggcacata

SEQ ID NO: 1626 - DNA, 593 bp, Brassica napus
agagaagactgacttcaacaaaacaacaaggttccgtagggttcctccttcgtgtctcgaactactctccattccgaccaggttacagcttccgatttgactttcagacatggcagaagatgaagttgttgatccaaagaagtaccttgaggaatcttgcaaaccaaaatgtgtgaagccactactcgaatatcaggcgtgtgtgaagagaatccaaggcgatgactctggccacaagcattgcactggccagtacttcgactactggcattgtattgacaaatgtgttgcaccaaagctgtttgcaaaactaaaatgattaaaaagccaaggtggagacgaaaatgtcttgattctgcttcatgtggtttgaaattgaaaggatgtataaaacgcagtgaatgttgaacaactttttttttcataactgcaaacctcaatattgccaaatggctctgctcctcttctttgtttctatgtttctataccgcagacattgttattttgctctctcatcatgcctaataacttcaagaatttgcctctctttgaacaaatcaaattattaggcttcgagtttcaataaaggtaga

SEQ ID NO: 1627 - DNA, 517 bp, Brassica oleracea
ggactcagaactcaaaacaaatctgtagggttcgttgtctccttcaggtctcgatctccgctctaggacagttctacaagcttcaaatttgacttctcgccatggcagatgaggaagttgttgatccaaagaagtaccttgaggaatcttgcaaaccaaaatgtgtgaagccactactcgaatatcaggcgtgtgtgaagagaatccaaggtgatgactctggccacaagcattgcaccgggcagtacttcgactactggcattgcattgacaaatgtgttgcacccaagctttttgcgaaactgaaatgaaaacaacgcgattctggacacagtatcttcttgagtttgcttcatgttatttttaagaggatgtataaaacgcagtggatgttgaatacctgcaaacctgaatatgccaaatggcttttgtttctatggccgtgtgcggttattacatttttttgctacagatttttttaaagtaattccatacctaataacgagaatctgtcttt

SEQ ID NO: 1628 - DNA, 510 bp, Brassica napus
aaaactcaaaacaaatctgtagggttcgttgtctccttcaggtctcgatctcctctccaggacagtttctacaagcttcaaatttgacttctcgccatggcagatgaggaagttgttgatccaaagaagtaccttgaggaatcttgcaaaccaaaatgtgtgaagccactactcgaatatcaggcgtgtgtaaagagaatccaaggtgatgactctggccacaagcattgcactgggcagtacttcgactactggcattgcattgacaaatgtgttgcacccaagctttttgcgaaactgaaatgaaaacaacgcgattctggacacagtatcttcttgagtttgcttcatgttatttttaagagggtgtataaaacgcagtggatgttgaataactgcaaacctgaatatgccaaatggcttttgtttctatcgccgtctgcggttattacattttttttgctacagattttttaaaagtaattgcatgcctaataacgagaatctgtc

SEQ ID NO: 1629 - DNA, 534 bp, Brassica napus
gactgactcaaaactcaaaacaaatctgtagggttcgttgtctccttcaggtctcgatctcctctccaggacagtttctacaagcttcaaatttgacttctcgccatggcagatgaggaagttgttgatccaaagaagtaccttgaggaatcttgcaaaccaaaatgtgtgaagccactactcgaatatcaggcgtgtgtaaagagaatccaaggtgatgactctggccacaagcattgcactgggcagtacttcgactactggcattgcattgacaaatgtgttgcacccaagctttttgcgaaactgaaatgaaaacaacgcgattctggacacagtatcttcttgagtttgcttcatgttatttttaagagggtgtataaaacgcagtggatgttgaataactgcaaacctgaatatgccaaatggcttttgtttctatcgccgtctgcggttattacattttttttgctacagattttttaaaagtaattgcatgcctaataacgagaatctgtctttatcttggtcttg

SEQ ID NO: 1630 - DNA, 508 bp, Brassica napus
agaactcaaaacaaatctgtagggttcgttgtctccttcaggtctcgatctccgctctaggacagttctacaagcttcaaatttgacttctcgccatggcagatgaggaagttgttgatccaaagaagtaccttgaggaatcttgcaaaccaaaatgtgtgaagccactactcgaatatcaggcgtgtgtgaagagaatccaaggtgatgactctggccacaagcattgcaccgggcagtacttcgactactggcattgcattgacaaatgtgttgcacccaagctttttgcgaaactgaaatgaaaacaacgcgattctggacacagtatcttcttgagtttgcttcatgttatttttaagaggatgtataaaacgcagtggatgttgaatacctgcaaacctgaatatgccaaatggcttttgtttctatggccgtgtgcggttattacatttttttgctacagatttttttaaagtaattgcgtacctaataacgagaatctgtc

SEQ ID NO: 1631 - DNA, 528 bp, Brassica napus
cggaccgactcagaactcaaaacaaatctgtagggttcgttgtctccttcaggtctcgatctccgctctaggacagttctacaagcttcaaatttgacttctcgccatggcagatgaggaagttgttgatccaaagaagtaccttgaggaatcttgcaaaccaaaatgtgtgaagccactactcgaatatcaggcgtgtgtgaagagaatccaaggtgatgactctggccacaagcattgcaccgggcagtacttcgactactggcattgcattgacaaatgtgttgcacccaagctttttgcgaaactgaaatgaaaacaacgcgattctggacacagtatcttcttgagtttgcttcatgttatttttaagaggatgtataaaacgcagtggatgttgaatacctgcaaacctgaatatgccaaatggcttttgtttctatggccgtgtgcggttattacatttttttgctacagatttttttaaagtaattgcgtacctaataacgagaatctgtctttatcttg

SEQ ID NO: 1632 - DNA, 610 bp, Acacia harpophylla
gaacgatcaccgcagccgagcctaccacgacctccaactgttagatctctttgacctccgacactcgtcttcttctttctctcgcaatggctgacgaagaacctgttgatccaaagggataccttgaagagtcttgcaaaccaaagtgcgtgaaaccattacttgaatatcaggcatgcgttaaaaggattcagggtgatgaatctgggcacaaacattgcacaggacaatattttgattattgggcatgcatcgacaaatgtgttgcatcaaagctattctccaaactgaagtgatggcagatgattatggcatattgtgataatgatcttctcatcttctactcagttgaaaatgactattccctgatatttgattgtgtacccgaactatatttctacatgcatcttattgtggttactgtgaaagtttgtactcacggtgatcttaaaggtcgattttaaacaactggcacaatctttgctcctttaaatttggaaggatgcttttttacttgatagtgttggtatatctgacttgttgagtgggattttgtcgtgcaatgaataattaacttctcattgaagggtctaaaaaaaaaaaaaaaggc

SEQ ID NO: 1633 - DNA, 477 bp, Arabidopsis lyrata
aaacaacatctgtgtagggttcttcctttgcttcttcgagtctcgatctcctctctcaatctcagtcttgagcttcctaattgactttcaacatggcagatgatgaagttgttgatccaaagaagtaccttgaggaatcttgcaaaccaaaatgtgtgaagccactactcgaatatcaggcgtgtgtcaagagaatccaaggtgatgattctggccacaagcattgcactggccagtatttcgactactggcattgcattgacaaatgtgttgcgccaaagctgtttgcaaaactaaaatgaaaagaggtcaagctggagactccattgtcttgagtttgctacatgtggtttaaattgatgtataaaatgcagtggatgttgaacttttttactgcaaaccagaatatgccaaatggctctgcttctcggttttgtttccatcgcaagtttgcgcttattatattttttttgctac

SEQ ID NO: 1634 - DNA, 310 bp, Brassica juncea
atctaaaggaagactgactcaaaactcaaaacaaatctgtagggttcgttgtctccttaaggtctcgatctcctctccaggacagtttctacaagcttcaaatttgacttctcgccatggcagatgaggaagttgttgatccaaagaagtaccttgaggaatcttgcaaaccaaaatgtgtgaagccactactcgaatatcaggcgtgtgtgaagagaatccaaggtgatgactctggccacaagcattgcactgggcagtatttcgactactggcaatgcattgacaaatgtgttgcacccaagctttt

SEQ ID NO: 1635 - DNA, 537 bp, Brassica juncea
tatgcgggggaaaatagaatcaggacatccagggttcatagtttggcgatcaatcagtgaagcttgcgttcctttctttccaatttcaccatgggcgatgtagaagttgttgatccgaaaaagtgccttgaggaatcttgcaaaccaaaatgtgtgaagccactacttgaatatcaggcctgtgtgaagaggatccaaaatgatgagtctggccacaaacactgcactgggcagtattttgattactggcaatgtgttgacaaatgtgtcggacctaagctgtttgcggaactaaaatgatgggacagaaagttggagcattgagtctgtgtcttgtattttttttttctcaaaggtttatataaaatgcagtgaatactgaacatttctgcaaacgattgcaacaatttccttcttggtttttgtttctctggcaaagctgtgaatcctttgcttgtcttttgggaggaaacctttattgagtttgtgatatacttcattaatgcctaataaatgaaaataagaacgtttctgtaa

SEQ ID NO: 1636 - DNA, 578 bp, Brassica juncea
gactcaaaactcaaagcaaatctgtagagttcgtttgtctccttcaggtctccatctccgctctaggacaggacagtacaagcttcagatttgacttttcgccatggcagaggatgaagttgttgatccaaagaagtaccttgaggaatcttgcaaaccaaaatgtgtgaagccactactcgaatatcaggcgtgtgtgaagagaatccaaggtgatgactctggccacaagcattgcactgggcagtatttcgactactggcaatgcattgacaaatgtgttgcacccaagctttttacaaaactgaaatgaaataaaggcgaagctggagttgacattgtctttgagtttaagggatgtataaaacgcagttgatgttaaactcttttttttttaactgcaaaccttaataatgccaaaaatggctctgcttctcgttttttttgtttctgtcacaagttgcgagtgttatatttttgctacagacattgttattctgcttcttttaaagtaataaaaagcctaataacaaggaaaaaaaaaaaatcatcatataggaaaaactccagaccccgcg

SEQ ID NO: 1637 - DNA, 668 bp, Cucumis melo
gattgcaatttctcagcttccaaactaaacctaatcagagttcctagtttcctctcagattcgtgtttcagctttcaaaggttttcttgcgtgctcttttgctccaagtcagtactatttgttagcgatggcggatgaagagcccgttgatcagaagaggtatcttgaagaagcttgcaaacccaagtgtgtgaaaccactacttgaatatcaggcatgcgtgaagagaatccaaggagatgacagtggtcataagcattgcactggacaatattttgattactggtcttgcattgacaaatgtgttgcaccaaaactatttacgaaactaaagtaatgggagagagttgttagggatgtggggatcctatccttttgcttttgcagcatttttctgattttttatgcaatgtcgttttgtgaacttgatttttgcatcaacaaaaaatgccagggctgtgaaattttataaaaactgtcatagacctttaaccatggtcaataagaaaggagattggattcacgttgggagattggattctgaataacttcttccttcaattttatgattgctttatataaacaatagtgatccatgaattcagtagttgtttcagaaaacaaatgtttagtaacgtgtgatccatttttgagtttgcaaaaaaaaa

SEQ ID NO: 1638 - DNA, 687 bp, Tropaeolum majus
cggccggggtaaacaaaagaaacttccctaaatccttggcctagggttccgacgctaactacggactactgtgtaataagaatatattcttgctcatttacttgaatccattctattttctcctttctcgtctagaactcgaaagccaatacactctttatcgatcccagatccaaggtgatttggtgagctttcggctgctgacttgtgtgactgatcttcattttccatggcagatgaagagcctgttgatcagaagcagttgctggaagaggcttgcaagcccaagtgtgtgaagcaattacttgaatatcaggcatgtgtgaagagaatccaagatgatgaatctggacacaagcattgtaccggccaatactttgattactggtcttgtgttgataaatgtgttgcaaggaagctattcgcaaaactaaaataatggtgtgggcgatatacatatttcaataacagtgtttcaagtgtacttttgaggtcctatttcctataattgctactaaagtttgattgatgccctttaatggtggcttcttgaactgtcatttttttgtattattgttgaattactttctgagttatgatcttgatcaataaataggatcttggaaaggcatttgcctaattgtgttaatttagccatatttgatttaaaaaaaaaaaaaaaggccg

SEQ ID NO: 1639 - DNA, 539 bp, Persea americana
agctgccggtttctctccattccaatacaaaatctcccgcaacatttaagggctgaagcctataggtgctccaatcaacactctcttgcagatatcaattttccatctcaatggcggacgaggagcctgttgatccaaagaaatatctcgaggagtcttgcaagccaaagtgcgtcaagcctttacttgaatatcaggcatgtgttaagagaatccaaggtgatgaaacaggacacaaacactgcaccgggcagtactttgattactgggcatgcgttgacaaatgcgttgcacctaagctctttccacaactaaaatgattgtggcaatgagtttcttggacaagtagtgttctctttcattttgtccgtcaactgtttgtgaacttgggatgtcatgttccataaaccatgaaccgcattgttcaccagcacatttttgcgacacttaaaaaggttttattgatgtttctatttacgaagagccctgatttgaatcaataaaaggagggttttcagacaaaaaaaaaaaaaaaaaaa

SEQ ID NO: 1640 - DNA, 521 bp, Persea americana
gagctgccggtttctctccattccaatacaaaatctcccgcaacatttaagggctgaagcctataggtgctccaatcaacactctcttgcagatatcaattttccatctcaatggcggacgaggagcctgttgatccaaagaaatatctcgaggagtcttgcaagccaaagtgcgtcaagcctttacttgaatatcaggcatgtgttaagagaatccaaggtgatgaaacaggacacaaacactgcaccgggcagtactttgattactgggcatgcgttgacaaatgcgttgcacctaagctctttccacaactaaaatgattgtggcaatgagtttcttggacaagtagtgttctctttcattttgtccgtcaactgtttgtgaacttgggatgtcatgttccataaaccatgaaccgcattgttcaccagcacatttttgcgacacttaaaaaggttttattgatgtttctatttacgaagagccctgatttgaatcaataaaaggagggttttcagac

SEQ ID NO: 1641 - DNA, 531 bp, Theobroma cacao
ggggccttgccgtagctgagatttcgtgcttcccgtttaaagttaggtaacctccaaagcttttcggtgctcagttatcgacttcgtttgatatggcggacgaggatcctgttgatcaaaagaagtatcttgaagaggcttgcaagcctaagtgtgtgaaaccgttgcttgcataccaggaatgtgttaagagaattcaaggtgatgaaagtgggcacaagcattgcactggtcaatattttgattattggtcttgtgttgataaatgtgttgcaccaaagttattctcggaactgaaataactgggggatgagacattttgttacagcagcattcatgtctttgctgttttgagttcgaaagccagtgattgtttggaaaaaacacgttcatgatgtacggtaatcttgaaatgcctgcatctgcatggctaatctgagaactgttagaaattttttgtgtttatgtggaaacagtttggtcattgtcaataaaatacgatcctggaatacatgcatgttggcttaaata

SEQ ID NO: 1642 - DNA, 635 bp, Nuphar advena
  misc_feature (289)..(289): n is a, c, g, or t
  misc_feature (375)..(375): n is a, c, g, or t
  misc_feature (414)..(414): n is a, c, g, or t
  misc_feature (508)..(508): n is a, c, g, or t
cctctccgactctccgagcgagctcaccggtgaattttttaaagctattgttgtggcttccttgcacttgttcttacatttcaatggctgatgaggagcttgttgatcagaagaaatacattgaagaatcttgcaagccgaaatgtgtgaagcccttacttgaatatcaggcatgtgtaaagaggatccaagaagatgaaacgggccacaaacattgcacagggcaatactttgattactggtcatgcgttgataaatgtgccgctccaaccctctttgcgaagctganatgatgatcgcgagctgcaggttcagtagcatttacttttcaaattttcttgattcgcactgtattgcagtattgtaccagctcancatttgctcaaatccggcatgactgcagtgcagtgccgntctgcttgcgagctaggatctgataaagcctatacatttttcctatattttgacctttttcttaccttcttgcttatgtgtcccttaagagggnaaaccaaataaagaggctatctgatgcatgtgggcatcaaaagctactgagatcttgcgtctgctgatctaatatttccttgcagaatcaatcattttcatctaaccagttgtgctttgtgctgacc

SEQ ID NO: 1643 - DNA, 557 bp, Populus trichocarpa
tttgtctgcgtcaatctcccgatcatcgtttctccaactcccccgaccaagggaattcgcgaactgtcgtaccgtgatttttagttctaatacatggcggacgaggaacctgtcgatccgaagaagtatcttgaggaatcttgcaagcctaaatgtgtgaagcctttgcttgaatatcaggcatgtgttaagagaattcaaggtgatgagactggccacaaacattgtactggacagtactttgattactggtcctgtgttgataaatgcgttgctctgaagctgttttcgaaactgaagtagtagggatgctgttagggcactttcatttcctgttgtatcttttgaaatgtcagatcatgggctcgtttccactatctgcggcacctcttttcgatttgatcagcaaacattttttgaattaaaataatggaagatgtcttaaattgattgctttgtaacttgtaagttgttgaacgtgatatatcatgcgaggtcatgttgaaaattttaaagatggaggctatatatcgctccagggtggattgattttgcag

SEQ ID NO: 1644 - DNA, 558 bp, Raphanus sativus
gggaatctagagacatctctaaaggaagactgactcagactcgaaacaaatctgtagggttcgttgtctccttcaggtctcgatctccgttctaggacagttttacaagcttcagatttgacttttcgccatggcagaggatgaagttgttgatccaaagaagtacctcgaggaatcttgcaaaccaaaatgtgtgaagccactgcttgaatatcaggcgtgtgtgaagagaatccaaggtgatgactctggccacaagcattgcaccgggcagtacttcgactactggcagtgcattgacaaatgtgttgcacccaagctttttgcaaaactgaaatgaaaacaaggcgattttggacacagtatcttcttgagtctggttcatgttatttgtaagaggatgtataaaacgcagtggatgttgtcataactgcaaacctgaatatgccaaatggctcttcttctcggttttgtttctatcgctatttgcggttattacattttttttttttgctacagatcttatgcctaataacaagaatttttctttatcttgga

SEQ ID NO: 1645 - DNA, 671 bp, Raphanus sativus
gaatcacaacaattagggttcatcgtttggcgatccatcagtgaagcttacgatcctctatttccaatttcaccatggcggatgtagaagttgttgatccgaaaaagtgcctcgaggaatcttgcaaaccaaaatgtgtgaagccactacttgaatatcgggcgtgtgtgaagaggatccaagatgatgagagtggtcacaaacattgcactgggcagtattttgattactggcaatgtgttgacaaatgtgtcgggcctaagctgtttgcggaactgaaatgatgggagagaaagttagagtattgagagtctctctgtctctgtcttgtgtttttttttcacaagggtttatataaaatgcagtggatactgaacgttactgcaaaccagattgcaacgggttccttccttggttttgtttctctggcagagctgcgaatcatttgtctgttgggaggaaacttttgatgagtttgtgatagttcactaatactttttttcactaccactaatgcctagtaaatgaaaataagaatgcgatacatttctgcacgattttggtttgtcttcaactgttgttggaatgaaactttgaacagcatcggtagttaaagaaagaccgaatactattgtaccataagttgattaaagcgatgtagttattacgca

SEQ ID NO: 1646 - DNA, 596 bp, Raphanus sativus
gggatcaaaaaacaatataattcaacttgtccttgtgttagggttcctcattcgtgtctcgatctaatctccttcccgatcagtttacagcttccgatttgactttccgacatggcagatgatgaagttgttgatccaaagaagtacctcgaggaatcctgcaaacctaaatgtgtgaagccactactcgaatatcaggcgtgtgtgaagagaatccaaggtgatgactctggccacaagcattgcaccgggcagtacttcgactactggcattgcattgacaaatgtgttgcaccaaagctgtttgcaaaactaaaatgattaggaagcagaggtggagacgatgttgtcttgcttgagtgtgcttcatgtggtttaaaagggatgtataaaacgctgtggacgttgaactttctttcataactgcaaacctgaatatggccaaatggctatgctcctcgttttgtttctatgttactataccacaaaaattgttattgtgctctctctctcatgccattaactacaagaattttcccttctttgaacaaattattaggcttttagtttcaataaagagtttttcacgattaaga

SEQ ID NO: 1647 - DNA, 524 bp, Camellia sinensis
ggagatcgtttgcggcttaaaccctcgaaaggtgacttcagtgagcttcgttgcactttgctgatcgttttctctgcaattgctatggcggatgaggaacttgttgatcagaagaagtactacgaagaatcttgcaagccaaagtgtgtaaaatctttactcgaatatcaggcatgtgttaaaaggatccaagatgatgattctgggcataagcattgcactggacagtattttgattattgtcttgtgttgacaaatgtgttgcacccaagctgtttgtgaaactgaagtaatgaggggatagctttgttttcatgtcgctcttttgttcttcaaccagacatctcgtggattgtgtcttttgctgcaaacttttaatgtttgtatgtttactttttaatcagctttatgggagacctttgagttaataatgacttttgtggattaaaattgttttacttggattttaatgttaagacagatctgaaataataagaaaatgtgttgagacttttcattattgt

SEQ ID NO: 1648 - DNA, 545 bp, Camellia sinensis
tatcggccattacggccggggggagatcgtttgcggcttaaaccctcgaaaggtgacttcagtgagcttcgttgcactttgctgatcgttttctctgcaattgctatggcggatgaggaacttgttgatcagaagaagtactacgaagaatcttgcaagccaaagtgtgtaaaatctttactcgaatatcaggcatgtgttaaaaggatccaagatgatgattctgggcataagcattgcactggacagtattttgattattgtcttgtgttgacaaatgtgttgcacccaagctgtttgtgaaactgaagtaatgaggggatagctttgttttcatgtcgctcttttgttcttcaaccagacatctcgtggattgtgtcttttgctgcaaacttttaatgtttgtatgtttactttttaatcagctttatgggagacctttgagttaataatgacttttgtggattaaaattgttttacttggattttaatgttaagacagatctgaaataataagaaaatgtgttgagacttttcattattgt

SEQ ID NO: 1649 - DNA, 308 bp, Brassica juncea
ttctcttcacacacgcctgatattcgagtactgacttcaacaaacacaagttctgtagcgttcctccttcgtgtctcgatctgctcttcctcccgacgaggttacagcttccgattttgactttccgacatggcagaggatgaagttgttgatccaaagaagtaccttgaggaatcttgcaaaccaaaatgtgtgaagccactactcgaatatcaggcgtgtgtgaagagaatccaaggtgatgactctggccacaagcattgcactgggcagtacttcgactactggcattgcattgacaaatgtgt

SEQ ID NO: 1650 - DNA, 2164 bp, Arabidopsis lyrata
ttgtcttctctctcactctcaggttctcaacaacataagaggcaaacaaaatcagaagccatcgtaatcaggtctcatcgctatgaccggaccatccgtagagaaaaccgggtcgacccggttcattgtcttcttcatcgtcctcaatctttccatttttagtttatcgattgaagcaagatcgagccaacaacatgctagctttcctccaagaggatggaattcgtacgattccttttgttggactatctctgaagctgagttcttgcaaagtgctgaaattgtttctaagcgtcttcttcctcatggttatcagtatgttgtggtggattacctttggtatagaaagaaagttgaaggagcttatgtggattctcttgggtttgatgtgattgatgaatggggaagattgcatcctgatccagctagatggccatcttctagaggtggtaaaggtttcactgaagttgctgagaaagttcatagaatgggtttgaagtttgggattcatgttatgggaggaatcagcacacaagcttataacgctaatactcttgttatggatagtgttaagggaggtgcttatgaagaatcaggtaggcagtggcgagcgaaagatattgggatcaaggagaaggcttgtgtgtggatgtcacatgggttcatgagtgtgaataccaagttaggtgcaggaaaagctttcttgaggtctctctatcgacaatatgccgaatggggcattgatttcataaaacatgactgcgtatttggcactgacttcaatatagaggagataacttatgtgtcagaggttctgaaggagcttgatcggcctgttttatactccatatctccagggaccagtgtgacacctacaatggctaaagaagttagccaattggttaacatgtacagaataacaggtgatgattgggatacatggaaagatgtggcggctcattttgatatctcgagagatttatctgcttctagtatgatcggtgcacgagggttgcaaggaaaatcatggcctgatctagatatgttacctcttggatggcttactgatcaaggttcgaatgttggacctcatcgagcgtgtaatctaaatcttgaagaacagaagtcacagatgacattgtggtccatcgcaaagtcccctctcatgtttggaggtgatgtgagaaagctcgatgacactacttataatctgatcacaaatcctacactgctggaaataaactcttatagctctaacaacaaggagtttccttacatcaccgtgacaagagtatctaggaataagcacaaaagccatcctcatcatccaacgggcaacaacatttcaactaaacatgcttttggtctcactagctgcaaagaaccgaaaaccaacacttggtccattgtagacaagaaccgtggacaaatctgttggaaccaatactctagccaaaaactagagaagcccttttgcttatacaacagaaaagctcttccagcgtccgatgaggagataaaacacaaccagctttaccaaggtaagcttcatttgcaaacaaatgaaaaagcagagtcttgtttaggagcttcctcaaagcaaaagctcacttcgaaagattatagtcgtggtactttatcaccttgcaaactagatgcaaaccagatgtgggagctccacagtaatggaacattagaaaatagttattccggtctttgtgccgtgttaaatccagtgaaagcagccgaagctacctcaaatggcgttcgttcttggattgccacgggaagaagaggagaagtatacgttgcgtttttcaacttaaatcaggagaagacaacgatatcagccaagataatagacattgccaaagctcttccaaacaagaaaaatcttgaaggagcttcttgtacaagccacgagctatggagcggcaaagatttcggaccaacaaaagattcagtatcgattcaagtcgaacctcatggtcctgctctgtttgttcttcattgtagccatgcctgactatatcagatcaacaggcttttcttttaccttctccatacgtcgtcttttctcatcgtagtaatgtttcatctttagtctatgaaattagtcttgtataatcgaaaaatacaaaacaacaaaatatcgaataaaaaa

SEQ ID NO: 1651 - DNA, 2336 bp, Brassica napus
ggctgggcccctctgagctgaggtactgatagctgatatcgaatcgtataggccattacgggcggggaacggtagcgtgttctatcgtctctcaggttctctcatcaacaaagattcgctatgatccgacacgccctagaaagaaccggaaccaccctccggtccctactcttcttcttcctcctcctcaatctttccatttatagtatatcgattaacgcaagatcaaacgaagatgcgagctttccaccaagaggatggaactcgtacgactccttctgctggacaatctccgaaactgagttcttgcagagcgctgaaaccatctcaaagcgtctccttcctcatggatatcaatatgttgtggtggattacctttggtacagaaagaaagtccaaggagcttacgtggactctcttggcttcgacgtgattgacgaatggggaaggatgcatcctgatcctgctcggtggccttcttctaaaggcggcaaaggcttcacccaagtagctgagaaagttcataagatgggtttgaagtttgggattcatgttatgggtgggattagcacgcaggcttataacgcaaacactctcgttatggatagtgtcaagggaggtgcttatgaggaatcaggtagacagtggagggcgaaggatattgggatgaaggagaaggcttgtgtgtggatgccgcatgggttcatgagtgtgaataccaagctaggtgctggaaaagccttcttgaggtcactttatcggcaatatgctgaatggggaatcgatttcataaaacatgactgtgtatttggggatgacttcaatctagatgagataactattgtgtcagaggttctgaaggagcttgatcggcctgttttgtactcaatatctccagggacgagtgtgacacctacaatggctaaagaagttagtcagttggttaacatgtacagaataacaggtgatgactgggacacatggagagacgtggtggcacatttcgatatctcgagggatctatctgcgtctaatatgatcggtgcacaagggctacaaggaaaatcatggccagatttagatatgctacctcttggatggcttactgatcaaggttcgaaccttggacctcatcgactgtgtaatcttactatggaagaacagaagacacagatgacattgtggtctatagcaaagtcccctctcatgtttggaggtgatgtgagaaagcttgatgacgcgacttataatctcatcactaatcctacacttctggaaatcaattcttatagctctaacaacatggagtttccttacatcaccgcggcacggaacaatcctcatcattcaataggcaacaacgttaaaaccaaacatgcatttggtctgactagctgcaaagaaccaaaagccagcacttggtccgttgtagacaagaacaatggaaaaatctgttggaaccaatactcaaccgagaaaccagagaagcccttttgcttatacaacagaaaagctcttctatcttctgaggagatacaacacaatcagctctatcaaggtaagctccatttacaaacaaatgataaagcagagtcttgtttaggagcttcctcgaggaaaaagctcacttccaaagactatagtcgcggtgcgttatcaccttgcaaactagacgcaaaccagatgtgggagctccacagtaatggaacactagaaaacagctactctggtctttgtgctgtgttaaatccagtgaaagcagcagaagctagctccaatggtgttcgttcttggattgcttcgggaagaagaggagaagtgtatgtcgcctttttcaacctaaatcaggtgaagacgacggtatcagctaagatatcagacattgccaaggctcttcagaacaagacgcatcttgaaggagcttcttgtaagagccacgaaatatggagcggtaaagatttcggaccaacgaaagattcagtaacgattcaagttgaatctcatggtcctgctctgtttgttctccattgtagccatgcatgagtatatcagatcaacaagctgttcttttgccttctactcacgactgtcgtttttcatcatatagtgtaatgttttatcttagcctaatgaaaacagagtttatgtataatctatgctttaataacactggttacgatgataattagcaaaccatactatattatatataccaacatgttaattattgtttccaaggagagagggtgaggaggggcgagatggttgggtatgggcgtttgggtgtctgtgtttggtttaaaaaagggggcgcgctctagaggacccaagcttga

SEQ ID NO: 1652 - DNA, 2309 bp, Brassica napus
  misc_feature (859)..(859): n is a, c, g, or t
  misc_feature (883)..(883): n is a, c, g, or t
  misc_feature (925)..(925): n is a, c, g, or t
  misc_feature (929)..(929): n is a, c, g, or t
  misc_feature (943)..(943): n is a, c, g, or t
  misc_feature (957)..(957): n is a, c, g, or t
  misc_feature (964)..(964): n is a, c, g, or t
  misc_feature (970)..(970): n is a, c, g, or t
  misc_feature (985)..(985): n is a, c, g, or t
  misc_feature (1005)..(1005): n is a, c, g, or t
  misc_feature (1018)..(1018): n is a, c, g, or t
  misc_feature (1020)..(1020): n is a, c, g, or t
  misc_feature (1024)..(1024): n is a, c, g, or t
ccgggcgaggattcggacgagcagtacttgtcatcaacaacggtagcgtgttctatcgtctctcaggttctctcatcaacaaagattcgctatgatccgacacgccctagaaagaaccggaaccaccctccggtccctactcttcttcttcctcctcctcaatctttccatttatagtatatcgattaacgcaagatcaaacgaagatgcgagctttccaccaagaggatggaactcgtacgactccttctgctggacaatctccgaaactgagttcttgcagagcgctgaaaccatctcaaagcgtctccttcctcatggatatcaatatgttgtggtggattacctttggtacagaaagaaagtccaaggagcttacgtggactctcttggcttcgacgtgattgacgaatggggaaggatgcatcctgatcctgctcggtggccttcttctaaaggcggcaaaggcttcacccaagtagctgagaaagttcataagatgggtttgaagtttgggattcatgttatgggtgggattagcacgcaggcttataacgcaaacactctcgttatggatagtgtcaagggaggtgcttatgaggaatcaggtagacagtggagggcgaaggatattgggatgaaggagaaggcttgtgtgtggatgccgcatgggttcatgagtgtgaataccaagctaggtgctggaaaagccttcttgaggtcactttatcggcaatatgctgaatggggaatcgatttcataaaacatgactgtgtatttggggatgacttcaatctagatgagataactattgtgtcagaggttctgaaggagcttgatcggcctgttttgtactcnatatctccagggacgagtgtgacncctacaatggctaaagaagttagtcagttggttaacatgtanagantaacaggtgatgantgggacacatgganagacgtngtggcncatttcgatatctcnagggatctatctgcgtctantatgatcggtgcncnaggnctacaaggaaaatcatggccagatttagatatgctacctcttggatggcttactgatcaaggttcgaaccttggacctcatcgactgtgtaatcttactatggaagaacagaagacacagatgacattgtggtctatagcaaagtcccctctcatgtttggaggtgatgtgagaaagcttgatgacgcgacttataatctcatcactaatcctacacttctggaaatcaattcttatagctctaacaacatggagtttccttacatcaccgcggcacggaacaatcctcatcattcaataggcaacaacgttaaaaccaaacatgcatttggtctgactagctgcaaagaaccaaaagccagcacttggtccgttgtagacaagaacaatggaaaaatctgttggaaccaatactcaaccgagaaaccagagaagcccttttgcttatacaacagaaaagctcttctatcttccatgaggagatacaacacaatcagctctatcaaggtaagctccatttacaaacaaatgataaagcagagtcttgtttaggagcttcctcgaggaaaaagctcacttccaaagactatagtcgcggtgcgttatcaccttgcaaactagacgcaaaccagatgtgggagctccacagtaatggaacactagaaaacagctactctggtctttgtgctgtgttaaatccagtgaaagcagcagaagctagctccaatggtgttcgttcttggattgcttcgggaagaagaggagaagtgtatgtcgcctttttcaacctaaatcaggtgaagacgacggtatcagctaagatatcagacattgccaaggctcttcagaacaagacgcatcttgaaggagcttcttgtaagagccacgaaatatggagcggtaaagatttcggaccaacgaaagattcagtaacgattcaagttgaatctcatggtcctgctctgtttgttctccattgtagccatgcatgagtatatcagatcaacaagctgttcttttgccttctactcacgactgtcgtttttcatcatatagtgtaatgttttatcttagcctaatgaaaacagagtttatgtataatctatgctttaataacactggttacgatgataattagcaaaccatactatattatatataccaacatgttaattattgtttccaaggagagagggtgaggaggggcgagatggttgggtatgggcgtttgggtgtctgtgtttggtttaaaaaagggggcgcgctctagaggacccaagcttga

SEQ ID NO: 1653 - DNA, 3820 bp, Arabidopsis lyrata
aagttcataacttcctaaatggagtataaataagtgttaaaggtggtgtggtcattatcaaattaagcctctcactaattattagaagctccaaaagcttttttccttcttctctttttttcttacggatttctctgactggagcgatggaaattgacggtggaggagatcgtatctccggtgaacgaccgatcattatggtcaccaacgacgacggcatagacgctcctggcttgcgttctctggttcgcgtcctcgtctccactaacctctacgatgttcgcgtctgcgctcctgattcggagaaatctgctgttagtcacagtataatatggagtagaccactcactgcaaaacgagtagatattgatggagctactgcttatgctgttgatggaacacctgcggattgtactggtttgggcttatcggaagcactctttccttctcgtcctgacctggttcttagtggtataaacgtgggtagcaactgcggatatcacatcgtctattctggaactgttgctggcgctcgtgaagccttcctttatgatgtgccttcagcttccatatcatatgattttgattggaaacgtggagagatgaatgctaatgattttgtcctttctgcccaagcttgcttgcctattataaacggcatactcagtgcgatcaagaacaaaactcaccctatgcaatgctttctgaatatcgatttaccgactgacattgccaaccataagggatacaaactaactagacaaggtaaaagcatgggtaaaatgggatggagacaagtggaagagaaagcacaagggccaaagatgttatcaacaatgacaatggatacagagtcaggagtagtctcgtcagacaacgacacatctgctcattcgaaaaaagataaccgtttattcaaaagggaggtaaggggaagctttaatgaagaagggactgattctcactacctaaaagaaggatttattacggtgacgccgcttggagctctatctcagactgatgtggattgccaaaactactacaaagaatggcttcccaagattacaaaccagtcatgttcctcctcatccctttgatcctacaacatgagaggaaaaaaaaactctattaagatttaaaaacttacccattgtagaccacaatttgtggtagacctattattatatcagtatcggttgtttagttttatatagttttgacttgttatggttatgagcagcagaatctatatcgagacgccgacacacgttggaatatcaaggaaactttcttgacaagaagcgatcagtcaatttgtaatttgtgcgttttagaatttagttaccgtaaacaaagttcgagcgctggcggcaggacctgatcagattgcaataacatcatcatgtgtgcaagttggagattagtagtcatgatcttgcatataatccttgttttatacttcaagttatgaccaatatatttattatttatacatccgaattttgctcccgtgaattcgaaggaagagtatataaaatatgtcacgtgataattatttttcatcttcacgtttctcattttatggggtctcattcgacgactttccaactcgaactaattaatatgttagttattaatcatatagagagacgctcctacaaaacacataaacatataggtgcatgcatataaatgtaaatgcattgttgttgtctacttaataacaactccatcaataaacacacatacttgccctagttttcctcctacaatgtgctttcacttttggtcttcatttccacccacttgatcccttaactccccaagaaatcactaaaacaagcttcatcgtcaagaaatctcacctaggcaatctcaaagatctcacatttcactacctcgacctcgaagaaccaaacaagacccacgtcctccaatggctatcgccaaatccctccaagaaaccaccaccgccacgtcgtcgctcactcgtggtagttcgagccggtggtcaaacccacgagctcatcattgacttaaccactagcaagatcgtatcctcccgcatctacaccggccatggattcccttcattaacattcatagagcttttcagagctagcaagcttcctcttacttacccacctttcaagaaatcgattcttgatcgagccctcaacatctccgaggtttcttgcatccctttcaccgttggttggtacggagaaaccaccacgagacgtgaagtcaaagcctcttgcttttacagagacggatctgtcaacgtcttcacaagacccatcgaaggaatcaccgtaactatagacgttgactcaatgcaagtcgtgaagtactccgacagattccgaaagcctctccctgataaagaaggtaacgactttcgaaccaaacacaaacccttcccattctcttgcaacgtctccgacacaggcttcaagatactcggcaatagagtcaagtgggctaactggaaattccacgtcggatttacagcaagagcgggagtaaccatatcgacggcttccgttcttgacccgagaaccaaaaggtttcgacgagtgatgtacagaggacacgtgtcagagacttttgttccgtacatggacccaacctacgaatggtactaccgtacgttcatggacatcggagagttcggtttcgggagatccgccgtgactctgcagccactcattgactgcccgcaaaacgctgcgtttttagatggacacgtggccggaccagatgggacagctcagagcatgaccaatgtgatgtgtgtcttcgagaaaaacggttacggtgcttcttttagacacaccgagattaatgttccaggacacgtgataacaagtggggaagctgatataagtttagtggttagaatggtggccacacttggaaactatgattacatagtggattgggaatttaaaaagaatggagccatcagagttggggtggatttgactggagttttggaagtaaaagcaacgtcgtacacgtcgaacgatcaaataacggataacgtttacgggacactggtggcgaagaacaccatcgccgttaaccacgaccattacctaacgtactacttggacctcgacgttgacggtaacggcaattctttggtgaaagcgaaactcagaacggtaagagtaacggacgttaacaaaacgtcttctcggaggaagagttactcgacggtcgttaaagagacggcgaaaacagaagctgatggtagagttcgactcggctcagagccggttgagctattaatagttaaccctaaaaagaagacaaagataggaaatacggttggttaccggctgataccagaacatttaccagtcacttcgcttttaaccgacgatgattacccggagataagagccggttacacgaaatatccggtttggattactgcttataaccggtcagaaagatgggccggtgggttttatagcgataggagccgtggcgatgacggtttagcggtatggagtagcaggaacagagagatagagaacaaagacatagtgatgtggtacaacgttgggtttcatcacattccataccaagaggattttccggttatgcccactcttcacggtggatttactcttcgaccttccaattttttcgataatgatcctttgattgggtaaataccgcctctggcaaacaaactgatgttagccttgtaatgattgacttatgttaggtcaattagccttgtaactgatcagttattaatttgatttgatatttgattcttatgtgttgaatggtttagttaatt

SEQ ID NO: 1654 - DNA, 1180 bp, Thellungiella halophila
gattggagctccctctcattctcagtaatcgcacgcgattacgcatttccctaatcagagcgatggaaattgacggtggagatcgtgtctccggccaaaagccgatcatcatggtcactaacgacgacggtatagacgcgcctggccttcgttctctggttcgggtcctcgtctccactaacctctacgacgttcgcgtctgcgctcctgattcggagaaatctgctgttagtcacagtattatatggagtagacccctcactgcacaacgagtagaaattgatggagctgtagcctatgctgtttctggaacccctgcggattgtactggtttgggcttatcggaagcactcttcccatcacttcctgacctggttcttagtggtataaacgtgggtagcaactgcggatataacattgtctattctggaactgtcgctggcgctcgggaagcctttatttatgatgtcccttctgtctccatatcatatgattggaaacgtggagacatcaatgttaatgattttgtccttgctgcccaagcttgcttgcctattatcaacggcatactcagtgcgatcaagaacaaaactcacccaacaaattgctttctgaatatcgatttgccaacagatattgctaaccataagggatacaaactaactacacaaggtaagagcttgggtaaaatgggatggagacaagtggaggagaaagcacaaggagcgaagatgttgtcaacaatgacaatggaaacagattcaggagtagtctcagaaaacggcacatctgctgatcattcacaagatacccgtttattcaagagagagctaaggactgtgttggttgaagaagggactgatctccactttctaagagaaggatatattacagtgacgccgcttggagctctatctcaggttgatgtggattgccaagactactacaaagaatggcttcccaagattacaaaccagccatattcttcatccttgtgatgcgaccatatgaaaaattcactttttaaaggaacttacccattgtggaccacaatctgtggtggacctattattctatcagtattagtttaattatccatactcttgagttattatattgtgttctatatgcagctaaaactctggcaacaaattttgttgcaagtcaaccatgatcatat

SEQ ID NO: 1655 - DNA, 1154 bp, Brassica napus
  misc_feature (10)..(10): n is a, c, g, or t
  misc_feature (12)..(14): n is a, c, g, or t
  misc_feature (16)..(17): n is a, c, g, or t
  misc_feature (19)..(21): n is a, c, g, or t
  misc_feature (24)..(24): n is a, c, g, or t
  misc_feature (26)..(29): n is a, c, g, or t
ttcttcttcntnnncnnannntangnnnnaagattacagaggcgatggcgattaacggcgaagatcgcatctccggcgaacgcccgatcatcatggtcaccaacgacgacgggatagacgcgcctggtctccgttctctcgttcgcgtcctcgtctccaccaacctctacgacgtccgcgtctgcgctcccgattcggagaagtctgctgttagtcacagtatcatatggagtagacctctcactgcacaccgtgttgagattgaaggagctgaggcctatgctgtttctggaacccctgcggattgcactggtttgggcttatccgaagcgctcttcccttctcttcctgacctggttcttagtggtataaacgttggtagcaactgtggctacaacatcgtctactctggaactgttgctggtgctcgtgaagccttcatttatgatgtgccttctgcctccatatcttatgattggaaacgtggagacatcaatgttaatgattttgttctgtctgcccaagcttgcttgcctattatcaacggcatgctcagtgccatcaagaacaaaactcacccaacaaactgctttctgaatatcgatttgccgactgatattgctaaccataagggatacaagctaaccacacaaggtaaaagcttgtgtaaaatgggatggagacaagtggaggaggaagcacaaggtgcgaagatgttgtcaacaatgtcaatggaaaccgattcaggagtagtctcagacaacaacgacacatctgctcatcattcaaacgatagccgtttgttcaagagagaggtaaggactgtggtggtggaagaaggcactgatcttcactttctgcgagaaggatatattacagtgacgccgataggagctctctctcaggttgatgtggattgccaaaactactacaaagaatggcttcccaagatttcttcatccttgtgatgtcaccaaatgaaaacataaaactcttctgatgatttatccattatggaccacagtttgtggtagacctattatcagtactcttttaagttattttatcttgtgatcagctagttttcttgcaagtcaattactgccagacatgttctttttcttttaatttatgcagtagcttaacctcaactt

SEQ ID NO: 1656 - DNA, 1212 bp, Raphanus sativus
  misc_feature (683)..(683): n is a, c, g, or t
  misc_feature (723)..(723): n is a, c, g, or t
  misc_feature (744)..(744): n is a, c, g, or t
  misc_feature (753)..(753): n is a, c, g, or t
  misc_feature (792)..(792): n is a, c, g, or t
  misc_feature (799)..(799): n is a, c, g, or t
  misc_feature (803)..(803): n is a, c, g, or t
  misc_feature (811)..(811): n is a, c, g, or t
  misc_feature (822)..(822): n is a, c, g, or t
  misc_feature (906)..(906): n is a, c, g, or t
  misc_feature (918)..(918): n is a, c, g, or t
  misc_feature (930)..(930): n is a, c, g, or t
  misc_feature (957)..(957): n is a, c, g, or t
  misc_feature (999)..(999): n is a, c, g, or t
  misc_feature (1004)..(1004): n is a, c, g, or t
  misc_feature (1008)..(1008): n is a, c, g, or t
  misc_feature (1019)..(1019): n is a, c, g, or t
  misc_feature (1032)..(1032): n is a, c, g, or t
  misc_feature (1034)..(1035): n is a, c, g, or t
  misc_feature (1045)..(1045): n is a, c, g, or t
gggtcttccttctcttatctaataagactcttattaataagatatacagagagagcgatggcgattaacggcgaagatcgcatctccggtgaccgcccgatcataatgatcaacaatgacgacggaatagacgcgcctggtctccgctctctcgttagcgtcctcgtctccaccaacctctaccaagtccgcgtctgcgctcccgattcggagaagtctgctgtaagtcacagtatcatatggagcagacctctcactgcaaaacgagttgagattgaaggagctgaggcctatgccgtttctggaacccctgcggattgcactggtttggggatatcggaagcactcttcccttctcttcctgacctggttcttagtggtataaacgtgggtagcaactgtggatataacatcgtctactctggaactgttgctggtgctcgtgaagccttcatttatgatgtcccttctgcctccatttcttatgattggaagcgtggagacatcaatgctaatgattttgtcctcgctgcccaagcttgtttgcctattatcaacggcatgctcactgccatcaagaacaaaactcacccaactaactgctttctgaatatcgatttgcctactgatattgctaaccataagggatacaagctaactagacaaggaaaaagcttgggtangatgggatggagacaagtggaggaggaagcacaaggtgcnaagatgttgtcaacaatgtcnatggaaacngattcaggagtagtttcagacaacaacaacgacacatcngctcatnattnaaaagatnatagccgtttnttcaagagagagctaaggactgtgatagttgaagaaggcactgatcttcacttcctgcgagaaggatatattacagtgacgccnataggagctctntctcaggttgangtggattgccagaactactacaaagantggcttcccaagatttcttcatccttgtgatgccaccaaatnaaaanaaanaaaaagaaccnttttaataatttnannattgttgacnaccacagtttgtggtagacctatttatccatactctttaaagttatttatgttgtgagcagctaaatctctggcaacaagttttgttgcaagtcgatgattgccacacatgtttcttttgctttttgttaatggaactcctatgcagtagccagtagctttacacga

SEQ ID NO: 1657 - DNA, 1186 bp, Brassica napus
ggtggagcctataaataaataaaacgcttcttcttccttcgcttatcttaagacttaagattacagagcgatggcgattaacggcgaagatcgcatctccggcgaacgcccgatcatcatggtcaccaacgacgacgggatagacgcgcctggtctccgttctctcgttcgcgtcctcgtctccaccaacctctacgacgtccgcgtctgtgctcccgattcggagaagtctgctgttagtcacagtatcatatggagtagacctctcactgcacaccgtgttgaaattgaaggagctgaggcctatgctgtttctggaacccctgcggattgcactgggttgggcttatcggaagcgctcttcccttctcttcctgacctggttcttagtggtataaacgttggtagcaactgtgggtacaacatcgtctactctggaactgttgctggtgctcgtgaagccttcatttatgatgtgccttctgcctccatatcttatgattggaaacgtggagacatcaatgttaatgattttgttctctctgcccaagcttgcttgcctattatcaacagcatgctcagtgccatcaagaacaaaactcacccaacaaactgctttctgaatatcgatttgccgactgatattgctaaccataagggatacaagttaactacacaaggtaaaagcttgtgtaaaatgggatggagacaagtggaggaggaagcacaaggtgcgaagatgctgtcaacgatgttaatggaaacagaatcaggagtagtctcagacaacaacgacacatctgctcatcattcaaacgatagccgtttgttcaagagagaggtaaggactgtggtggtggaagaaggcactgatcttcacttcctacgagaaggatatattacagtgacgccgataggagctctctctcaggttgatgtggattgccaaaactactacaaagaatggcttcccaagatttcttcatccttgtgatgtcaccaaatgaaaacataaaactcttttgatgatttatccattatggaccacagtttgtggtagacctattatcagtatactcttttaagttattttatgttgtgatcagctagttttcttgcaagtcaattactgccagacgtgtttctttttcttttaatttatgcagtagcttaacctcgacttgaa

SEQ ID NO: 1658 - DNA, 1124 bp, Brassica napus
aagattacagaggcgatggcgattaacggcgaagatcgcatctccggcgaacgcccgatcatcatggtcaccaacgacgacgggatagacgcgcctggtctccgttctctcgttcgcgtcctcgtctccaccaacctctacgacgtccgcgtctgcgctcccgattcggagaagtctgctgttagtcacagtatcatatggagtagacctctcactgcacaccgtgttgagattgaaggagctgaggcctatgctgtttctggaacccctgcggattgcactggtttgggcttatccgaagcgctcttcccttctcttcctgacctggttcttagtggtataaacgttggtagcaactgtggctacaacatcgtctactctggaactgttgctggtgctcgtgaagccttcatttatgatgtgccttctgcctccatatcttatgattggaaacgtggagacatcaatgttaatgattttgttctgtctgcccaagcttgcttgcctattatcaacggcatgctcagtgccatcaagaacaaaactcacccaacaaactgctttctgaatatcgatttgccgactgatattgctaaccataagggatacaagctaaccacacaaggtaaaagcttgtgtaaaatgggatggagacaagtggaggaggaagcacaaggtgcgaagatgttgtcaacaatgtcaatggaaaccgattcaggagtagtctcagacaacaacgacacatctgctcatcattcaaacgatagccgtttgttcaagagagaggtaaggactgtggtggtggaagaaggcactgatcttcactttctgcgagaaggatatattacagtgacgccgataggagctctctctcaggttgatgtggattgccaaaactactacaaagaatggcttcccaagatttcttcatccttgtgatgtcaccaaatgaaaacataaaactcttctgatgatttatccattatggaccacagtttgtggtagacctattatcagtactcttttaagttattttatcttgtgatcagctagttttcttgcaagtcaattactgccagacatgtttctttttcttttaatttaggcagtagcttaacctcaac

SEQ ID NO: 1659 - DNA, 1125 bp, Brassica rapa
  misc_feature (1105)..(1105): n is a, c, g, or t
  misc_feature (1118)..(1118): n is a, c, g, or t
taagacttaagattacagaggcgatggcgattaacggcgaagatcgcatctccggcgaacgcccgatcatcatggtcaccaacgacgacgggatagacgcgcctggtctccgttctctcgttcgcgtcctcgtctccaccaacctctacgacgtccgcgtctgcgctcccgattcggagaagtctgctgttagtcacagtatcatatggagtagacctctcactgcacaccgtgttgagattgaaggagctgaggcctatgctgtttctggaacccctgcggattgcactggtttgggcttatccgaagcgctcttcccttctcttcctgacctggttcttagtggtataaacgttggtagcaactgtggctacaacatcgtctactctggaactgttgctggtgctcgtgaagccttcatttatgatgtgccttctgcctccatatcttatgattggaaacgtggagacatcaatgttaatgattttgttctgtctgcccaagcttgcttgcctattatcaacggcatgctgagtgccatcaagaacaaaactcacccaacaaactgctttctgaatatcgatttgccgactgatattgctaaccataagggatacaagctaactatacaaggtaaaagcttgggtaaaatgggatggagacaagtggaggaggaagcacaaggtgcgaagatgttgtcaacaatgtcaatggaaacagattcaggagtagtctcagacaacaacgacacttctgctcatcattcaaacgatagccgtttgttcaagagagagctaaggactgtggtggtggaagaaggcactgatcttcactttctgcgagaaggatatattacagtgacgccgataggagctctctctcaggttgatgtggattgtcaaaactactacaaagaatggcttcccaagatttcttcatccttgtgatgtcaccaaatgaaaacataaaactcttctgatgatttatccattatggaccacagtttgtggtagacctattatcagtactcttttaagttattttatcttgtgatcagctagttttcttgcaagtcaattactgattttttttcttctaacactgnttctgatctgaanactaata

SEQ ID NO: 1660 - DNA, 3148 bp, Arabidopsis lyrata
gaaagcttcacactcgggttctgcttctcgatctagcctccgacctctttgttcttaccacggatctcgcctgctctttttccgtacgacggtctgctttgtggatagtttggctgacgacgaggcgatttgaacattaacagttactgagtaattgctaaagatggagggtttcctaacggatgagcagagagagatgatgaaaaaagctacacagactgcagatgatcttccaccctcacaaaaacctcactcggttttgcttgagcatctccctaaagtatctgctggtgggaaagcttctggtgcgtcaaatgctgtgaagcacagaaggtctcatgcggggaggtctacccgatctaagaaggatgggtgtggtgggaaaggaaattggggaaaacttattgacactgacggagactatcacattgaccggaatgatccaaattatgacagtggagaggaaccattcgagcttgttggtgcaactctgtcagacccattagatgattacaagaaagctgcagcttccatcattaacgaatacttcagcactggtgatgttgatgtggcagcagctgacctcattgaacttggttcaagtgaatatcatccctacttcatcaagcggcttgtctcagtagccatggacaggcatgacaaagagaaggaaatggcctcagtgttgctttccgcattgtatgctgatgtcattaacccgaaccagataagagatggatttgtcctgctgctggagtcagctgatgactttgtggtggatatacctgatgctgtcaatgtccttgctttgttccttgcacgtgcggttgtggatgacatccttcctccagcttttcttcccagggcggccaaggcacttccagtaacttccaaaggttaccaggttgtccaaactgcagagaaaagctatctatcagctgcacaccatgccgagctcgtagaaagaagatggggtggacagactcgaacgactgttgaggaagtcaagaagaagattgctgacattttgaatgaatatgtggagactggagagacttatgaggcatgtcgctgcgttagagagttgggtgtgtctttttttcatcatgaggttgtgaagagggccttagttactgccatggaaaaccacgcagcagaaggactcgtattgaaactgctgaaggaagcagcttcagaaaacctgataagctctagtcaaatggtgaaggggttttcaaggttaagagaaagccttgatgatcttgctcttgacattccttcagctagaaccaaatttgatttgattgtgccaaaagctgtctcaggtggttggcttgatgcttcatttggttatccctctggtgaatgtggacgacagcagatcgaagatgagaaactaaagcggtttaaggaagacattgtgaccatcattcatgagtatttcaattccgatgacataccagaactcatacgcagtcttgaggatttaggagcaccggagtacaacccaatttttctaaagaagctgataacacttgctctggacaggaagaatcacgagaaagaaatggcatctgttcttctctcatctcttcacattgagatgttcaccacagaagatgttgcagatggttttgtcatgctcctggagtctgcagaagatacagctcttgacattctggatgcttccaacgaacttgctttgttcttagctagagctgtgatcgatgatgttttagcacctttcaacctggaagagatctgtagcaaactgcgacctaactcaagcggaactgaaaccgtgaagatggctaggtcacttatctttgctcgacatgcaggagagaggcttctaagatgctggggaggtgggagcggttgggcagtggaagatgcaaaagacaagatatcgaatctgctggaggaatatgaaagctcagggctggtatcagaagcgtgcaaatgcatccatgagctaggcatgcctttctttaaccatgaggtggtgaagaaagcactggtgatgggtatggagaagaagaaggacaagatgatgttggatcttctgcaggagagtttcggtgaaggactcataaccacaaaccagatgactaaagggttcacaagagtcaaagacgggctcgaagatcttgctttagacatcccaaacgcaaaggagaaattcaaggactatgtggagcatgggaagaagaatggttggagacaacaagaaagcgaagtctcgaagctaaaaatgaaattcgtaataccaaaactacccttcacactctctctcctcctctccctctctcttctcatcatcttcctcttcgccttccccaccacattcctccgccgtcctctctcctcctccgttatcgccgttgccgacgaagggatacggatccgtcatcatggatactcctcctacgaagcctacatcaaacaccagctcaacaaaactcaaaacccgaagctacgtaaggtatggaccacgcgcgactgggacaggaaagtgcgcgtgttctccactttcttccgacgtctcagcgatcgcggtctcctctcaaatcaatcaaaagctctctcgatcggcgcgcgagtaggccaggaagtggcggcgttgagattgatcggcgtggaagactccgtcgggatagatctggtgccgcgaccacctctggttgtgaaaggtgacttccacgcgcagccgttcgacgaggagacattcgatttcgaattctcaaacgtgttcgatcacgcgctttacccggagaagttcgttggggagatcgaacggacgttaaagcccggaggtgtgtgtgtgttacacgtgtcgatatctgggaagacggataagtactcggctaacgatttgtttagtgtgaaaccattggtgaatctgtttaagagatcaaaggtcgtggaaatgaggaagatcgatgggtttgggcttgatactgagattgtttttagaaagaacatcaactaaacacataaagattttaaaaagtagtctgttttaatttgtttcatttaatacatagtttcgttgataggttgaaagcaaattgtttctttttttgggtgtattttcattttctatcatttattatacacttgcaaatgtatacatcaataaattata

SEQ ID NO: 1661 - DNA, 516 bp, Arabidopsis thaliana
atgttatctccgattgagaatgagagatccgaaattccttcccctgagaagctgaagttagtggaggagccatccgacgatgaatctaagttctctaactatgattcggacgattgggaaactttgtctgatgatcttcgactgttagacgaagagtggggcaagagcgggggttttgatgtggacttctcgaaagtgcgtcacagatttggttgcggagctgttcatctcgacgacgacaatatggttagcgagcctcatgaaaccaacagagatttgctcaacaggttgtccaacatggctatctccttctacaacgacaagacggattcaagtttggaacttgtcaaggttttgagagcaaattttcacccatctgctgcaatcacgctctacatcacgttcgaagccaatgatcctaaagatggtaaccagactaaacgttaccaggcagtggtcctctacttgtcctttgatatccaagtgtgctcttgcaagcctgaaccatcttcttga

SEQ ID NO: 1662 - DNA, 1095 bp, Arabidopsis lyrata
aaaaagtactactaaagagtcgttccaataaaccccttttcccaataaaccctaattccttgcggcttcttcttcctcctcctccttcccactgtcatcaaatgtttggtgtttcgatgagaacattaatctcaccatctcttgctcctttctctcttcatctccctaaaccttctctcttctccaccgctcttcgcttctcctccctcaccacttccaccatctcaatcaacaacagatcccccacaaatgcacctccctccgccatttccaccagaaaactacaaacgaaagcgacggcgccgctctctttcacaactcccggcgaaatacacgtagtcgtcggaccaatgttctccggtaaaaccacaacacttctccgccgtatcctcgccgaaaaagaaaccggtaaacaaatcgcaatcatcaaatcaaacaaagacacaagatactgcactgaatcaatagttactcacgacggtgagaaattcccttgctggtcacttcccgatctctcgtccttcaaagagaggttcggattcgacgaatacgagaatcgattagatgtgattggaatcgacgaagctcaattcttcggagatctatacgagttttgccgtcaagctgctgatagagagggtaaaactgtaattgttgctggattggatggtgattttaagcggaggaggtttggttcggtgcttgatttgattccaattgcggatacggttacgaagctgacgtcacggtgtgaggtttgtgggaagagagctttgtttacgatgaggaagacggaggagaaagagacggagttgatcggcggagctgaagtttatatgcctgtgtgtcggagtcattacgtttgcggtcaaagcgttttggaaaccgctcgtgccgttttggattcttcaagcaataagcatgatgttgtagcaagtttgctttaatgtgtgcggagttgagagtttgtaggatttgtgatagtctttaaatattcggtttattaaacataattatgtactatataatcaatgtttttaagataacactcttatttgtgaatttcttgtagaaacccttatatcgaaaaaattt

SEQ ID NO: 1663 - DNA, 1215 bp, Brassica napus
gaactgggttttactcagatcaactagatcctaactgggtcgttgatcctcaacatctctttgttggtcccaagattggtgaaggatctcatgccaaaatctatgaaggaaagtataaaaacaaaacagttgctataaagattattaaaaagggagaatctcctgaagagattgccaaaagagatagcagatttgcgagagaggtctctatgttgtctaaagttcaacacaagaatttggtcaagttcattggagcttgcaaagaaccaatcatggttatagtcaccgagcttttactcggtggtacattgcgtaaataccttgtgagtttgcgtccagggcgtttggacatacgtttagctgttgggtttgctcttgacattgctcgagcaatggaatgtttacactctcatggaatcattcatcgtgacctcaaaccagagaacttgatcctgacctcagattacaagactgttaaactagcggatttcggtttagctagggaagagtcactaaccgagatgatgactgcagaaactggtacttatcgttggatggctcctgagctttatagcacggtcacgttgaggcaaggtgagaaaaaacactataaccacaaggtagatgcgtacagcttcgccattgtcttgtgggagcttatccacaacaagttacctttcgaaggcatgtcaaatctccaagctgcttacgctgctgcattcaagaacgtgaggccgagtgcagatgatttaccggaggatttagcaatgatagtaacatcttgctggaaagaagatccaaacgacagaccaaacttcacagagattattcaacttctcttacgttacctctccacaatctcagcaccggagcttgttcctccctcaatgaaacgtgttttctcgtcagaaaacaccgttctgccaccagaatcgccgagaacttgctcactgatggctgttagagacggagatcagattactacagacacaaactcgcctgagaaggaaggcagaggaagcttctttttctgctgctaattttagatgattgtgattggtttattggttaataaaagggaactgagaggaagtggtttaaaaaatataatgaataataaatgtatttaatttggttaaagatttacagcttagagttattgttataaatttgttgaaattatgtatagtttggttatgtttttcaattactacc

SEQ ID NO: 1664 - DNA, 1215 bp, Brassica napus
  misc_feature (680)..(680): n is a, c, g, or t
  misc_feature (692)..(692): n is a, c, g, or t
  misc_feature (710)..(710): n is a, c, g, or t
gaactgggttttactcagatcaactagatcctaactgggtcgttgatcctcaacatctctttgttggtcccaagattggtgaaggatctcatgccaaaatctatgaaggaaagtataaaaacaaaacagttgctataaagattattaaaaagggagaatctcctgaagagattgccaaaagagatagcagatttgcgagagaggtctctatgttgtctaaagttcaacacaagaatttggtcaagttcattggagcttgcaaagaaccaatcatggttatagtcaccgagcttttactcggtggtacattgcgtaaataccttgtgagtttgcgtccagggcgtttggacatacgtttagctgttgggtttgctcttgacattgctcgagcaatggaatgtttacactctcatggaatcattcatcgtgacctcaaaccagagaacttgatcttgacctcagattacaagactgttaaactagcggatttcggtttagctagggaagagtcactaaccgagatgatgactgcagaaactggtacttatcgttggatggctcctgagctttatagcacggtcacgttgaggcaaggtgagaaaaaacactataaccacaaggtagatgcgtacagcttcgccattgtcttgtgggagcttatccacaacaagttacctttngaaggcatgtcnaatctccaagctgcttangctgctgcattcaagaacgtgaggccgagtgcagatgatttaccggaggatttagcaatgatagtaacatcttgctggaaagaagatccaaacgacagaccaaacttcacagagattattcaacttctcttacgttacctctccacaatctcagcaccggagcttgttcctccctcaatgaaacgtgttttctcgtcagaaaacaccgttctgccaccagaatcgccgagaacttgctcactgatggctgttagagacggagatcagattactacagacacaaactcgcctgagaaggaaggcagaggaagcttctttttctgctgctaattttagatgattgtgattggtttattggttaataaaagggaactgagaggaagtggtttaaaaaatataatgaataataaatgtatttaatttggttaaagatttacagcttagagttattgttataaatttgttgaaattatgtatagtttggttatgtttttcaattactacc

SEQ ID NO: 1665 - DNA, 1334 bp, Raphanus sativus
  misc_feature (899)..(899): n is a, c, g, or t
  misc_feature (932)..(932): n is a, c, g, or t
  misc_feature (1009)..(1009): n is a, c, g, or t
  misc_feature (1191)..(1191): n is a, c, g, or t
  misc_feature (1208)..(1208): n is a, c, g, or t
  misc_feature (1226)..(1226): n is a, c, g, or t
  misc_feature (1258)..(1258): n is a, c, g, or t
  misc_feature (1299)..(1299): n is a, c, g, or t
  misc_feature (1303)..(1303): n is a, c, g, or t
  misc_feature (1307)..(1307): n is a, c, g, or t
  misc_feature (1315)..(1315): n is a, c, g, or t
  misc_feature (1328)..(1330): n is a, c, g, or t
gattcaaaaaattgagattgttgtttctttctcaagtctttttatttgtttttgttacatttatggacgtctcttgatttcgctttatagtcccctcccctctctaaaagcattttgtttgtttgtttctgatttgtaccaagaatgattgatcatctaaagggtttcgatttgacaggtttctaactataaaaaaaaaagatcatcaaaatctttaaaatctttttttgaaatgggatctggaactgggttttactcagatcaattggatcctaaatgggtcgtcgatcctcagcatctctttgttggtcccaagattggtgaaggatctcatgccaaaatctatgaaggagagtataaaaacaaaacagttgctataaagattattaaaaagggagaatctccagaagagattgctaaaagagatagcagatttgcgagagaggtctctatgttgtccagagttcaacacaagaacttggtcaagttcattggagcttgcaaagaaccgatcatggttatagtcactgagcttttactaggcggtacattgcgtaaatacctcgtgagtttgcgtccagggcgtttggacacgcgtttagctgttgggtttgctcttgacattgctcgtgcaatggagtgtttacactctcatggaatcattcatcgtgatctcaaaccagagaacttgatcttgacagcagattacaagactgttaaactagcggatttcggtttagctagagagatcactaaccgagatgatgactgcagaaactggtacttatcgttggatggctcctgagctttatagcacggtcacgttgaggcaaggtgagaaaaaacactataaccataaggtagatgcgtgcagcttcgccatcgtcttgtgggagctnatccacaacaagttaccttttgagggaatgtcnaatctccaagctgcttacgctgctgcattcaagaacgtgaggccgagcgcagatgatttaccggaggatttagcaangatagtaacatcttgctggagagaagatccaaacgacagaccaaacttcacagagattattcaacttctcttacactacctctccacaatctcagcacctgagcttgttcctccctcaatcaaacgtgttttctcatcagaaaacaccgttctgccaccagaatcaccgggaacttgctcantgatggctgttagaganggagatcagattaccacngacgcaaactcgccggagaaagaagcttcttnttctgctgctaatttagatgatgattgttttattggttatnaagngaantgagagantggtttgaaaaannnaatg

SEQ ID NO: 1666 - DNA, 1587 bp, Prunus persica
tgctactttgccatccttgtttctttgccagtttcccagttccccaaaataataaatataatcctctctactgacagagctcccatcaaacttcatttttaaattcttggttgttggtgggtgcctctgggtttttattctttgcctcccaaacaaaggcaggcattagattttgttggattggatctacaagcgtgattttggggatgtgtctgttttctgaaacctgctattatggcctatccctacacaacagaaccaagcatgtccttttattatagttttatcatctaactctctctatctttctcccacttcaatcacagaaagtatacttattttaatactttttgtttttgttttttttttccatttttaagctgaccaaagcttccacctttacttcaaatgtaggagacaaacagaaaaaaaagggtatgctttgttttggttagtcagtatatgcagctagtaggttcagctcttgttttcaagaatttatagagaaaatatgggatctggtaatggggtttattcagttggggatttcaatttggatgccaagtggctgatcgatccaaagcttctttttgttgggccgaggattggggagggcgcgcatgccaaagtgtacgaaggaaaatataagaatcaaactgttgctgtaaaaattgttcatagaggagaaactccagaggagattgccaagagagaatcacggtttgcaagggaagtggcaatgctgtccaaagtgcagcacaaaaatttagtaaagttcattggtgcctgcaaagaacctgtcatggtcatagtgactgagcttcttctgggcgggactttgcgcaaatacttgttcagtatgcggccaaggtgcttggacatatgcgtggcagttgggtttgcacttgatattgcccgtgctatggaatgcttacactcccatggaatcattcaccgggacctgaaacctgagaatttgatcttgactgcagaccataaaacagttaaacttgcggattttggcttagcaagagaagagtcgttgacagagatgatgaccgccgaaactgggacatatcggtggatggctcctgagctttacagcacagttacattacgacatggagagaagaagcattacaatcataaggtggatgcttacagctttgcaattgtattgtgggaactcatccataataagctgccttttgaaggcatgtcgaatctacaggcggcatatgcagctgcttttaagaatgtgaggcccagtgctgaaaaccttcctgaggatttggctttgatcgtaacttcatgttggaaagaggatccaaatgatcggcccaactttacccaaattatacagatgctgctgcattatctttctactatttcagcaccggaacctgctatcccccaacggatattcagatctgagaacgctgtactgccgccagaatcacctggtactagttctttgatgactacgcacgatgactcaggtgaaacccctaaaatcgacgtggaagagaagcctaaaggtttttccttctgctttagccagtgttattgatcctctaaagccataat

SEQ ID NO: 1667 - DNA, 1959 bp, Populus trichocarpa
aatgttttgtttatcttatgtagaaggagaagcacagactcaaatcctgccgcggctttttctactgatcaaagaaacaaaggcacttccatacgcgtagattgctttaataatctctttaactctaaatctcaatctgtgccattcccttagcctcctctactccaatcctcccttcattattttttctttttctttttttggtcatactctctcccacttctccatataattttatctgctcctcacagagcttcttggggatattttttttaatgagtacccttcgttttttaaattcttgttttggtagtgacattctctgaaacatgtagggttttattctttgcctcccaaacaaaggcaaatgctaatctctttggatctaaagttgtgatttttgggtacaacatggagcatgtttatttatagttaatctctttcgtatagaattggtatcttgctttcccatttctttaatttgacttgtttagctgtttagtctacttaaaaaaaaggagtgttataaaaaaataaataaataaagttttggtctttgtttagttagttgatgatgtttcatttgcagatagtataggttaagaaatgggatctagtaatgggttttattctgaagagttcgatttggatgctaagtggcttattgatccaaagcttctattcgttgggccaaagattggggaaggtgctcatgctaaagtatatgaaggaaagtacaaaaatcaaattgttgctattaaaattgtacatggaggagaaaccccagaagagattgccaagagagaagcgcggtttgcaagggaggttgcaatgttatctagagttcagcacaaaaatctagtgaagtttattggtgcttgcaaggagcctgtcatggtgatagtaactgagcttcttttgggcggaacattgcgaaaatacttgctgaacatgcggccaaggtgcctggacatgcgtctggctgttggatttgctcttgatattgctcgtgcaatggaatgcttgcactcccatgggataattcatcgtgacctaaaacctgagaatttgatcttgactgcagaccataaaacagttaaacttgctgattttggtttagccagagaagagtcattaacagagatgatgactgctgaaacggggacgtaccggtggatggctccagagctttacagcacagtcacattaaggcatggtgagaagaaacactataatcacaaggtggatgcttatagctttgcaattgtgttgtgggagctcattcataataaattgccttttgaaggcatgtcaaatctacaggcagcatatgcagctgcttttaagaatgtgagacctagtgctgagaacctcccagaggatttggcgttgattgtgacctcatgttggaaagaagatccaaacgctaggccgaacttcagccaaataatacagatgctcctgcattatctttctaccatttcagcaccaaaacccgtcatccctgctaggattttcacatctgagaatgccgttttgccaccagagtctcctggtacaagttccttaatggctgtaagagatgacttaggggaaaccccaagaacccagatagaagacaagccgaaaagtttttttttctgctttaaccaatgttactgatccctcctgatacacaaaagtcgtctctggaggtgtttaggcacattacaataagcaagtcttaaatattagaatacgcttaaatctttatgaaaatggtcgatctagttagttcagttgcaataggaagttactcatcatctgattgatgtcttcattaacctttgcacgcttctccccatgaatactagtttgttctgacaatgtatttagggttttggagttggggttgctgtgatgatttatcatcaccgaaatataaggtccgtccaaaggccttcactcctgctgcataca

SEQ ID NO: 1668 - DNA, 1869 bp, Populus trichocarpa
aatgttttgtttatcttatgtagaaggagaagcacagactcaaatcctgccgcggctttatctactgatcaaagaaacaaaggcacttccatacgcgtagattgctttaataatctctttaactctaaatctcaatctgtgccattcccttagcctcctctactccaatcctcccttcattattttttctttttctttttttggtcatactctctcccacttctccatataattttatctgctcctcacagagcttcttggggatattttttttaatgagtacccttcgttttttaaattcttgttttggtagtgacattctctgaaacatgtagggttttattctttgcctcccaaacaaaggcaaatgctaatctctttggatctaaagttgtgatttttgggtacaacatggagcatgtttatttatagttaatctctttcgtatagaattggtatcttgctttccatttctttaatttgacttgtttagctgtttagtctacttaaaaaaaaggagtgttataaaaaaataaataaataaagttttggtctatgtttagttagttgatggtgtttcatttgcagatagtataggttaagaaatgggatctagtaatgggttttattctgaagagttcgatttggatgctaagtggcttattgatccaaagcttctattcgttgggccaaagattggggaaggtgctcatgctaaagtatatgaaggaaagtacaaaaatcaaattgttgctattaaaattgtacatggaggagaaaccccagaagagattgccaagagagaagcgcggtttgcaagggaggttgcaatgttatctagagttcagcacaaaaatctagtgaagtttattggtgcttgcaaggagcctgtcatggtgatagtaactgagcttcttttgggcggaacattgcgaaaatacttgctgaacatgcggccaaggtgcctggacatgcgtctggctgttggatttgctcttgatattgctcgtgcaatggaatgcttgcactcccatgggataattcatcgtgacctaaaacctgagaatttgatcttgactgcagaccataaaacagttaaacttgctgattttggtttagccagagaagagtcattaacagagatgatgactgctgaaacggggacgtaccggtggatggctccagagctttacagcacagtcacattaaggcatggtgaaaagaaacactataatcacaaggtggatgcttatagctttgcaattgtgttgtgggagctcattcataataaattgccttttgaaggcatgtcaaatctacaggcagcatatgcagctgcttttaagaatgtgagacctagtgctgagaacctcccagaggatttggcgttgattgtgacctcatgttggaaagaagatccaaacgctaggccgaacttcagccaaataatacagatgctcctgcattatctttctaccatttcagcaccaaaacccgtcatccctgctaggattttcacatctgagaatgccgttttgccaccagagtctcctggtacaagttccttaatggctgtaagagatgacttaggggaaaccccaagaacccagatagaagacaagccgaaaagtttttttttctgctttaaccaatgttactgatccctcctgatacacaaaagtcgtctctggaggtgtttaggcacattacaataagcaagtcttaaatattagaatacgcttaaatctttatgaaaatggtcgatctagttagttcagttgcaataggaagttactcatcatctgattgatgtcttcattaacctttgcacgcttctccccatgaatactagtttgttctgacactgta

SEQ ID NO: 1669 - DNA, 1883 bp, Ricinus communis
tttctctctatctgtgactctgtctatttttttattgctcttttttcttttctttctttctgtagaaaacaaaatataataaaagcccactactgttctctgacaatgacttgcatcctgccgcggcttctttatctatccatctatctaccagcagatcaaagaaaatagagaaaactgagctttcccatacgcgttatagcaagaaaagagcttctaaataaaataaaattttaaaagaattctaatctctctgtcaaatcttttatctgggtttgttttcttttagccttttctttcatctttcattgatatatactgtctacgttcttcacttccctgtaaatttttatccattactctgtttcttgacaggactttgttgggttttccttttcttttcttttctttggtgattctcccagtcttttattttctttattttttagttgttgtttctgttgcttatccttctctaagatatatgtgggattttattctttgcttcctaaacaaaggcaaatattgatctttttggatctacaggcttgattttaggtacaatgtatggggtgtgtttatccatagtatttattatttcttaacttgactgagctgagctttaacttttgtttttagtttactacaaagggctttgattcttcttcttcttcttttctttttcttcttcaagtcaatagatggcagttcattaggtgatgatttagagttctgagattaaaaaatgggatctactgataatgggttttattctggagaatttaatttggatgctaagtggttgattgatcctaaacttctccttgttggtccaaagattggagaaggtgctcatgccaaagtatatgaaggaaagtataagaatcgaattgttgccatcaaagttgttcatagaggagaaactccagaagaaattgccaagagagaagcacgatttgcaagagaggttgcaatgttatctagagttcaacacaaaaatctagtgaagtttattggcgcttgcaaggaacctgtcatggtgatagtaactgagcttctgttaggtgggacattgcgtaaatacctgctgaacttgcgaccaagaagcctagaactgcatgtggcaatcgggtttgcacttgatattgctcgtgctatggaatgcttgcactcccatgggatcattcatcgcgacctaaaacctgagaacttgatcttgactgccgaccataaaacagttaaacttgcagattttggattagccagagaagagtcattaactgagatgatgactgctgaaacgggaacatatcgttggatggctccggagctttacagcactgtcacattaaggcatggtgagaaaaagcattacaatcacaaggtggatgcttacagctttgcaattgtcttgtgggagctcattcacaataaattgccctttgagggcatgtcaaacttacaggcagcatatgcagctgcttttaagaatgtgagacccagtgcagatgacctcccagaggaaatggcaatgattgtgacctcatgttggcaagaggatccaaatgctcggccgaatttcacccagataatacagatgctcctgcgatttctttctaccatttcaccgccagagcctgtcatcccagctcggatatttacttctgagaatgctgttttgccaccagagtctccaggcacaagctctttaatggctgtgagagacgactcaggggaaaccccgaagtctaagatggaagacaacaaaccaagaggtttctttttctgttttaaccagtgttactgatccctccaaaggcacaaagtcgtcggtggaggtagtttaggcaagggtttaataaaacaatagtctgaaatattag

SEQ ID NO: 1670 - DNA, 1999 bp, Populus trichocarpa
atacgcgtagattgctttaaactaatctcttttacaccaaatctcaatctgggtctctctcccttttagccgcctcctcctccacttcaatcctccattcatttttccccttctcaatagtataattttatctgcttctgacagagcttgttgggagtgttttttttttattgattcccatttgtattttaaattcttgttttgttagtgactgtctctaaaacatgtggggttttattctttgcctcctaaacaaaggcaaatgcttatctttttggatctaaagttgtgatttttggggtataatatggagcatgtttatttatagtttatctcttttctatcaaagtggtatcctgctttccatttctttaacttgactagctagctgtttactctgcttcaaaagagcgatagcttaacttttggtcttgttcagtttgttgatgttatttcatctacttttagtatagagtaagaaatgggatctagtaatgtgttttactctggagagttcaatttggatgccaagtggctcgttgatcctaagcttctatttgttgggccaaagattggagaaggtgctcatgctaaagtatatgaagggaagtacaagaatcaaaatgttgccattaaaattgtacatggaggagaaaccccagaagagattgccaagagacaagctcggtttgcaagagaggttgcaatgttatctagagttcaacacaaaaatctagtgaagtttattggtgcttgcaaggagcctgtcatggtgatagtaactgagcttcttttaggtgggacattgcgcaaatacttgctgaacatgcgaccaaggtgcttggaaatgcgtgttgcttttgggtttgctcttgatattgctcgtgctatggaatgcttacactcccatgggatcattcatcgtgacctaaaacctgagaacttgatcttgactgcagaccataaaacagttaaacttgcagattttggtttagccagagaagagtcattgacagagatgatgactgctgaaacagggacataccggtggatggcaccagagctttacagcacagtcacattaagacatggtgagaagaaacactataatcacaaggtggatgcttatagctttgcgatagtgttgtgggagctcatccataataaattgccttttgaaggcatgtcaaatctacaggcagcttatgcagctgcttttaagaatgtgagacccagtgctgaaaacctcccagaggatttggctttgattgtgacctcatgttggaaagaagatccaaatgctcggcccaacttcagccaaattatacagatgctcctgcattatctttctaccatttcagcaccagagcccgccatccctgctaggatattcacatctgagaatgcagtttttcccccggagtctcctggtacaagttccttaatggctgtaagagatgactcaggggaaaccccaagaacccagatagaagacaagccgagaggtttctttttctgctttaaccaatgttactgatccctcctgatacacaaagtcgtttctggaggtatttaggtacattcaaataagcaagtctcagatattagaatatacttacatgtttgaaaaaaaaaaatgtcaatctagttagttcagttgcagtaggaagctactctcatctgattattaacttttccacacttctccccatgaatattagtctggtccgacttgtgtatttagggtttcggagttggggttgctgtgatgatttatcattattgtaaaataaggtccgtccaaaggcctttactcctgttgttcatcaagaatatacatgactatgttagagttgatgatgctttggtcatgtatgcatcgacttgaggcatgccgcaagctcttaattgtgcattcaggcttgtgtcgatatgctactactgtgtgtgtgtgtatgtattaatggtggtaataaacttagattgatccgaaatgctt

SEQ ID NO: 1671 - DNA, 1997 bp, Populus trichocarpa
atacgcgtagattgctttaaactaatctctttaacaccaaatctcaatctgggtctctctcccttttagccgcctcctcctccacttcaatcctccattcatttttccccttctcaatagtataattttatctgcttctgacagagcttgttgggagtgttttttttttttttattgattcccatttgtattttaaattcttgttttgttagtgactgtctctaaaacatgtggggttttattctttgcctcctaaacaaaggcaaatgcttatctttttggatctaaagttgtgatttttggggtacaatatggagcatgtttatttatagtttatctcttttctatcaaagtggtatcctgctttccatttctttaacttgactagttagctgtttactctgcttcaaaagagcgatagctaaacttttggtcttgttcagtttgttgatgttatttcatctacttttagtatagagtaagaaatgggatctagtaatgtgttttactctggagagttcaatttggatgccaagtggctcgttgatcctaagcttctatttgttgggccaaagattggagaaggtgctcatgctaaagtatatgaagggaagtacaagaatcaaaatgttgccattaaaattgtacatggaggagaaaccccagaagagattgccaagagacaagctcggtttgcaagagaggttgcaatgttatctagagttcaacacaaaaatctagtgaagtttattggtgcttgcaaggagcctgtcatggtgatagtaactgagcttcttttaggtgggacattgcgcaaatacttgctgaacatgcgaccaaggtgcttggaaatgcgtgttgcttttgggtttgctcttgatattgctcgtgctatggaatgcttacactcccatgggatcattcatcgtgacctaaaacctgagaacttgatcttgactgcagaccataaaacagttaaacttgcagattttggtttagccagagaagagtcattgacagagatgatgactgctgaaacagggacataccggtggatggcaccagagctttacagcacagtcacattaagacatggtgagaagaaacactataatcacaaggtggatgcttatagctttgcgatagtgttgtgggagctcatccataataaattgccttttgaaggcatgtcaaatctacaggcagcttatgcagctgcttttaagaatgtgagacccagtgctgaaaacctcccagaggatttggctttgattgtgacctcatgttggaaagaagatccaaatgctcggcccaacttcagccaaattatacagatgctcctgcattatctttctaccatttcagcaccagagcccgccatccctgctaggatattcacatctgagaatgcagtttttcccccggagtctcctggtacaagttccttaatggctgtaagagatgactcaggggaaaccccaagaacccagatagaagacaagccgagaggtttctttttctgctttaaccaatgttactgatccctcctgatacacaaagtcgtttctggaggtatttaggtacattcaaataagcaagtctcagatattagaatatacttacatgtttgaaaaaaaaaaatgtcaatctagttagttcagttgcagtaggaagctactctcatctgattattaacttttccacacttctccccatgaatattagtctgttccgacttgtgtatttagggtttcggagttggggttgctgtgatgatttatcattattgtaaaataaggtccgtccaaaggcctttactcctgttgttcatcaagaatatacatgactatgttagagttgatgatgctttggtcatgtatgcatcgacttgaggcatgccgcaagctcttaattgtgcattcaggcttgtgtcgatatgctactactgtgtgtatgtattaatggtggtaataaacttagattgatccgaaatgctt

SEQ ID NO: 1672 - DNA, 2305 bp, Arabidopsis lyrata
tatatagcttctagtctcctgtgaaagagataaagagagagagagagaattgtgttgttgcatagttccaataatggcaaagacgattcaagccatcatcactatctgttcccttcttctgcttcttctactctctgcaacaacttctcatcctctttgctcagattcaaagactccagttaacaacaacgagacactccagttctgcgattcctacaaaggaaaatcttgctgcaattccaaagatgatcttcaattacagaatcgcttcaactccatgaacatctctgactctaattgttcttctcttctcaaatccattctttgctctaaatgtgatcaatcctcaggacaattgtttgatgatgatagttctctagttccaattctttgcaactcaacttcacaagacttatgctcaaagctttgggattcatgtcagaacatttccattgtttcttctccttttagtcccactctactaggtggtgctacttcaccttcaacttcctcaaattcatcaacattaaccgatctttggaaatcccaaaccgaattctgtaccgcctttggtggaccatctcaaaccaacaacaacaaaaccaaatgctttaatggtgaaccggttaacaaagacaccgatgttaagccaccaaaaggagtatgtcttgagaagataggaaccggatcttacttaaacatggtggctcatcctgatggttctaaccgggcctttttctctaaccaacctggtaagatttggttaggaacaataccggatcaagactcaggtgaaccgatggaaatcgatgaatcgactccttttgttgatattaccgatcaagtcagtttcgatacgcagtttggtatgatgggaatggcgtttcatcctaaattcgcagagaacgggcggtttttcgcgtcttttaactgcgataaagtcaaatctcctggatgttctggtcgttgtgcttgcaattctgatgtaaattgtgatccttctaagcttcctaaagacgatggcgcgcatccttgtcgttatcagaccgtcgtggctgagtatactgcaaatggtacttcctcgagcccttcaacggcaaagattggtaaagcctctgaagtgaggaggattttcactttgggacttccgtattcgtcatctcacggtggtcagattctctttggacctgacgggtatttgtatctcatgactggtgacggaggaggagtttcagatactcacaactttgcacagaacaagaagtcgttacttggaaaaatcttgaggcttgatgttgatgttatgccaagcgtatctgaaatctcaaagcttggtttgtggggaaactactctatcccaaagaacaatcctttccaaggcaatgaaaatgagcagcctgagatttgggctttaggtctaagaaatccatggcgctgcagcttcgattccgaaagaccagattacttcttgtgcgctgatgttggaaaggatacatatgaagaagtagatatcataacaaagggtggaaactatggctggagaacttatgaaggaccttatgttttctccccattatcgccttttggagaaaatgtttccgcggattcaaaccttacattcccgattctcggttacaaccactctgaagtgaacaaacatgaaggatctgcttccattattggaggttacttctatcgatccaacactgatccttgctcttatggaacgtacttgtatgcagatctttatgcaaacgcaatgtgggcagcgattgaatcaccagaagatagtggaaacttcacagactctctaataccgttcagttgcagtaaggattcgccgattaagtgtaccgcggctccaggaggagctagctcaggacctgctcttggttacatctactcttttggacaagacaataacaaggacatacatttgctcacgagctctggtgtgtatcgagttgttcgtcctagtcgttgtaacttagcttgctccaaagaaaacactaccgcttctaccggaaaacagaaccctgctggtgctgctcctcctcagcctttaccttcttctgcaagaaagctctgtttctctttgtttttgttagtgtcgttgttgtttatgtttttaacggttttagattagaatgataattgtttcagactctgttttgtaacatgtcttatggatattattcaaaaactattttgtgattgcttatattagacgaaatcatatataataaaccattaagtttgagttcttttgttttgttacgtcgcagcaatgtgatcaatttctcag

SEQ ID NO: 1673 - DNA, 3281 bp, Arabidopsis thaliana
aataaggtattgtcaagtaaatggtagtgaatattccgacttgtgctcaaatttgagttctctttctctgtctcatccatttaaacttttttttcttctgtctcccccatttgtaatcaatagtaacgaaacgtgtctcgtcaatttttgtcaatggactaaagagaaacttttttttcagttcttgtgaaaatattggattattatggatcgtggcataaaaatctgattactgtttcataagcttccagtattcttttttgttaatggcggaagcaaacgagagaagtaaagaaatggcgagaagtaatagttgtgtgtttccaagagatctgcttcagagatttatctctaactctgttgaaggtgaagatgatgatgaagaagaagatgatgatgagatcgagttaaatcttggcttatctcttggtggaagatttggtgttgataagagtaataagcttgtgagatcttcttccgttgttgtaacgatgcctctgtttcgtgaagatcatcatcatcatcaagcggcggcgatgataacaactaaggtttcgacggagacggtggcgggagcgactcggggtacgggtttgatgagaacgacgtcgttgccggcagagtcggaggaagagtggaggaagaggaaagagatgcagactttgagaagaatggcagccaagagacggagaagcgagaagcttcgtactggcgtcggcggaggaaacagtaataatccggaagaagctgctactgccaccgcttcgagacggcgaggtagaccatcgtcaggacttccacggtggtcagcgactgctaacaaaagcgggcttttgcggcagcacagtgctggtctcgattcactacaagtttccggtgaatctctaggcggaggaagagccgccggaagttcttcgagcgtctccgagttggaaactaaagcgtccagtgacgaagcaagaagcttaccatcaactacacagccacaacaagaaacaacgacaaagccaacaaatcgtttgagaagattgagttcagtggacatgaacatgaagatggagccacaagggaaaggaaaaagtgagatgccatgtgtgtttaccaaaggagatggaccaaatgggaagagagttgatgggattctttatagatacggcagtggagaagaagttaggatcatgtgtgtttgccatggcgatttcttgtctccggcggatttcgttaaacatgccggtggtcctcatgtagatcatcctcttagacacattgttgtcaacacttcttctccttctaatctcttataatagaccaaaaaccctctaaccaacccttgtttagagaagatgtttttaagagtctctggtcatttctcaatttttaagtcatatatgtattttttacctgctttatacagagagaattaaggagaaagaaacatcatttatatcagttttcaagagagtagactgagaataacattttgatgatgcatatgaaaaacctccctagcactgaaaatataaaaaacagacttgagaaagattctaatggctaggcacttgtttgctgctgtacaaatcctctaaaaacacctttcttctagctttgtatcacaatctagaaggctggattcgtttcagcagtcttacagcttgtttcattgtcggccttatcgagaggctatcgacggtgcatttgagtgccaaatgcagaacctcgaccaaatcgtctggaggaccagtctcccatagtcctgtggtgaagacttctttcgctttgccttgactcaacatcatatgagcccacgagacaatgttgaacccgttctcatgcgatgagaaagaaggatccagagctcgtttgtccgatatcagctccaagaggactatcccatagctgtaaacatctgctttctccgagactcggcatgtcattgcgtactctggagctacatatccgaatgttccagccacaccagttgtgacatgagactgcgaagttcccaagagtttcgagagtccgaaatcagatagataagcgttgtagttgttgtccaagagtatgttactcggtttgatatctctatgcaagactttaggagaacactgttcgtgaagataggagagagcacgcgctacatcaagagcaatcttgtgaagtaccttccactcaatagcagctttcgatctctctttaatgaaatcttgaaggtttcctccagataagtagttgtaaataagaaacatctcggtttcgctcgcatggtaaccgattaacataacaagattcggatgcctaaccatctcaagagcagagatctcagcatgaaactgttgatcaccttgaaacctcccaacagagagtcttttaacagcaaacacattcgttggagacacctctgctttataagtcgaaccgaaaccgccgtgaccgatacagttagagttactaaagtaaccagtagctctaacaatgatctcatacgtcagaggaataccaatgtcaacaaacactttaatctccttgatctcatctacctgaacctgagagtttcgtttccatttcctcgtgtagatgaacaagatcacaagaacaagaagcacaaagacaatcactgaagctgacacaatagaagctatctcaatcggatacaatccagatttaccaggagaatcatcatcagctgagcttggaccaatttcatcttcatcctcaaaactcataagtttcctaagaacaacattatcaacaaccctaattccaccgataaagttgttacctttaagatcaagaatctctaatttctccaacccccaaatctcctttggaatctcacctctaagatcattaaaagacagagataaaaccctaatttcagacaaatctccaacaacaggagagattacaccaccaagtcttcttttacttgaagaacaagaagacaaatctgggagatgaagaacaccactaccttcaagctcatcacagcctctgagaattaaagaaacgactctcgaatcagagttgcaagagacaccgtaccaagaacaatggtttgatgagctgtcggaaacccagctagacagaactccatttggatccaagaaactactcttcaacttcaacagagcagcttcgtcgtggagaccaccaccactctcggttaaaagtttccgagaaaacgaaaacataaacagattaaacagcaagaagaccaaacccagaagtttcatttttcttctttttcttcacaagagaaagagaaagagacgacggcaaaa

SEQ ID NO: 1674 - DNA, 3280 bp, Arabidopsis lyrata
aataaggtattgacaagtaaaattgaactgaatattctgtcttgtactcaaatttgagttctctttctctgtctcatccatttcactttttttttggtctgtctcccccattttattcaatagtaacagaacgtgtctcgtaagtttttattaatggattaaagagaaactttttcttcttctgcaaatattggattatggatcgtggcatcaaaatctgattactgtttcatcagcttctttgttgttaatggcggaagcaaacgagagaagtagagaaatggcgagaagtaatagttgtgtgtttccaagagatctacttcagagatttatctctaattctgttgaaggtgaagatgatgatgaagaagaagaagatgatgagatcgagttaaatcttggcttatctcttggtgggagatttggagttgataagagtaataataataagcttgtgagatcttcttccgttgttgtgacgatgcctctgtttcgggaagatcatcatcatcatcaggcggcggcgatgataacgacgaaggtttcgacggagacggtggcgggagcgacgagggggacgggtttgatgagaacgacgtcgttgccggctgagtcggaggaagagtggaggaagaggaaagagatgcagactttgagaagaatggcggcgaagagacggagaagcgagaagcttcgtaccgtcgccgtcgccggtggaggaaacagtaataatccggaagaagctgtcactgccaccacttcgagacggcgaggtagaccatcgtcaggacttcctcggtggtcagcgacggctaacaaaagcgaacttttgcggcaacacagcgctgctcttgattcactacaagtttccgttgaatctcaaggcggaggaggaggtggaggagccgccggaagttcatcgagcgtctccgagttggaaactaaagcgtcgagcgatgaagcaagaagcttaccatcaacgacacaacaacaagaaacaaccacaaagccaacaaatcggctgcgaagattgagttcagtggacatgaacatgaagatggagccacaagggaaaggaaaaagtgagatgccatgtgtgtttacaaaaggagacggaccaaatgggaagagagttgatgggattctttatagatacggtaatggagaagaagttaggatcatgtgtgtttgccatggcgatttcttgtctccggccgatttcgttatacatgccggtggtcctcatgtagatcatcctcttagacacattgttgtcaacacttcttctccttctaatctcttataatagaccaaaacccctctgatccaacccacttttgtttagagaagatgtttttaagagtctctggtcatttctcaatttttaagttatatatgtatttttattactttatacagagaagagaattaaggagacagaaacatcatttatatcagtttcaagagagtagaatgagaataacattttgatgattcatatgaaaaacctccctacactgaaaattttaaaaacagacttgaaaaagattctaatggctaggcacttgtttgctgctgtacaaatcatctactaaacacacactttcttctagctttgtatcacaatctagaaggctggattcgtttcagcagtcttacggcttgtttcatcgtcggccttatcgaaaggctatcgactgtgcatttgagagccaaatgtagaacctcgaccaaatcgtctggtggactagtctcccatagtcccttggtgaagacgtctttggctttgccttgactcaacatcatatgtgcccaggacacgatgttaaacccgttctcatgcgaagagaaagatggatctagcgctcgcttgtccgatatgagctccaagagaactatgccgtagctgtaaacatctgctttctccgagacacggcacgtcattgcgtattctggagcaacatagccaaatgtaccagctacacctgttgtgacatgagactgcgaagttcccaagagtttcgagagtccgaaatcggatagataagcgttgtagttgttgtccaagagtatgttactcggtttgatgtctctatgcaagactttaggggaacactgttcgtgaagataggcgagagcacgcgcaacatcaagagcaatcttgtgaagaaccttccactcaatagcagctttcgatctttctttaatgaaatcttgaaggtttcccccggataagtagttgtagataagaaacatctctgtttcactcgcgtggtaaccgattaacataacaagattcggatgcctaaccatctcaagagcagagatctcagcatgaaactgttgatccccttgaaacctcccaacagagagtcttttaacagcaaacacattcgttggagacacctctgctttatacgtcgaaccaaaaccgccatgaccgatacagttggagttactaaagtaaccagtagctctaacaatgatctcatacgtcagaggaataccaatgtccacaaacactttgatctccttgatttcatctacctgaatctgagagtttcgtttccatttcttcgtgtagaggaacaagagcacaagaacaagaagcacaaagacaatcactgaagccgacacaatcgaagcaatctcaatcggatacaatccaggtttaccaggagaatcatcagctgagcttggaccaatttcatcttcatcttcaaaactcataagtttcctaagaacaacatttcaagaaccctaattccaccgataaagctgttacctttaagatcaagaatctctaatttctccaacccccaaatctcctttggaatttcacctcttagatcattaaaagacagagacaaaaccctaatttcagacaaatctcccacaaccggagagattacaccaccaagtcttcttctacttgaagaacaagaagacaaatctgggaaatgaagaacaccactaccttcaagctcatcacaacctctgagaatcaaagagacgactcttaaatcagagttacaagagacaccgtaccaagaacaatggtttgatgagctgtcggaaacccagctagacagaactccatttggatcgaagaaactactcttcagcttcaaaagaacagcttcgtcgtgaagaccactctcggttaaaagtttccgagaaaatgaaaacacaaacaaattaaacagcaagaagaccaaacccagaattttcatttttcttcttcttcacaagagaaagagaaagagagacgacggcagat

SEQ ID NO: 1675 - DNA, 2164 bp, Brassica napus
ccctcaggatcgagatatcgataagcttgatatcaatacgtatctgccattacggacggggggtctctgaataccaataccaccaacaccatatggggtactggagtgctccattttgggattgtctaacttcctctcttctcctgctttttctttcagaattgcacgcgtagagtgagataacttggagactgtaacccttttaaaatcaaattccttgaagcagttaggttaaaacaatggttgtgtttgggaatgtttccgcggcgaatttgccttatcaaaatggatttttgaaggcaatttcatctggaggttgtgatttaatgggacaccgcagcttcaaaatttcaacttgttttaagacaagaacaaggaggaggaggagtgctggtcctttgcaggtagtttgtgtggatataccaaggccagagctagagaacactgtcaacttcttggaagctgcaagtttgtctgcatctttccgtagtgctcctcgtcctgcgaagcctttaaaagttgtcatcgctggtgctggattggctggattgtcaacagcaaagtacctggctgatgcaggacataaacctctgttgcttgaagcgagagatgttcttggtggaaagatagctgcatggaaggatgaagatggagattggtatgaaaccggtttacatatattttttggtgcttatccgaatgtgcaaaacttatttggagaacttgggatcaatgatcggctgcagtggaaggaacactccatgattttcgccatgccaagtaaacctggagaatttagtagatttgatttcccagatgtcctcccagcacccttaaacggaatatgggctatattgaggaacaacgagatgctgacatggccagagaaaataaagtttgctattggacttcttccggctatggtcggaggtcaggcttatgttgaggctcaagatggtttatcagttgaacaatggatgagaaagcagggagtacctgatcgagtgactgatgaggtgttcattgccatgtcaaaggcgctaaactttataaacccggacgaactttcaatgcaatgcattttgatagctttgaatcggtttcttcaggagaaacatggatcgaagatggccttcttagatggtaatccaccggagaggctatgcatgccaatagtggaacatattcgatcactaggtggagaagtgcgacttaactcaaggataaggaagattgagctcgaggatgatggtactgttaagagtttcttactcactgatggaaccactatccaaggagacgcttatgtctttgccactccagtggatatcctgaagcttcttttaccggattcttggaaagagataccatacttcaagagattggagaagttagttggtgtgccagttattaacgttcatatatggtttgatcgaaaactgaagaacacatatgatcatttactctttagtagaagtaaccttctgagtgtgtatgctgacatgtcgttaacatgtaaggaatattacgatcctaaccggtcaatgctggagttagtatttgcacccgcagaggaatggatatcacggaccgactctgacatcattgatgcaacgatgaaagagctcgagagactcttccctgacgaaatcgctgctgaccaaagcaaggctaagattctcaagtaccatgtcgtcaaaactccaaggtctgtgtacaagacgatcccagactgtgaaccatgtcggccactacaaagatctcctattaaaggattctacttagctggggattacactaaacagaagtacttagcttccatggaaggcgccgttctctctggcaaattctgctctcagtctattctaaaggattacgagctattggctgcttcctctggaccgcaaaagttgtcggaggcgactctatcaacataagacaggaagcttaaaatattttgtaacttttgtgtacaaacctcatttcaatacaaagttacagatttggcaaaaaggaaacaatgtactgccaggaaaatatgaatgcacttgattaaaaccacactgtcgatacagcgctcggcttcataaataatgacacgaatctctgttctcctctcgcttgcgccccctgctgcgtctaaaaagggcggccccctctaagg

SEQ ID NO: 1676 - DNA, 1896 bp, Brassica rapa
attccttgaagcagttaggttaaaacaatggttgtgtttgggaatgtttccgcggcgaatttgccttatcaaaatggatttttgaaggcaatttcatctggaggttgtgatttaatgggacaccgcagcttcaaaatttcaacttcttttaagacaagaacaaggaggaggaggagtgctggtcctttgcaggtagtttgtgtggatataccaaggccagagctagagaacactgtcaacttcttggaagctgcaagtttgtctgcatctttccgtagtgctcctcgtcctgcgaagcctttaaaagttgtcatcgctggtgctggattggctggattgtcaacagcaaagtacctggctgatgcaggacataaacctctgttgcttgaagcgagagatgttcttgggggaaagatagctgcatggaaggatgaagatggagattggtatgaaaccggtttacatatattttttggtgcttatccgaatgtgcaaaacttatttggagaacttgggatcaatgatcggctgcagtggaaggaacactccatgattttcgccatgccaagtaaacctggagaatttagtagatttgatttcccagatgtcctcccagcacccttaaacggaatatgggctatattgaggaacaacgagatgctgacatggccagagaaaataaagtttgctattggacttcttccggctatggtcggaggtcaggcttatgttgaggctcaagatggtttatcagttgaacaatggatgagaaagcagggagtacctgatcgggtgacagatgaggtgttcattgccatgtcaaaggcgctaaactttataaacccagacgaactttcaatgcaatgcattttgatagctttgaatcggtttcttcaggagaaacatggatcgaagatggcgttcttagatggtaatccaccggagaggctttgtatgccaatagtggaacatattcgatcactaggtggtgaagtacgtcttaactcaaggataaggaagattgagctcgaggatgatggtactgttaagagtttcttactcactgatggaaccactatccaaggagacgcttatgtctttgccactccagtggatatcctgaagcttcttttgccggactcttggaaagagataccatacttcaagagattggagaagctagttggtgtgccagttattaacgttcatatatggtttgataagaaactgaagaacacatatgatcatttactatttagcagaagtaaccttctgagtgtgtatgctgacatgtcgttaacgtgtaaggaatattacgatcctaaccggtcaatgctggagctagtatttgcacctgcggaggaatggatatcaaggagcgactctgacatcattgatgcaacgatgaaagagctcgaaagactcttccctgacgaaatcgccgctgaccaaagcaaggctaaaattctcaagtaccatgtcgtcaaaactccaaggtctgtgtacaagacgatcccagactgtgaaccatgtcggccactacaaagatctcctattaaaggattctacttagctggggattacactaaacagaagtacttagcttccatggaaggcgccgttctctctggcaaattctgctctcagtctattctacaggattacgagctattggctgcttcctctggaccgcaaaagttgtcggagacgactctatcaacataagaaaggaagcttaaaatattttgtaacttttgtgtacaaacctcatttcaatacaaagttacagatttggcaaaaagggaacaatgtattgccaggaaaatatggaatgcacttgatttatatgtgtactatatatcaatattctaaataaataatgaattcatttcaaat

SEQ ID NO: 1677 - DNA, 1908 bp, Brassica napus
atggttgtgtttgggaatgtttctgcagcgaatttgccttatcaaaatgtgtttttggaggcactttcatctgaactgatgggacacagcagcttcagagttccgatctcttcacaagcgcttaagacaagaacaaggcgaaggactgctggtcctttgcaggtggtgtgtgtggatataccaaggccagagctagagaacactgtcaatttcttggaagctgcaagtttgtctgcatctttccgtagtgctcctcgtcctgctaagcctttaaaagttgtcattgctggtgctggattggctggactgtcaactgcaaagtacctggctgatgcaggccaccaacctctcttgctcgaagcaagagatgttcttggtggaaagatagctgcatggaaggatgaagatggagattggtatgaaaccggtttacatatatttttcggtgcttatccgaatgtgcagaacttatttggagaacttgggatcaatgatcggttgcaatggaaggaacactccatgatattcgccatgccaagtaaacctggagaatttagtagatttgatttcccagatgttctaccagcacccttaaacggtatttgggcaattttgagaaacaacgagatgctgacatggccagagaaaataaagtttgctattggacttcttccagcaatggtcggaggtcaggcttatgttgaggcccaagatggtttatcagttgaagaatggatgagaaagcagggagtacctgatcgcgtgactgatgaggtgtttatagccatgtcaaaggcacttaactttataaaccccaacgaactgtcaatgcaatgcattctgatagctttgaaccggtttcttcaggagaaacatggttcgaagatggccttcttagatggtaatcctccggagaggctatgcatgcctattgttgaacatattcgatcactaggtggtgaagtgcgacttaactcaaggataaggaagattgagctggaggacgatggtacggttaaaaatttcttactcactgatggaaccacaatccaaggagacgcttatgtgtttgccactccagtggatattctgaagcttcttttgccggattcatggaaagaaatatcatacttcaagagattagagaagttagttggtgttccagtcattaacgttcatatatggttcgatcggaaactgaagaacacatatgatcacttactctttagcagaagtaaccttctgagtgtgtatgcagacatgtcgttaacttgtaaggaatattacgatccaaaccgatcaatgctggagctagtgtttgcacctgcagaggaatggatatcacggaccgactctgacattatagatgcaaccatgaaagagctcgagaaactcttccctgacgaaatcgctgctgaccaaagcaaagctaaaattctcaagtaccatgtcgtcaaaactccaaggtctgtgtacaagaccatcccagactgtgaaccatgtcgtcctctacagagatctcctattcaaggcttttacttagctggagactacactaaacagaagtacttagcttccatggaaggcgccgttctctctggcaaattctgctcacagtctattgtgcaggattatgagctattggctgcgtctggacgccgaaacttgtcggagacaactgtatcaacatgagaagaggaagcttaaagatcattgatttgtgctcgtaaccattattttgtaacttttgtgtacaaacctcatttcaagacaaagttaaggtgtggcaaaaaaaaacaaatacataatgtaaaaaatttataggtgtttatttaagaaaaacacaattagtataggatatataaattgcactctaatcccataaatgcaaactgacgaagaagagta

SEQ ID NO: 1678 - DNA, 2340 bp, Gossypium hirsutum
ttgaattcggtcatctgagctttgggatttttgtcttgaagaaaatgagtctctgtgggagtgtttctgccctgtacttaaacttacaaagcagcaagataagcatgggaaatgtcttagcttttagaagtggtgaatccatgggaaataccttgagaattccctttaaaaagaggtcacgtaagggtgctggttgtcctttgcaggtagtttgcatagattatccaaggccagagctagagaatactgttaattttttggaggctgcttctctatctgcttcttttcgttcagcttcccgtccaactaaaccattgaaagtcataattgctggtgcaggtttggctggtttgtcaactgcaaagtatcttgcggatgcaggtcatacaccaatattattagaagcgagagatgttctaggtggaaaggtggctgcatggaaggatgatgatggagattggtatgagacaggattacatatattctttggggcttacccaaatgtgcaaaacttgtttggagaacttggcattaatgatcggctgcaatggaaggagcattctatgatatttgcgatgccaaataaacctggagagttcagtcgatttgattttccagaagttctacctgcaccattaaatggaatatgggccattttgaagaataatgaaatgctgacttggccagagaaagtgaaatttgcaataggactcctaccagcaatgctgggtggacaaccttatgttgaggcccaagatggtttatctgttaaagactggatgagaaagcagggcgtacctgatcgtgtgactgaggaggtgtttattgccatgtcaaaggcactgaacttcattaaccctgatgaactttcaatgcaatgtatattgattgcattgaatcgatttcttcaggagaaacatggatcaaagatggcattcttggatggaaaccctcccgagaggctttgcatgcctatcgtcaatcatattgaatcactggggggtgaggtccggcttaattcacgtataaaaaaaatagagctcaatgaagatggaactgtgaagacttttcttctaaataatggcaatacaatcgaaggagatgcttatgtagttgcaacgcccgttgatatcttcaagttacttttgcctgaagactggagagagatttcatacttcaagaaattagagaaattagttggagttccagttatcaacgttcacatctggtttgataggaaattgaagaacacctatgatcatctactctttagcagaagcccgcttttaagtgtttatgctgacatgtctgtaacatgtaaggaatattacaatccaaaccaatccatgttggagttagtttttgccccagcagaagaatggattgcatgtagtgactcagaaattattgatgctacaatgaaggaacttgcaaagctctttcctgatgaaatatctgcagatcagagtaaagcaaaagtcgtaaaataccatattgttaaaacaccaagatctgtatataaaactgttccaaattgtgaaccctgccgccccttgcaaagatctccaatacaggggttctatctagcaggtgattacacaaagcaaaagtatttagcttcgatggaaggtgctgtgctctcagggaagctttgtgcacagtctattgtacaggattatgagttgctttgtactttgggacaaagaaagttgacaggagcaagcattcactgatgtcctttgaattgaagtaaacaggtcacaagttatcgaggatcatctgctaatagattgtttaaggccactaggttagtggttctttttttttttcattacatataatatactgtatatcccatataaaatcagtaacttttgctaaaatagtatcagaagctgcgtataaaattcttttgagatatacatcatgatcttcaatatacatgattcccttttagctatggtgtggaatgcattagcaatcttttagtgaacaaattaagatagaaatagcaaagctcattttgcaaccccactcgattgagtgataacctgtatgtttgagactgaggattaaagtaggagaatggaagaagaactagtatggaaagcattggggatatcttaagaagaactagtatggaaagcattggggatatcttataggccatgtttgattgctgaaaaactgatttctgggccgaagccagtggctcgatcagattggaccgtgattaattttctttctattggattgtgactattttgtaagagaaaataggaatttgggtattcgaattaataaatgaaaaaataataaattacataaagataataaata

SEQ ID NO: 1679 - DNA, 2278 bp, Helianthus annuus
  misc_feature (82)..(82): n is a, c, g, or t
  misc_feature (1710)..(1710): n is a, c, g, or t
ttttaggtgacgaccaactcaaaccaatccacgcacacgctagtgacaatggttaggcagttggatgagatgagtggtgganggagggtatattccaaacaagggccgacgaagttccaacaacgaaagaagccaaaaacaatcccatcttcttcttcttctttctcttctccttcttcttaattaccttcaattcagttgatccactcactctgaaccaaggctataataaacgacatgtctctgcttggaaatgtatccgctaccggaaattctgtagtaatgagtagtagtctttcaagagattattttgccaacaccacctcagggagaacagatgtcttgtcttttagacacggtgatattatgggccatcgactgcaattccgatcaagaaccaacaagattactgtctgccctttcaaggtggtctgcgtggactatccaagaccagagcttgacaacacatctaacttcttggaagctgcttacttgtcttcaaccttcccaaccgcccctcgtccggctaagcccttaaacgttgtaattgctggtgcaggtctggctggtctatccactgcaaagtatttggctgatgccggtcacaagccgattttgctagaagccagagacgttcttggtggaaaggtagcagcttggaaagaccaggacggagattggtacgagacagggttacacatattttttggagcttacccaaatgtacagaacctgtttggagagctagggattaatgatagattacagtggaaggaacattctatgatatttgcaatgccaaacaagcctggagagtttagtcgctttgacttcccagatgtgttgcctgcaccaataaatggaatttgggctatcttgaggaacaatgaaatgctgacatggcccgagaaagtaaaatttgcaattggactcttgcctgcaatgttgggtggacaagcttatgttgaggctcaagatggacttagtgtccaagattggatgagaaagcaaggcataccggatcgagttaccactgaggtgtttattgccatgtcaaaggcattaaacttcatcaatccagatgaactttcaatgcagtgtattcttattgctctgaaccggtttcttcaggaaaagcatggttctaagatggcatttttagatggcagcccgcctgaaagactttgcaagccaattgttgaccatattgaatcactaggtggccaagtcagacttaattcacggatacaaaagatcgagttaaacaaggatggaactgttaaaaactttttactgactgatgggaataccatcaaaggggatgcttatgtatttgctactccagttgacattctgaagcttcttttgcccgaagattggaaaccgcttccatacttcaaaaagttggacaaattagttggtgttccggttataaacgttcatatatggttcgacaggaagctcaaaaacacttatgatcacctacttttcagcaggagccctcttcttagtgtatatgctgacatgtctgttacgtgtaaggaatattatgatccgaatcggtcaatgttggaattggtttttgcacctgcagaagaatggattgcacgcagtgactctgacattattgatgccacaatgagtgaactttcaaaactctttcctgatgaaattgcagcagatgggagcaaagcaaaaatattgaaatancatgtggtaaaaactccaaggtcggtttataaaactgtaccggattgtgaaccttgccgtccgttgcaaagatctccaatagaaggattctatttagctggtgattacacgaaacaaaagtatttggcttcaatggagggtgcggttttgtcaggaaaattttgtgcccgagctattgtacaggattacgagttgcttgctgcgaggggggaagtgatggctgaagcaagtctggtgtaaagatgacgtggcaagttgaaattcgataaaaaacactcatccatatgatagaacttatcttgtatttcattactttatacatgtattgattaatcagtatttaatatctataaatgagcacaggcgtttgttgtgaaaagggtatgcttaggtttaggtggtgccttggaaggcgagcgttggtttctagcttttgtttgttaattaatacctggctgttaaagatgatctatttaatgaggcgattagatccgctataaatataatgtaatgtaatgtaatgtaatggtgtttataaacaatgacagaaggagtcaaatttatgaac

SEQ ID NO: 1680 - DNA, 1998 bp, Centaurea maculosa
  misc_feature (119)..(119): n is a, c, g, or t
  misc_feature (124)..(124): n is a, c, g, or t
  misc_feature (127)..(127): n is a, c, g, or t
  misc_feature (135)..(135): n is a, c, g, or t
  misc_feature (142)..(142): n is a, c, g, or t
  misc_feature (149)..(149): n is a, c, g, or t
  misc_feature (153)..(153): n is a, c, g, or t
  misc_feature (164)..(164): n is a, c, g, or t
  misc_feature (191)..(191): n is a, c, g, or t
  misc_feature (249)..(249): n is a, c, g, or t
  misc_feature (254)..(254): n is a, c, g, or t
  misc_feature (413)..(413): n is a, c, g, or t
  misc_feature (761)..(761): n is a, c, g, or t
  misc_feature (770)..(770): n is a, c, g, or t
  misc_feature (1002)..(1002): n is a, c, g, or t
  misc_feature (1397)..(1397): n is a, c, g, or t
  misc_feature (1436)..(1436): n is a, c, g, or t
ccaaaaaaacaatcccgaaactgaacggctttttttaactctctcagcttcttcttcgttaccaaaacccaccatctctttcttcttattagtcacacacacagacagatttacttaantatanccngttagcancatcganttggttntcanaaagggctgtnacttgtggaccttctaatcctaaaagnaagtttgtcttaatttggtgaggtgacatgtctctgtttggaaatgtctccgccatcnactcnagtggaaagtgtacggtaatgaatctttcaagcacaccaccgatcaattgttttaacaacatctcctcggggaaaacagatgtattggcctttggacgcagtgatgctatgggtcagcgcttgcaattcccatgtgtcccttcttttataacaagaacnaagaagaatgtctcccctttgaaggtagtttgcattgactatccaagaccagagcttgacaacacatctaatttcttggaagctgcttacttgtcttcaacattcagaacttcccctcgtccagctaaaccattgaaaattgtaattgctggtgctggtctggctggtttatcaactgccaaatatttagctgatgcaggtcacaagccaattttattagaagcaagagacgttcttgggggaaaggttgctgcttggaaagatgatgatggggattggtatgagacaggcttacacatattctttggagcctacccaaatgtacagaacctgtttggagaactaggnattaatganagattgcagtggaaggagcattccatgatattcgcaatgccaaacaagcctggagaatttagtcggtttgactttccagatgttctgcctgcaccattgaatggaatttgggctatattgaggaacaatgaaatgctgacatggcctgagaaagtaaaatttgcaatagggctcttgcctgcaatgttaggtggacaggcttatgttgaggctcaagatggtttgagtgttnaagactggatgagaaagcaaggcataccagaccgagttactaccgaggtgtttattgccatgtcaaaggcattaaacttcataaatccagatgaactttcaatgcaatgtattctcattgctctgaaccgcttccttcaggagaagcatggttcaaagatggcatttttagatggcagcccacctgagagactttgcatgccaatcgttgagcatattgagtcgctaggtggtcaagtcaggcttaattcacgaatacaaaagatcgagttaaacaaagatggaactgttaagaacttcctactgagtgatgggaatattattgaaggcgatgcttatgtattcgctactccagtagacattctgaagcttcttttgcctgaagattggaaatcnattgcttacttcaagaagttggagaaattagttggtgtnccagttataaatgttcatatatggtttgacaggaaactcaaaaacacctacgatcacctactctttagcaggagcaaacttctgagtgtatatgctgacatgtctgtaacatgtaaggaatattatgatccaaatcggtccatgttggaattggtgtttgcacctgcagaagaatggatttcacgcagcgactctgatataattgatgccacgatgagtgaactttcaagactctttcctgatgaaattgcagcagatcagagcaaagcaaaaatattgaaataccatgtagttaaaacaccaaggtctgtctacaaaactgtaccagactgtgaaccttgccgtcccttgcaaagatctccaatagaaggattctatttagctggcgactacaccaaacaaaaatatttggcttcgatggagggtgccgttctatcaggaaaattttgtgcacaagctattctacaggattatgagttacttgctgcccggggggaagtggtagccgaggcaagccttgtctaactccacaaaacccatatgactttgttgtaggctttaa

SEQ ID NO: 1681 - DNA, 2122 bp, Artemisia annua
  misc_feature (801)..(801): n is a, c, g, or t
  misc_feature (980)..(980): n is a, c, g, or t
  misc_feature (1043)..(1043): n is a, c, g, or t
  misc_feature (1085)..(1085): n is a, c, g, or t
  misc_feature (1106)..(1106): n is a, c, g, or t
  misc_feature (1181)..(1182): n is a, c, g, or t
  misc_feature (1247)..(1247): n is a, c, g, or t
  misc_feature (1280)..(1280): n is a, c, g, or t
  misc_feature (1293)..(1293): n is a, c, g, or t
  misc_feature (1367)..(1367): n is a, c, g, or t
  misc_feature (1517)..(1517): n is a, c, g, or t
gatgccctcttttttttatttattttatttatcccccaaccaacccaattctcttcttctgctgctgctgctactgccatatactaattattaaggcggccagggctgtttagtttgtgatgatgtctgtgtccggaaatgtctcggcttctttagtttcaaccatcacttcccgaaatgattctattaatattacctcctcttctgccaaactactttcatttcgacgagccgttggtcaccacttcccgctcgctcgttcatattcatattcaaccaagacgaggaggaggaggaatgtatcccctttgaaggttgtttgcgttgactatcctcgccctgaccttgacaacacctctaatttcttggaagccgcttacttgtcttctaccttccgtgtctccccacgcccatctaagcctttgaacatcgtcattgctggtgcaggtctcgctggtttatcaactgctaagtatttggctgatgccggtcacaagcctatcttgctagaagcaagagacgttctcggcggaaaggtggcggcttggaaagacaaggatggagattggtacgagacgggtttacacatattttttggagcttacccaaatatgcagaacctgttcggagagctaggcattaatgacagactgcagtggaaggagcattctatgatatttgcaatgccaaacaagcctggggagtttagtcgctttgacttcccagatgtcctgcctgcaccactcaatggaatatgggctatcttgaggaacaatgaaatgctgacatggccagagaaantaaaatttgcaattgggctcttgcctgcaatgttaggtgggcaggcgtatgttgaggctcaagatgggctaagtgttcaagactggatgagacagcgaggcataccggatcgagttaccaccgaggtgtttattgccatgtcaaaggcattaaacttcataaatcctgatgaactgtcnatgcaatgtattctcatagctctaaaccggtttcttcaggagaagcatggttctaagatggcntttttagatggcagccctcctgagagactttgcaagccaatngttgagcatattgagtcgttnggtggccaagtcaggcttaattcacgaattcaaaagattgagttaaacaaagatggaactgtcaggaactttctnntgaatgatgggaatattatcaaaggtgatgcctatgtattcgctgctccagttgacattctgaancttcttttgccggaagattggaaaccgattccntactttaagaagntggataaattagttggtgttccagttataaacgttcatatatggtttgacaggaaactccgaaacacatacgancacctactcttcagcaggagtcctcttctcagtgtatatgctgacatgtctgtaacatgtaaggaatattatgatccaaaccggtccatgttggagttggtttttgcaccagcagaagaatggatttcacgtagcgactctgatattatngatgcaacaatgagtgaactttcaaaactctttcctgatgaaattgcagcagatcagagcaaagcaaaaatattgaaataccatgtagttaaaacaccaaggtctgtttacaaaacagtaccagactgtgaaccttgccgtccattgcaaagatctccaatagaaggattctatttagctggagactacacgaaacaaaagtatttggcttcaatggaaggtgccgttctatcgggaaaattttgcgcccaagctattgtacaggattatgagttgcttgcggccaggggggaagtagttgctgaggcgagtcttgtctaactgtacaaaggcaaaatacttgttgtagacttaaagtggaggaggagctgttacaagttcaaaataagctatacatataaacaccacccgtatcccaaatcaagattccaggtgaaactcgtccacattatttttcttgtatttgtcaaaagaggatatgcatgatgtacctagttggttattattccttactttatacatcatttgtaacatcaaatctattgattaatcaagatatacatgggcgtggggtgttaaaccttctatcccgatcctttattttc

SEQ ID NO: 1682 - DNA, 2135 bp, Manihot esculenta
aaatgactttgtacgggagtgtttctgcattgaatttaaattggcattgtggtaccttagctggtagaaaattgcaatcctccttgagatgtgattatcctagcagttccaagcaaaccaatgcactagcttttagaggtagtgaatcaatgggccatgctttgagaataccatatgggattgctactaagacaaggactgctagcagatctttgcaggtagtttgtgtggactatcctagacctgacattgataacacggtgaatttcttggaagctgcatacttatcagcatccttccgcaattctccccgtccagctaaaccattgaaagttgtgattgctggggcagggttggctggtttatcaactgcgaaatatttggcagatgcagggcacaagcccgtactacttgaggcaagagaagtcctgggtggaaaggtggctgcgtggaaagatgatgatggggactggtatgaaacaggcttgcatatattctttggagcataccccaatattcagaacctgtttggagagcttggtataaacgacagattgcagtggaaggaacattctatgatatttgcgatgccaaataagccaggagagttcagtcgatttgattttgctgaagttcttcctgcaccgataaatgggatatgggcaattttaaaaaacaatgagatgctgacctggcctgagaaagtgaaatttgcaattggactcctgccagcaatgcttggtggacaggcttatgtggaggctcaggatggtttgacagttcaagattggatgagaaagcagggagttcctgatcgagtaactaaagaggtgtttattgccatgtcaaaggcacttaactttattaatccagatgaactttcgatgcagtgtattttgatagcattgaaccgatttcttcaggagaaacatggttcaaagatggctttcttagatggaaatcccccagagaggctttgcatgccaattgttgatcatattcagtcattgggtggtgaagtccggctaaattcacgaataaagaaaattgagttaaataatgatggaacagtgaaaagatttttactaaatagcggggagacgattgaaggagatgtttatgtgtttgctactccagttgacatcctgaagcttcttttgcctgacgactggaaagagattccttacttcaagaaattggagaaattagttggtgttcctgttattaatgttcacatatggttcgacaggaaactaaaaaatacatatgaccacctacttttcagcagaagtccccttcttagcgtttatgctgacatgtctgtaacatgtaaggaatattataatccaaatcaatccatgctggagttggtttttgcacctgcagaagaatggatctcttgcagtgactcggaaatcattgatgctacaatgagggaactttcgaaactctttcctgatgaaatatctgctgatcagagcaaagcaaagattgtgaaatatcatgttgttaaaactccaagatctgtttacaagacggttccaaattgtgaaccttgccgtcccttacagagatctcctatagagggcttctatttagctggggactacacaaagcaaaaatatttggcttcaatggagggcgctgtcctatctgggaagctttgtacgcagtcaatagtacaggattatgagttgcttgttgcacgggagcaaaggaagttggccgaggcaactattagttaacaaaggaaaacctttgctacttattaaatgtttgaataatctaaaggtgaattagggattgctagtcataacaatattccacaagttgttcatatatatgatacagtttgtaaagcacataaaatgtcaatctatttgggatttttgctatcaagtgaatgggattggcaatctgagatccctggaagcacaagtaagagctaaaaacacaaagggcataaaagctccaactaatagatgttctattttcggaagaaaatagtgaaatgtagccataatgaaagctgttgtttaatggagttgggagaaaggaaactgttaaagttttagctttgaggatgtagtcaggtaatcgtatacaagttttgcttgtcgtagtgctgtttattg

SEQ ID NO: 1683 - DNA, 2045 bp, Gossypium hirsutum
  misc_feature (453)..(453): n is a, c, g, or t
  misc_feature (470)..(470): n is a, c, g, or t
  misc_feature (711)..(711): n is a, c, g, or t
  misc_feature (716)..(716): n is a, c, g, or t
  misc_feature (718)..(718): n is a, c, g, or t
  misc_feature (810)..(810): n is a, c, g, or t
  misc_feature (836)..(836): n is a, c, g, or t
  misc_feature (873)..(873): n is a, c, g, or t
  misc_feature (1028)..(1028): n is a, c, g, or t
  misc_feature (1034)..(1034): n is a, c, g, or t
  misc_feature (1036)..(1038): n is a, c, g, or t
  misc_feature (1071)..(1072): n is a, c, g, or t
  misc_feature (1074)..(1074): n is a, c, g, or t
  misc_feature (1078)..(1078): n is a, c, g, or t
  misc_feature (1083)..(1083): n is a, c, g, or t
gcacgagcttcctttgtatctgcccaacccactttccatatcccactttctattcaactcaagttctttactcacctttgctttgaattcggtcatctgagctttgggatttttgtcttgaagaaaatgagtctctgtgggagtgtttctgccctgtacttaaacttacaaagcagcaagataagcatgggaaatgtcttagcttttagaagtggtgaatccatgggaaataccttgagaattccctttaaaaagaggtcacgtaagggtgctggttgtcctttgcaggtagtttgcatagattatccaaggccagagctagagaatactgttaattttttggaggctgcttctctatctgcttcttttcgttcagcttcccgtccaactaaaccattgaaagtcataattgctggtgcaggtttggctggtttgtcaactgcaaagtatctngcggatgcaggtcatanaccaatattattagaagcgagagatgttctaggtggaaaggtggctgcatggaaggatgatgatggagattggtatgagacaggattacatatattctttggggcttacccaaatgtgcaaaacttgtttggagaacttggcattaatgatcggctgcaatggaaggagcattctatgatatttgcgatgccaaataaacctggagagttcagtcgatttgattttccagaagttctaccngcacnantaaatggaatatgggccattttgaagaataatgaaatgctgacttggccagagaaagtgaaatttgcaataggactcctaccagcaatgctnggtggacaaccttatgttgaggcccnagatggtttatctgttaaagactggatgagaaagcanggcgtacctgatcgtgtgactgaggaggtgtttattgccatgtcaaaggcactgaacttcattaaccctgatgaactttcaatgcaatgtatattgattgcattgaatcgatttcttcaggagaaacatggatcaaagatggcattcttggatgnaaaccntnnngagaggctttgcatgcctatcgtcaatcatatnnantcantgggnggtgaggtccggcttaattcacgtataaaaaaaatagagctcaatgaagatggaactgtgaagacttttcttctaaataatggcaatacaatcgaaggagatgcttatgtagttgcaacgcccgttgatatcttcaagttacttttgcctgaagactggagagagatttcatacttcaagaaattagagaaattagttggagttccagttatcaacgttcacatctggtttgataggaaattgaagaacacctatgatcatctactctttagcagaagcccgcttttaagtgtttatgctgacatgtctgtaacatgtaaggaatattacaatccaaaccaatccatgttggagttagtttttgccccagcagaagaatggattgcatgtagtgactcagaaattattgatgctacaatgaaggaacttgcaaagctctttcctgatgaaatatctgcggatcagagtaaagcaaaagtcgtcaaataccatattgttaaaacaccaagatctgtatataaaactgttccaaattgtgaaccctgccgccccttgcaaagatctccaatacaggggttctatctagcaggtgattacacaaagcaaaagtatttagcttcgatggaaggggctgtgctctcagggaagctttgtgcacagtctattgtacaggattatgagttgcttcgtactttgggacaaagaaagttgacaggagcaagcattcactgatgtcctttgaattgaagtaaacaggtcacaagttatcgaggatcttctgctaatagattgtttaaggccactaggttagtggttcttttttttttttttcattacatataatatactgtatatcccatgtaaaatcagtaactcgtgctaaaacagtatcagaagctgcgtataaaattcttttgagatatacataatgatcttccatatacatgatttcccttttagct

SEQ ID NO: 1684 - DNA, 2098 bp, Cynara scolymus
  misc_feature (223)..(223): n is a, c, g, or t
  misc_feature (228)..(228): n is a, c, g, or t
  misc_feature (260)..(260): n is a, c, g, or t
  misc_feature (334)..(334): n is a, c, g, or t
  misc_feature (366)..(366): n is a, c, g, or t
  misc_feature (547)..(547): n is a, c, g, or t
  misc_feature (550)..(550): n is a, c, g, or t
  misc_feature (583)..(583): n is a, c, g, or t
  misc_feature (777)..(777): n is a, c, g, or t
  misc_feature (1245)..(1245): n is a, c, g, or t
  misc_feature (1574)..(1574): n is a, c, g, or t
  misc_feature (1695)..(1695): n is a, c, g, or t
  misc_feature (1846)..(1846): n is a, c, g, or t
cgggatgcatttgcatttgcatttgcaatttgcaatacatagctccaatccagatcctctcttctccagttaccacaagttctgccaaatcgcacaaagggctgttactgtgtcttctcgggacggacgtaatttgggtatttggtgaggtggcatgtctctgtttggaaatgtctccaccatcaactcaagtggaaagtgtacaataatgaatctttcaagnacacngatcagttcaagagattgttttaacattgccncagggcacatggatgtattggcctttggacacagtgatgctatgggtcacccattgcgattcccaggtgtccgntctttaataacaagaacgaagaagaatgtctnccctttgaaggtagtttgcgttgattatccaagaccagagcttgagaacacgtctaatttcttggaagctgcttacttgtcttcaacattccgaacttccccccgtccagctaaaccactggaaattgtaattgctggtgcaggtctggcaggtttatcaactgccaagtatttagctgangcnggtcacaagccaattttattagaagcaagagangttcttggcggaaaggttgctgcttggaaagatgatgatggagattggtacgagacaggcttacacatattctttggagcttacccaaatgtacagaacctgtttggagaacttggcattaatgatagattgcagtggaaggagcattctatgatattcgcaatgccaaacaagcctggagaatttagtcggtntgacttcccagatgttctgcctgcaccattgaatggaatttgggctatattgaggaacaatgaaatgctgacatggcctgagaaagtaaaatttgcaatagggctcctgcctgcaatgttaggtggacaggcttatgtcgaggctcaagatggtttgagtgttaaagactggatgagaaagcaaggcataccagatcgagttactacggaggtgtttattgccatgtcaaaggcattaaacttcataaatccagatgaactttcaatgcaatgtattctcattgctcttaaccggtttcttcaggagaagcatggttcaaagatggcatttttagatggaagcccacccgaaagactttgcatgccagtcgttgagcatattgagtcgctaggtggcgtagtcaggcttaattcccgaatacaaaagatcgagttaacaaagatggaactgttaggaacttctactgnatgatgggaatattatccaaggcgatgcttatgtattcgctactccagtagacattctgaagcttcttttgcctgaagattggaaaccgattccatacttcaaaaagttggagaaattagttggtgttccagttataaatgttcatatatggtttgataggaaactccggaacacctacgatcacctactctttagcaggagcaatcttctcagtgtatatgctgacatgtctgtaacatgtaaggaatattatgatccgaatcggtccatgttggaattggtctttgcacctgcagaagaatggatttcacgcagtgactctgatatnattgatgccacgatgagtgaactttcaagactctttcctgatgaaattgcagcagatcagagcaaagcaaaaatattgaaataccatgtagttaaaacaccaaggtctgtttacaaaactntaccagactgtgaaccttgtcgtcctttacaaagatctccaatacaaggattctatttagctggcgactacaccaaacaaaagtatttggcttcaatggagggtgccgttctatcaggaaaattttgtgcacaagctattgtacaggattntgagttgcttgctgcccggggggaagtgctggctgaggcaagccttgtctaactccacaaacaccagatgacttgttgtaggcttaacgtggtggagctgttacaagttcacagaagctaaacatagaaacaccagtgaagcttttccaaagaagaagcacatgcttattatgtacctagttggttacgttctgattactttatacatcatttgtagcaaatattgattaatcaagatgttttatacatggg

SEQ ID NO: 1685 - DNA, 1902 bp, Artemisia annua
gccaaactactttcatttcgacgagccgttggtcaccacttcccgctcgctcgttcatattcatattcaaccaagacgaggaggaggaggaatgtatcccctttgaaggttgtttgcgttgactatcctcgccctgaccttgacaacacctctaatttcttggaagccgcttacttgtcttctaccttccgtgtctccccacgcccatctaagcctttgaacatcgtcattgctggtgcaggtctcgctggtttatcaactgctaagtatttggctgatgccggtcacaagccaatcttgctagaagcaagagacgttctcggtggaaaggtggcggcttggaaagacaaggatggagattggtacgagacgggtttacacatattttttggagcttacccaaatatgcagaacctgttcggagagctaggcattaatgacagactgcagtggaaggagcattctatgatatttgcaatgccaaacaagcctggggagtttagtcgctttgacttcccagatgttctgcctgcaccactcaatggaatatgggctatcttgaggaacaatgaaatgctgacatggccagagaaagtaaaatttgcaattgggctcttgcctgcaatgttaggcgggcaggcgtatgttgaggctcaagatgggctaagtgttcaagactggatgggacagcgaggcataccggatcgagttaccaccgaggtgtttattgccatgtcaaaggcattaaacttcataaatcctgatgaactgtcaatgcaatgtattctcatagctctaaaccggtttcttcaggagaagcatggttctaagatggcgtttttagatggcagccctcctgagagactttgcaagccaattgttgagcatattgagtcgttgggtggccaagtcaggcttaattcacgaattcaaaagattgagttaaacaaagatggaactgtcaggaactttctactgaatgatgggaatattatcaaaggtgatgcctatgtattcgctgctccagttgacattctgaaacttcttttgccggaagattggaaaccgattccgtactttaagaagttggataaattagttggtgttccagttataaacgttcatatatggtttgacaggaaactccgaaacacatacgaccacctactcttcagcaggagtcctcttctcagtgtatatgctgacatgtctgtaacatgtaaggaatattatgatccaaaccggtccatgttggagttggtttttgcaccagcagaagaatggatttcacgtagcgactctgatattattgatgcaacaatgagtgaactttcaaaactctttcctgatgaaattgcagcagatcagagcaaagcaaaaatattgaaataccatgtagttaaaacaccaaggtctgtttacaaaacagtaccagactgtgaaccttgccgtccattgcaaagatctccaatagaaggattctatttagctggagactacacgaaacaaaagtatttggcttcaatggaaggtgccgttctatcgggaaaattttgcgcccaagctattgtacaggattatgagttgcttgcggccaggggggaagtagttgctgaggcgagtcttgtctaactgtacaaaggcaaaatactttgttgtagacttaaagtggaggaggagctgttacaagttcaaaataagctatacatataaacaccacccgtatcccaaatcaagattccaggtgaaactcgtccacataatttttcttgtatttgtcaaaagaggatatgcatgatgtacctagttggttattattccttactttatacatcatttgtaacatcaaatctactgattaatcaagatatacatgggcgtggggtgttaaaccttctatcc

SEQ ID NO: 1686 - DNA, 2273 bp, Helianthus annuus
ttttaggtgacgaccaactcaaaccaatccacgcacacgctagtgacaatggttaggcagttggatgagatgagtggtggatggagggtatattccaaacaagggccgacgaagttccaacaacgaaagaagccaaaaacaatcccatctgcttcttcttcttcctcttctccttcttcttaattaccttcaattcagttgatccactcactctgaaccaaggctataataaacgacatgtctctgcttggaaatgtatccgctaccggaaattctgtagtaatgactagtagtctttcaagagattattttgccaacaccacctcagggagaacagatgtcttgtcttttagacacggtgatattatgggccatcgactgcaattccgatcgagaaccaacaagattactgtctgccctttcaaggtggtctgcgtggactatccaagaccagagcttgacaacacatctaacttcttggaagctgcttacttgtcttcaaccttcccaaccgcccctcgtccggctaagcccttaaacgttgtaattgctggtgcaggcttggctggtctatccactgcaaagtatttggctgatgccggtcacaagccgattttgctagaagccagagacgttcttggtggaaaggtagcagcttggaaagaccaggacggagattggtacgagacagggttacacatattttttggagcttacccaaatgtacagaacctgtttggagagctagggattaatgatagattacagtggaaggaacattctatgatatttgcaatgccaaacaagcctggagagtttagtcgctttgacttcccagatgtgttgcctgcaccaataaatggaatttgggctatcttgaggaacaatgaaatgctgacatggcccgagaaagtaaaatttgcaattggactcttgcctgcaatgttgggtggacaagcttatgttgaggctcaagatggacttagtgtccaagattggatgagaaagcaaggcataccggatcgagttaccactgaggtgtttattgccatgtcaaaggcattaaacttcatcaatccagatgaactttcaatgcagtgtattcttattgctctgaaccggtttcttcaggaaaagcatggttctaagatggcatttttagatggcagcccgcctgaaagactttgcaagccaattgttgaccatattgaatcactaggtggccaagtcagacttaattcacggatacaaaagatcgagttaaacaaggatggaactgttaaaaactttttactgactgatgggaataccatcaaaggggatgcttatgtatttgctactccagttgacattctgaagcttcttttgcccgaagattggaaaccgcttccatacttcaaaaagttggacaaattagttggtgttccggttataaacgttcatatatggttcgacaggaagctcaaaaacacttatgatcacctacttttcagcaggagccctcttcttagtgtatatgctgacatgtctgttacgtgtaaggaatattatgatccgaatcggtcaatgttggaattggtttttgcacctgcagaagaatggattgcacgcagtgactctgacattattgatgccacaatgagtgaactttcaaaactctttcctgatgaaattgcagaagatgggagcaaagcaaaaatattgaaatatcatgtggtaaaaactccaaggtcggtttataaaactgtaccggattgtgaaccttgccgtccgttgcaaagatctccaatagaaggattctatttagctggtgattacacgaaacaaaagtatttggcttcaatggagggtgcggttttgtcaggaaaattttgtgcccgagctattgtacaggattacgagttgcttgctgcgaggggggaagtgatggctgaagcaagtctggtgtaaagatgacgtggcaagttgaaattcgataaaaaacactcatccatagaacttatcttgtatttcattactttatacatgcattgattaaacagtatttaatatctataaatgagcacaggcgtttgttgtgaaaagggtatgcttaggtttaggtggtgccttggaaggcgagcgttggtttctagcttttgtttgttaatacctggctgttaaagatgatcgatctatttaatgaggagattagatccgctataaatataatgtaatgtaatgtaatgtaatggtgtttataaacaatgacagaaggagtcaaatttatgaac

SEQ ID NO: 1687 - DNA, 1874 bp, Cichorium intybus
aaccttccaaacacacagatcactacaaaagactgcttcaacatcacctcaggacaaaaagatgtactctcatttggatgctgtgatgccatgggtcacagattgcaattcccaagtgcccgttcttttacatcaaaatcaaagaagaatatctcccctttaaaggcagtttgcgttgactatccaagaccagagctagagaacacctctaatttcttggaagctgcttacttgtcttcaaccttcacaacttcccctcgtccatctaagccattgaagattgtaattgctggtgcaggtttggctggtttatcaactgcaaagtatttggctgatgcaggtcacaagccaattttgttagaagcaagagacgttcttggtggaaaggtggcagcttggaaagatgatgatggtgattggtacgagacaggtttacacatattctttggagcttacccaaatgtacaaaacctatttggagagctaggaattaatgatagattgcaatggaaggaacattctatgatatttgcaatgccaaataagcctggagaatttagtcggtttgactttccagatgttttgcctgcaccaataaatggaatttgggctatattgaggaacaatgaaatgctgacgtggcctgaaaaagtaaaatttgcaattgggcttttgcctgcaatgttaggtggacaggcttatgttgaggcccaagatggtttgagtgttcaagactggatgagaaaacaaggcataccagatcgagttactactgaggtttttattgccatgtcaaaggcattgaactttataaatccagatgaactttcaatgcaatgtattctcattgctctcaacaggtttcttcaggagaaacatggttccaagatggcatttttagatggaagcccacccgaaagactttgccagccgattgttgaccatattgagtcacttggtggccaagtcagactcaattcaagaatacaaaaaattgaattaaacaaagacggaactgtccggaactttctactgaatgacgggaatgttctagaagctgatgcttatgtatttgccacccctgttgacattttaaagcttcttttacctgaagaatggaaaccaattccatatttcaaaaagttagagaaactagtcggtgttccagttataaatgttcatatatggtttgataggaaactgaaaaacacatatgatcacctacttttcagtaggtcacctcttttgagtgtatatgctgacatgtcagtgacatgtaaggaatattatgatccaaatcggtcaatgttggaattggtttttgcacctgcagaagaatggatttcaagaagtgattctgatattattgatgcaacaatgagtgaactttcaaggctttttccagatgaaatttcagcagatggaagtaaagcaaaaatcttgaaatataaagttgttaaaacaccaagatctgtttataaaaccataccagattgtgaaccttgtagaccattacaaagatctccaattgagggattttatttagctggtgattatactaaacagaagtatttagcttcaatggagggtgcggttttatctggaaagttttgtgcacaagctattgtaaaggattatgagttgcttgctgcacgtaagggagtggttgctgaagcaagccttgtgtaagttaataattcgtggatgaattttaaggagctcttacaagttcaaagaaggttaaaatataaaaaataggaattcaagattacaagtgaaacttgtttacatgatttttgttgtatttgtgaaaggaggtatgtgtattcatgttatgtggctagttggttgttttcttttttcgtaattaaaaa

SEQ ID NO: 1688 - DNA, 1274 bp, Arabidopsis lyrata
acaacacaatatttgttcaaagtctaaaaaagattattgatacttatcttctctcctgaaataacctcatagtgtcgacatggcttgccaaaacaatctcgttgtgaagcaaatcgtcgacttatacgatcaaatctcaaagctcgtgagcttaaaaccttccaaaaatgtcgacactttgttcggacaactcgtgtccacgtgcttacccacggatacaaacatcgatgtcacaaatatgtgtgaagaagtcaaatacatgagatctaatctcatcaagctttgtggtgaagccgaaggttatttagagcaacacttctccacaattttgggatctttacaagaagaccaaaacccacttgaccatttacacatctttccttactacaccaactacctcaagctaggcaagctcgagttcgatctcctgagtcaacactcaagccatgtccccaccaagattgccttcgtgggttcgggtccgatgcctctcacatccatcgtcttggccaagtttcacctcccgaacacgaccttccacaacttcgacatcgactcacacgcaaacacactcgcttcaaacctagtctctcgcgacccggacctctcaaaacgcatgatcttccacacaacggacgtactaaacgctaccgaaggccttgaccaatatgacgtcgttttcttggcggctcttgttgggatggacaaagagtcaaaggtcaaagccattgagcacttggagaaacacatggctcctggagctgtccttatgctaaggagtgctcatgctctcagagctttcttatatcccatcgttgactcttctgatctcaaaggctttcagctcttgaccatctatcatccaaccgatgatgtggttaactcggttgtgatcgcacgtaagctcggtggttcgaccacgaccggggttaatggtactcgtggctgcatgtttatgccttgtaactgctccaagatccacgcgatcatgaacaaccgtggtaagaagaatataatcgaggagtttagtgccatcgagtaagcaaataattaattgtattaacacatctcttttcttaagattgtgttcatgttttttgtcttataataactgctcttttcgtttcatgtcttttgtgtgtgtgtggctacttttgttaagtataagtttgtgaatttagagttctttgatctcgttttgtacgaagatacagaaccctttgcttgttgtactatcaatacaaaataaaataaaaaagcatatcttgagaatc

SEQ ID NO: 1689 - DNA, 1273 bp, Arabidopsis thaliana
acaacacaaaatttgttcaaagtctaaaaaagattattattacttatcttctcccctgaaataacctcatagtgtcgatatggcttgccaaaacaatctcgttgtgaagcaaatcatcgacttgtacgaccaaatctcaaagctcaagagcttaaaaccttccaaaaatgtcgacactttgttcggacaactcgtgtccacgtgcttacccacggatacaaacatcgatgtcacaaatatgtgtgaagaagtcaaagacatgagagctaatctcatcaagctttgtggtgaagccgaaggttatttagagcaacacttctccacaattttgggatctttacaagaagaccaaaacccacttgaccatttacacatctttccttactactccaactacctcaagctaggcaagctcgagttcgatctcctgagccaacactcaagccatgtccccaccaagattgccttcgtgggttcgggtccgatgcctctcacatccatcgtattggccaagtttcacctccccaacacgacgttccacaactttgacatcgactcacacgcaaacacactcgcttcaaacctcgtctctcgcgacccggacctctcaaaacgcatgatcttccacacaacggacgtactaaacgcaaccgaaggccttgaccaatatgacgtcgttttcttagcggcgcttgtagggatggacaaagagtcaaaggtcaaagccatcgagcacttggagaaacacatggctcctggagctgttcttatgctaaggagtgctcatgctctcagagctttcttatatccaatcgttgactcgtctgatctcaaaggctttcaactcttgaccatctatcatccaaccgatgacgtggttaactcggttgtgatcgcacgtaagctcggtggtccgaccacgcccggggttaatggtactcgtggatgcatgtttatgccttgtaactgctccaagattcacgcgatcatgaacaaccgtggtaagaagaatatgatcgaggagtttagtgccatcgagtaaacaaacaattaataaaacacatctcttttcttaagattgtgttaatgtttttgtcttatattaactgctcttttcatttcatgtcttgtgtgtgtgtggctacgcttattaagtgttaagtttgtgaattttgagttctttgatctttgttatgaatgaaaaagataccgaacattttgtttgttgtactttttatatattatcattaataaaaaagcatatcttgagatc

SEQ ID NO: 1690 - DNA, 1274 bp, Arabidopsis thaliana
cacaacacaaaatttgttcaaagtctaaaaaagattattattacttatcttctcccctgaaataacctcatagtgtcgatatggcttgccaaaacaatctcgttgtgaagcaaatcatcgacttgtacgaccaaatctcaaagctcaagagcttaaaaccttccaaaaatgtcgacactttgttcggacaactcgtgtccacgtgcttacccacggatacaaacatcgatgtcacaaatatgtgtgaagaagtcaaagacatgagagctaatctcatcaagctttgtggtgaagccgaaggttatttagagcaacacttctccacaattttgggatctttacaagaagaccaaaacccacttgaccatttacacatctttccttactactccaactacctcaagctaggcaagctcgagttcgatctcctgagccaacactcaagccatgtccccaccaagattgccttcgtgggttcgggtccgatgcctctcacatccatcgtattggccaagtttcacctccccaacacgacgttccacaactttgacatcgactcacacgcaaacacactcgcttcaaacctcgtctctcgcgacccggacctctcaaaacgcatgatcttccacacaacggacgtactaaacgcaaccgaaggccttgaccaatatgacgtcgttttcttagcggcgcttgtagggatggacaaagagtcaaaggtcaaagccatcgagcacttggagaaacacatggctcctggagctgttcttatgctaaggagtgctcatgctctcagagctttcttatatccaatcgttgactcgtctgatctcaaaggctttcaactcttgaccatctatcatccaaccgatgacgtggttaactcggttgtgatcgcacgtaagctcggtggtccgaccacgcccggggttaatggtactcgtggatgcatgtttatgccttgtaactgctccaagattcacgcgatcatgaacaaccgtggtaagaagaatatgatcgaggagtttagtgccatcgagtaaacaaacaattaataaaacacatctcttttcttaagattgtgttaatgtttttgtcttatattaactgctcttttcatttcatgtcttgtgtgtgtgtggctacgcttattaagtgttaagtttgtgaattttgagttctttgatctttgttatgaatgaaaaagataccgaacattttgtttgttgtactttttatatattatcattaataaaaaagcatatcttgagatc

SEQ ID NO: 1691 - DNA, 1495 bp, Arabidopsis lyrata
gtcacccaaaagcaaaatctaaatagaaagaaagaagtaagaaatggcaacccttaagtgcattgactggcaattcagcggaagcgaagcagccaaagaagctgccggggccagcttaggcacatatacctctgcactctatgctttgtgcgatcctagtggcaaatccattttgcccccacgaaatgagatcctggagaccagcaatacagccgaaaaagcagttgttaaagccgttctttatggcacgggaaacgcctatgctcctagcgttggcctcgcaaccgccaaacgtgccgtagcagattatctaaaccaaggtcttccaaagaagcttacagcagatgacgtgtttatgactcttggatgcaaacaagccattgagctcgcggtagacattctggctaaaccgaaagccaacgttttgcttccgagtcctggcttcccatgggacctagtccgctccatctacaggaaccttgaggtccgccactatgatttccttccccaaaagaactttgagatcgactttgatagtgtccgagcgctcgtggacgagaacacgtttgccatatttataatcaacccccacaatcccaatgggaacacctactccgaggctcatctcaaacagctcgctgaattggctaaggaactcaagattatggtagtttctgacgaggtttttagatggacactctttgggagtaacccttttgttccgatgggaaaattctcgtcgatagtaccagtggttacacttggatccatatcaaagggatggaaagtcccaggatggcgaactggttggctcgcgctacatgatctagatggtgtcttcagaaacaccaagatcttacaagctgcacaagaatatctccagataaacaataatcctccgactgttatccaggcggctattcctgacatcttggagaaaactcctaaagacttcttcgataagaggcaaagttttctgaaagacaaagttgaatttggttattctaagctcaagcacatacctagcctcacttgctacatgaaacctgaggcgtgcaccttcttatggaccgagcttgatttatcgagctttgtggacatcgaagatgatcaagacttttgcaataagcttgctatagaagaaaacctcgtcgttttaccagggattgcatttagtcagaagaattggttgaggcattctatcgatatggagactccggtattggaggatgcaatggaaagactgaagagcttctgtgatcgccattccattaaaaaagctccactcaaagacgtcaatggtgtcaagtaaagtgtcaatatggatctttgcctaagtcttttacgtatgctataaaaataaataaatgagtgtttattggtttgaggtacaaatcatgaacacttaagtatttgtaacaaataaaattggtgcacttatcatcaatcgtgtgtaatattttctcatagtttgcaatgtctttgtgtatatcta

SEQ ID NO: 1692 - DNA, 1695 bp, Arabidopsis thaliana
aaatgaaaagtggttgggaattttcactatatattcgacttcgtagcaatgagagttagtcacccaaaaacaaaatctaatagagaaaaataagtagatatggcaacccttaagtgcattgattggcaattcagcggaagcgaggcggccaaagatgctgctgcggcctccttaggctcatatacctctgcactctatgccctgtgcgatcctcatggcaaacccattttgcccccacgaaatgagatcctggagaccagcaatacagccgaaaaagcagttgttaaagctgttctttatggctcgggaaacgcctatgctcctagcttaggcctcgcggccgccaaaagtgccgtagcagagtatctaaaccaaggtcttccaaagaagcttaccgcagatgacgtgtttatgactctgggatgcaaacaagctattgagctcgcggtagacattctcgctaaaccgaaagccaacgttttgcttccgagtcccggcttcccatgggacctagtccgctccatctacaagaaccttgaggtccgccactataatttccttccagaaaagaactttgaaatcgactttgatagcgtccgagcgctcgtggacgagaacacatttgccatatttataatcaacccccacaaccccaatggtaacacctactccgaggctcatctcaaacagctggctgaactggctaaggaactcaagattatggtggtttctgacgaggtttttagatggacactctttggtagtaacccttttgttcctatgggaaaattctcgtcgatcgtaccagtggttacactcggatccatatcaaagggatggaaagtcccaggatggcgaactggttggctcacgctacatgatctagacggtgtcttcagaaacaccaaggtcttacaagctgctcaagattttctccagataaacaataaccctccgacagttatccaggcggctattcctgacatcttggagaaaactcctcaagagttttttgataagaggcagagttttctgaaagataaagtagaatttggttattctaagctcaagtacattcctagcctcacttgctacatgaaacccgaagcctgcaccttcttatggaccgagcttgatttatcgagctttgtggacatcgaagacgatcaagacttttgcaataagcttgctaaagaagaaaacctcgtcgttttaccagggattgcattcagtcagaagaactggttgaggcattctatcgatatggagactccggtattggaggatgcattggaaagattgaagagcttctgcgatcgccattccaacaaaaaagctcccctcaaagacgtcaatggtgttaagtaaagggtcaatatggttatttgcctaagtcatttacgtatgctataatgataaataaatgagtgtttcttggtttgaggtaaatcatgaacactttagtgtatttgtaacaaataaaatgggtgcacttaatatcaatcgtgtgtaatgttttctcatagtttgctatatctttgtgtatatctatctacttttcggaaataaaatagattgtctgcatttaccattggaatacatatacatatatacatctcttaactacttcaaaatactttggacttgtcgtgtcgtgtatttttagaaaaattatgaagaaacccagttttacct

SEQ ID NO: 1693 - DNA, 1637 bp, Arabidopsis thaliana
gtcacccaaaaacaaaatctaatagagaaaaataagtagatatggcaacccttaagtgcattgattggcaattcagcggaagcgaggcggccaaagatgctgctgcggcctccttaggctcatatacctctgcactctatgccctgtgcgatcctcatggcaaacccattttgcccccacgaaatgagatcctggagaccagcaatacagccgaaaaagcagttgttaaagctgttctttatggctcgggaaacgcctatgctcctagcttaggcctcgcggccgccaaaagtgccgtagcagagtatctaaaccaaggtcttccaaagaagcttaccgcagatgacgtgtttatgactctgggatgcaaacaagctattgagctcgcggtagacattctcgctaaaccgaaagccaacgttttgcttccgagtcccggcttcccatgggacctagtccgctccatctacaagaaccttgaggtccgccactataatttccttccagaaaagaactttgaaatcgactttgatagcgtccgagcgctcgtggacgagaacacatttgccatatttataatcaacccccacaaccccaatggtaacacctactccgaggctcatctcaaacagctggctgaactggctaaggaactcaagattatggtggtttctgacgaggtttttagatggacactctttggtagtaacccttttgttcctatgggaaaattctcgtcgatcgtaccagtggttacactcggatccatatcaaagggatggaaagtcccaggatggcgaactggttggctcacgctacatgatctagacggtgtcttcagaaacaccaaggtcttacaagctgctcaagattttctccagataaacaataaccctccgacagttatccaggcggctattcctgacatcttggagaaaactcctcaagagttttttgataagaggcagagttttctgaaagataaagtagaatttggttattctaagctcaagtacattcctagcctcacttgctacatgaaacccgaagcctgcaccttcttatggaccgagcttgatttatcgagctttgtggacatcgaagacgatcaagacttttgcaataagcttgctaaagaagaaaacctcgtcgttttaccagggattgcattcagtcagaagaactggttgaggcattctatcgatatggagactccggtattggaggatgcattggaaagattgaagagcttctgcgatcgccattccaacaaaaaagctcccctcaaagacgtcaatggtgttaagtaaagggtcaatatggttatttgcctaagtcatttacgtatgctataatgataaataaatgagtgtttcttggtttgaggtaaatcatgaacactttagtgtatttgtaacaaataaaatgggtgcacttaatatcaatcgtgtgtaatgttttctcatagtttgctatatctttgtgtatatctatctacttttcggaaataaaatagattgtctgcatttaccattggaatacatatacatatatacatctcttaactacttcaaaatactttggacttgtcgtgtcgtgtatttttagaaaaattatgaagaaacccagttttacct

SEQ ID NO: 1694 - DNA, 442 bp, Brassica napus
atggacgcctgcggaccggtccgaattctcgggtcgacccacgcgtccggaaacatatacctcaaaagcaccaaacacaaaccaaagaagaagaacacaatatggtgtctcaaaaactggagatttgcatcgaattagtgaagtttgccgtcgtttttgtagccaccgtggctgaatcagtagaaaaggctttccggaagcctttgccggcgcttccagcagttcatgatggtagccggaatagttactcggccgttcccattcctcttgttggattcatgtgatgagctttcttttgtttgtttattttatttttcttctcttttttgggtgttgacctcgttaaagttaggagtggcgttttgaagttgttgatatgtgtatacgcataatcaaagtaatcatgaagagttgcagatgaatcaaaccgtcgaactttacc

SEQ ID NO: 1695 - DNA, 396 bp, Brassica napus
gagaacagagagagaagaaacatatacctcaaaagcaccaaacacaaaccaaagaagaagaacacaatatggtgtctcaaaaactggagatttgcatcgaattagtgaagtttgccgtcgtttttgtagccaccgtggctgaatcagtagaaaaggctttccggaagcctttgccggcgcttccagcagttcatgatggtagccggaatagttactcggccgttcccattcctcttgttggattcatgtgatgagctttcttttgtttgtttattttatttttcttctcttttttgggtgttgacctcgttaaagttaggagtggcgttttgaagttgttgatatgtgtatacgcataatcaaagtaatcatgaagagtgcagagaatcaaaccgt

SEQ ID NO: 1696 - DNA, 470 bp, Brassica juncea
  misc_feature (299)..(299): n is a, c, g, or t
  misc_feature (303)..(303): n is a, c, g, or t
  misc_feature (306)..(306): n is a, c, g, or t
  misc_feature (313)..(314): n is a, c, g, or t
  misc_feature (320)..(320): n is a, c, g, or t
acaaaaacaagagatttcaagacgcggaaaacatagagagaagaaacttatacctcaaaggcgcaaaacacacacctaagaagaaaaacacaatatggtgtctcaaaagctggagatttgcatcgaattagtgaagtttgccgtcgtttttgtagccaccgtgactgaatcagtagaaaaggctttccgtaagcctttgccggcgcttccggcagttcatgatggtagccggaatagttactcggccgttcccattcctcttgttggattcatgtgatgagctttttttgtttgtttantttnttnttcttcnntttttngtttttggctttgttaaagttaggagttttcgtgccatgtggcgtttttgaaggtgctgatttgtgtattaagtataatcaaattcaaaagaatcatgaagagttgcagatgaatcaaatcgttgaagtttacccaaaagtttgagtatt

SEQ ID NO: 1697 - DNA, 517 bp, Arabidopsis lyrata
gactcacaaagacaagagttctctagacgcggaaaacatagagaaaacaaaaaaccctcaaaagcgcaaaacacgaaacaagaagaaaagaaaaacatttttatttctctcctacgaattaagtacgtacaacatggtgtctcaaaagctagagatttgcatcgaattggtgaaaatagctgttggtttcgtcgccaccgttgctgaatcagtagaagaagctttccgtaagcctcaaccgtcgcttacagcagttcacggtggtcgccggaatacttacgccgccgttcccattcctcttgttggattcatgtgatgagcttcttagttttttttttttttttggttttggcctcgttaaagttagtagttctcgtgccttgtggcgttttggatgttgttgatttgtgtataaagcataaccaaaagataatgaagagtttacagatgaatcaaatcgtggacgtttattgatttttgagtattaactgcttttaactttctttaagatctattg

SEQ ID NO: 1698 - DNA, 516 bp, Arabidopsis thaliana
aagacgactcacaaagacaagagttctctagacgcggaaaacatagaaagaaaaaaacctaaaaagcgcaaaacacgaaacaagaagaaaagaaaaacatttctcttcctacgaattaagcacaaacaacatggtgtctcaaaagctagagatttgcatcgaattggtgaaaattgctgttgttttcgtcaccaccgtggctgaatcagtagaagaagctttccgtaagcctccaccgtctcttccagcagttcacggtggtcgccggaataattacgccgccgttcccattcctcttgttggattcatgtgatgagcttcttagttttttatttttttttggttttggcctcattaaagttagtagttcccgtgccttgtggcgttttggatattgtttatttgtgtataaagtataaccaaaacataatgaagagtttacagatgaatcaaaaccgtggacgtttatataattcttgtgtattaactgcttttaattttctttaagatctattg

SEQ ID NO: 1699 - DNA, 511 bp, Arabidopsis thaliana
gactcacaaagacaagagttctctagacgcggaaaacatagaaagaaaaaaacctaaaaagcgcaaaacacgaaacaagaagaaaagaaaaacatttctcttcctacgaattaagcacaaacaacatggtgtctcaaaagctagagatttgcatcgaattggtgaaaattgctgttgttttcgtcaccaccgtggctgaatcagtagaagaagctttccgtaagcctccaccgtctcttccagcagttcacggtggtcgccggaataattacgccgccgttcccattcctcttgttggattcatgtgatgagcttcttagttttttatttttttttggttttggcctcattaaagttagtagttcccgtgccttgtggcgttttggatattgtttatttgtgtataaagtataaccaaaacataatgaagagtttacagatgaatcaaaaccgtggacgtttatataattcttgtgtattaactgcttttaattttctttaagatctattg

SEQ ID NO: 1700 - DNA, 522 bp, Brassica napus
atttccgggtcgaccacgcgtccggttctgcagacgcggcaaacatagagagaagaaacatatacctcaaaagcgcaatacacaaaccagacgaagaagaaaatccacttttagatttctcctacaaatcaaacacaatatggtgtctcaaaagctagagatctgcatcgaattagtgaagattggcgtcgtttttgtcgccactgtggctgaatcagtagaaaaagctttccgtaagccaccaccgtcgcttccggcagttcatgatagtcgccggaacagttacgccgacgttcctattcctcttgttggattcatgtgatgagctctttttttttgggttttggcctcgttaaagttagtagctctcgtgccatgtggcgttttggaagttgttggtttgtgtatataagaatcttgaagagttacagatgaatcaaatcgtcaatgcttataaaactttttgactattaaatcgctctaactgtctttaagatcattccaatcttataagcacacctt

SEQ ID NO: 1701 - DNA, 521 bp, Brassica napus
  misc_feature (4)..(4): n is a, c, g, or t
  misc_feature (450)..(450): n is a, c, g, or t
attnacaagtcacaaaggcaaaagttctgcagacgcggcaaacatagagagaagaaacatatacctcaaaagcgcaatacacaaaccagacgaagaagaaaatccacttttagatttctcctacaaatcaaacacaatatggtgtctcaaaagctagagatctgcatcgaattagtgaagattggcgtcgtttttgtcgccactgtggctgaatcagtagaaaaagctttccgtaagccaccaccgtcgcttccggcagttcatgatagtcgccggaacagttacgccgacgttcctattcctcttgttggattcatgtgatgagctctttttttttgggttttggcctcgttaaagttagtagctctcgtgccatgtggcgttttggaagttgttggtttgtgtatataagaatcttgaagagttacagatgaatcaaatcgtcaatgnttataaaactttttgactattaaatcgctctaactgtctttaagatcattccaatcttataagcacacctt

SEQ ID NO: 1702 - DNA, 464 bp, Thellungiella halophila
gacaaagacaaaagatctcgagacgcggaaaaacatagagagaagaaagaaacacatacacctcaaaagcgcaaaacacaacccacagagacatttttagtttttttctcatccaaataaaacacaatatggtgtctcaaaagctggagatttgcatcgaattgatgaagattgccgtggttttcgtcgccaccgtggctgaatcagtagaagaagctttccgaaagcctctgccggcgctaccagcagttcacggtggtcgccgaaatagttacgccaacgttccagttcctcttgttggattcatgtgatgagcttttttgttttttttttttgtttttatcttttcgattttggcctcgttaaagttagtagctctcgtgccatgtggcgttttggaagttgttgatttgtgcataagcaaaagagtttactgataaatcaaatcgtcgagttttgtaacc

SEQ ID NO: 1703 - DNA, 357 bp, Brassica juncea
gctcacaaagacaagagttctcgagacgcggaaaacatagagagaagaaacacccttacctcaaaagcgcaatacacagaagaaaaaaagtacatctttagttttctcctacagatcaaccacaacatggtgtctcaaaagctagagatctgcatcgaactagtgaagattggcgtcgtttttgtcgccaccgtggctgaatcagtagagaaagctttccgcaagcctccgcaggtgcttccggcagttcatgatggttgccagaatagttacgccgatgttcccattcctcttgttggattcatgtgatgtgcctttttttggttgaacttttttttttcttgagttttggcatcg

SEQ ID NO: 1704 - DNA, 322 bp, Brassica juncea
aagtcacaaaggcaaaaagttctgcagacgcggcaaacatagagagaagaaacatatacctcaaaagcgcaatacacaaaccagacgaagaagaaaatccacttttagttttctcctacagatcaaccacaacatggtgtctcaaaagctagagatctgcatcgaactagtgaagattggcgtcgtttttgtcgccaccgtggctgaatcagtagagaaagctttccgcaagcctccgcaggtgcttccggcagttcatgatggttgccagaatagttacgccgatgttcccattcctcttgttggattcatgtgatgtgcc

SEQ ID NO: 1705 - DNA, 427 bp, Brassica rapa
ctcaagacgcggaaaaaatagagtgaaggaatacatacctcaaaagcgcaaaaaaccaaaccaaagaaccgaatcatacatttttatttttctcctacaaattaaacacagtatggtgtctcaaaagctggagttttgcatcgaattagtgaagatggcagtcgtttttgtcgccgccgtggctgaatcattagaagaagctttccgtaagcctcagccggcgcttccggtagttcatgacggtcgccggaacagttacgctaacgttcccattcctctcgttggattcatgtgatgagttttttttttggttttggcctctttaaagttagtagctctcgtgccatgtggcgttttggaagttgttgatttatgtataagttaattaagagaatcattgagagttacagatgaatacaatttgggg

SEQ ID NO: 1706 - DNA, 396 bp, Brassica rapa
tcaaaagctagagatctgcatcgaattagtgaagattggcgtcgtttttgtcgccactgtggctgaatcagtagaaaaagctttccgtaagccaccaccgtcgcttccggcagttcatgatagtcgccggaacagttacgccgacgttcctattcctcttgttggattcatgtgatgagctctttttttttgggttttggcctcgttaaagttagtagctctcgtgccatgtggcgttttggaagttgttggtttgtgtatataagaatcttgaagagttacagatgaatcaaatcgtcaatgtttataaaacttttttactattaaatcgctttaactgtctttaagatcattccaatcttataagcacacttaaaaaactgcagttacaacttt

SEQ ID NO: 1707 - DNA, 462 bp, Raphanus sativus
ggtgacaaagataagagctctcgagacgcggaaaacatagagagaagaaacacgcatacctcaaaagcgcaatacacaaaaagaaaaagtacatctttagttttctcctacaaattaaacacaatatggtgtctcaaaagctggagatctgcatcgagttagtgaagactgccgtctcttttgtagccaccgtggctgaaacagtggaagaagctttccgtaagcctccgccggcgcttccgtcagctcatgatgttcgccggaacagttacgccgacgttcccattcctcttgttggattcatgtgatgagctttttgtgtttgttaaacttttattctttagttttggcctcgtttggctctcgtgccatgaggcgttttggaatgttgttgatttgtgtataaatataaccaagtgaatcatgaagagttacagataaatcaaatcgtcgatgtttata

SEQ ID NO: 1708 - DNA, 774 bp, Brassica napus
gaaaaaaaaatatgagtggctccggtgcgcagcttcacaatgttttcgtctatggtagctttcaggagcctgaggtcgtcaaggtcatgcttgatcgtagtcctgaaatcatctctgtaacactccctggctttaagaggtttaggcttaaagggcgtttgtatccatgtgttataccgtctgaagatggagaagttcatggaaagttactaatgggattaacggatgaagaacttgagaatgtagatgctgttgagggtaatgaatatgagagagtgacagttggtgttgtaagagaggacaattctgagaagatgactgtgaaaacatatatatggatcaataaagatgatcctgatatcgatggagaatgggatttcgaggaatggaaacgactacacatgaagaaattcatagagacgttcaaagaaatcatggaatggaagaggaatcctcaaggaaagggaagggacgacttcaaccatgtcctgcgcgatgctccatcggcttgagttgaatttgtgttaagagtatgttctatgtttcatttttctccagattccgagtataataaaacctagaaaagtgataggtattgtggagatcagtgaaagtatagtaatgctatatgttattttgtatgttctatgaatcatttttcttccatagattttggcatttatattgtgtatggttttgatcagccaatgcttatggtttctctttataagtaactaattaaagagagtagtagatcattgtactgatctgcta

SEQ ID NO: 1709 - DNA, 855 bp, Brassica napus
gtcggcagagaatcctaacacgtgattccgggcatcgtggtcggtggtccttgtcaagattcttttatcttcacgttataaatcaaaccacggataaagaaacaacaaaagcaagaaaaaaaaatatgagtggctccggtgcgcagcttccaatgttttcgtctatggtagctttcaggagcctgaggtcgtcaaggtcatgcttgatcgtagtcctgaaatcatctctgtaacactccctggctttaagaggtttaggcttaaagggcgtttgtatccatgtgttataccgtctgaagatggagaagttcatggaaagttactaatgggattaacggatgaagaacttgagaatgtagatgctgttgagggtaatgaatatgagagagtgacagttggtgttgtaagaggacaattctgagaagatgactgtgaaaacatatatatggatcaataaagatgatcctgatatcgatggagaatgggatttcgaggaatggaaacgactacacatgaagaaattcatagagacgttcaaagaaatcatggaatggaagaggaatcctcaaggaaagggaagggacgacttcaaccatgtcctgcgcgatgctccatcggcttgagttgaatttgtgttaagagtatgttctatgtttcatttttctccagattccgagtataataaaacctagaaaagtgataggtattgtggagatcagtgaaagtatagtaatgctatatgttattttgtatgttctatgaatcatttttcttccatagattttggcatttatattgggtatgggtttgatcagccaatgcttaagggttctctttataaggaactaaataaag

SEQ ID NO: 1710 - DNA, 852 bp, Brassica napus
gttggcatttgaaagaaaaactggaagagaatacaaaatggcaacgcgaggagcagctgctgcgttcgtaatatggaagcaccgaaacaacccttctcttcgatcgatatcatcgcaccatttctatcccattttcaaacctcaaatcatcccaaaagggtgtcgatatcagattagggcaatacaaggagaaagtgttgatcgcggtacacaatcgaagaacaacgatgagccaaaaccaaaacctgagaattggaaaatcaaaatgctttacgatggggattgccctctctgtatgcgtgaggttaatatgcttaaggaaaggaatgaggaatatggaacgataaagttcgtcgacatcagttccaatgattattccccgcaagagaatcaagggcttgattacaaaactgttatggggcaaatccacgcgattcagtccgagggaaatgtggtaacgggtgtggaggcatttaggaaactatatgaattggttgggcttggatgggtttactctatcacaaaatttgaaccaatagggaaggtagctgatgcagtgtatgatttctgggctaagtatcgacttcaggtcacagggcggccacctatagaagctattcttgaagcgagaaagaaaaataaggtggagacatgtggtaacagtaaggcgtgcaagacgtgatttttcttacaaattacatataccacaaccagtttgtagttacatatgctctgttttcccgcattatgtaaacttgagtgtttcgatgtattagataaaaagtacgttacgtatatatcggaccagatcttcctttggaaataagaatattcgaaatcaaaattgacata

SEQ ID NO: 1711 - DNA, 769 bp, Brassica rapa
  misc_feature (762)..(762): n is a, c, g, or t
gaaaaattggaagagaatacaaaatggcaacgcgaggagctgctgctgcgttcgtaatatggaagcaccgaaacaacccttctcttcgatcgatatcatcgcaccatttctatcccattttcaaacctcaaatgatcccaaaagggtgtagatatcaaattagggcaatacaaggagaaagtgttgatcgcggtacacaatcgaagagcaacgatgagccaaaaccaaaacctgagaattggaaaatcaaaatgctttacgatggggattgccctctctgtatgcgtgaggttaatatgcttaaggaaaggaatgaggaatatggaacgataaagttcgtcgacatcagttccaatgattattccccgcaagagaatcaagggcttaattacaaaactgttatggggcaaatccacgcgattcagtccgatggaaatgtggtaacgggtgtggaggcatttaggaaactatatgaactggttgggcttggatgggtttactctatcactaaatttgaaccaatagggaaggtagctgatgcagtgtatgatttctgggctaagtatcgacttcaggtcacagggcggccacctatagaagctattcttgaagcgagaaagaaaaataaggtggagacatgtggtaacagtaaggcgtgcaagacgtgatttttcttacaaattacatataccacaaccagtttgtagttacatatgctctgttttcccgcattatgtaaacttgagtgtttcgatgtattanataaaaa

SEQ ID NO: 1712 - DNA, 852 bp, Brassica napus
  misc_feature (21)..(22): n is a, c, g, or t
ggttggcatttgaaagaaaanntggaagagaatacaaaatggcaacgcgaggagcagctgctgcgttcgtaatatggaagcaccgaaacaacccttctcttcgatcgatatcatcgcaccatttctatcccattttcaaacctcaaatcatcccaaaagggtgtcgatatcagattagggcaatacaaggagaaagtgttgatcgcggtacacaatcgaagaacaacgatgagccaaaaccaaaacctgagaattggaaaatcaaaatgctttacgatggggattgccctctctgtatgcgtgaggttaatatgcttaaggaaaggaatgaggaatatggaacgataaagttcgtcgacatcagttccaatgattattccccgcaagagaatcaagggcttgattacaaaactgttatggggcaaatccacgcgattcagtccgagggaaatgtggtaacgggtgtggaggcatttaggaaactatatgaattggttgggcttggatgggtttactctatcacaaaatttgaaccaatagggaaggtagctgatgcagtgtatgatttctgggctaagtatcgacttcaggtcacagggcggccacctatagaagctattcttgaagcgagaaagaaaaataaggtggagacatgtggtaacagtaaggcgtgcaagacgtgatttttcttacaaattacatataccacaaccagtttgtagttacatatgctctgttttcccgcattatgtaaacttgagtgtttcgatgtattagataaaaagtacgttacgtatatatcggaccagatcttcctttggaaataagaatattcgaaatcaaaattgacat

SEQ ID NO: 1713 - DNA, 862 bp, Raphanus sativus
  misc_feature (35)..(35): n is a, c, g, or t
  misc_feature (227)..(227): n is a, c, g, or t
  misc_feature (239)..(239): n is a, c, g, or t
  misc_feature (702)..(702): n is a, c, g, or t
ggaagcacattttgcatctgagaaaaaaattggangagaatacaaaaatggcaacgcgaggagctgctgctgcgttcgtaatatggaagcaccgaagcaacccttctcttcgatctctatcatcacaccatttctatcccgttttcaaacctcaaatcatcccaaaagggtttagatatcaaattagggcgatacaaggagcaagtgttgatcccgttacacaattnaagaacaacgangagccaaaacctgagaattggaaaatcaaaatgctttacgatggggattgccctctctgtatgcgtgaggttaatatgcttaaggaaaggaatgaggaaaatggaacgataaagttcgttgacatcagttccgatgattattccccgcaagagaatcaagggcttgattacaaaacagttatggggcaaatccacgcgattcagtccgatggaaatgtggtaacgggtgtggaggcatttaggaaactatatgaggaggttgggcttgggtgggtttacactatcactaaatttgaaccaatagggaaggtagctgatgcagtgtatgatttctgggctaagtatcgacttcaggtcacagggcggccacctatagaagctattttggaagcgagaaagaaaaataaggtagagacatgtggtgacagtaaggcgtgcaagacgtgatttttcttacaaattnacatataccacagccagtttggacttacttatactctcttgcccacattttgtaaacttgagtgtttctatgtattagaaaagacctcgttacatatatttccgaccagatcttcctttggaaatatgaatattggaaatcaaaatcaacatagtttgat

SEQ ID NO: 1714 - DNA, 1035 bp, Brassica napus
gttcgtctatgactcctatctaaccttaatcatcatcccttgtgttagcttctttaagaacttgctttccagcaaagctcgaaaatacaagaaagtaaaaggtatggcgtcgaacaacagcaacgatgatttgtatgctgttcttggtttgaacaaggaatgtacctcgaccgaacttcgcactgcttataagaagcttgctcttatatggcatccagatcgttgttcatcaatggggaatatggagtttgtagatgaagcaaagaagaaatttcaggctattcaagaggcttactctgttctgtctgactccaacaagaggttcctctatgatgttggagcttataacagtgatgatgatgttgaggaccaaaatggaatgggagatttcttgaacgaaatggctgcaatgatgaatcagtccaagcctaatgacaatagttcaggggacagttttgagcagctacaagatttgtttaacgagatgtttcaaggagacgccgcggcattcccaccctcatcatcatccttctctgcttcaactttcacttcctcttgtaactttgtctttgatacaaactatcagcagtcaccgtttgggatgggctcgatggggactagcgatcctttcggatttgactcaagatctcacaccttctctttaggggtggaacatcagcaggatttcaagaaagggaagaacaatggtggaagaaggaacagacggaagaacaatgctcaatcttctaacaactatggagtccctacttcatagcccttccttcagaccatattttttatttgtcgactagtcacacacatgaggactactggttatggtctcctctcaacggcgatgcatgaaaatactcaaaaaaacattgtcgtttgtaaactacacaccctcattttctcgaagcttcttctctctctctctctctctctctctctctctctctctctctctctctctctctctctctcattgtgtgtaataagaccaaaactattcatcattgagaaatgatggtgttt

SEQ ID NO: 1715 - DNA, 971 bp, Brassica rapa
  misc_feature (907)..(907): n is a, c, g, or t
  misc_feature (910)..(910): n is a, c, g, or t
ggccctattttaaccacctcttctcttttctcttgagtttcttctatgttcgtctacgactcctatctaaccctaatcatcatcccttgtgtttggcttctttaagaacttgctttccaagcaaagctcgaaaatacaagaaagtaaaaggtatggcgtcgaacaacggcaacgatgatttgtatgctgttcttggtttgaacaaggaatgtacctcgaccgaacttcgtactgcttataagaagcttgctcttagatggcatccagatcgttgttcatcaatggggaacttggagtttgtagatgaagcgaagaagaaatttcaggctattcaagaggcttactctgttctgtctgactccaacaagaggttcctctatgatgttggagcttataacagtgatgatgatgttgaggaccaaaatggaatgggagattttttgaacgaaatggctgcaatgatgaatcaatccaagcctaatgagaataattcaggggacagttttgagcagctacaagatttgtttaacgagatgtttcaaggagacgccacagcattcccaccctcatcatcatccttctctgcttcaactttcacttcctcttgtaactttgtctttgatacaaactatcagcagtcaccgtttgggatgggctcgatggggactagtgatcctttcggatttgactcaagatctcacaccttctctttaggggtggaacatcagcaggatttcaagaaagggaagaacaatggtggaagaaggaacagacggaagaacaatgctcaatcttctaacaactatggagtccctacttcatagctcttcacttcagaccatattttttatttgtcgactagtcacacacatgaggactactggttatggtctcctcaacggcgatncangaaaatactcaaaagcattgtcgtttgtaaactacacacctcatttctcgaagctcttttc

SEQ ID NO: 1716 - DNA, 1075 bp, Brassica napus
  misc_feature (1050)..(1050): n is a, c, g, or t
  misc_feature (1064)..(1064): n is a, c, g, or t
taatcatcatcccttgtgttagcttctttaagaacttgctttccaagcaaagctcgaaaatacaagaaagtaaaaggtatggcgtcgaacaacagcaacgatgatttgtatgctgttcttggtttgaacaaggaatgtacctcgaccgaacttcgcactgcttataagaagcttgctcttatatggcatccagatcgttgttcatcaatggggaatatggagtttgtagatgaagcaaagaagaaatttcaggctattcaagaggcttactctgttctgtctgactccaacaagaggttcctctatgatgttggagcttataacagtgatgatgatgttgaggaccaaaatggaatgggagatttcttgaacgaaatggctgcaatgatgaatcagtccaagcctaatgacaatagttcaggggacagttttgagcagctacaagatttgtttaacgagatgtttcaaggagacgccgcggcattcccaccctcatcatcatccttctctgcttcaactttcacttcctcttgtaactttgtctttgatacaaactatcagcagtcaccgtttgggatgggctcgatggggactagcgatcctttcggatttgactcaagatctcacaccttctctttaggggtggaacatcagcaggatttcaagaaagggaagaacaatggtggaagaaggaacagacggaagaacaatgctcaatcttctaacaactatggagtccctacttcatagcccttccttcagaccatattttttatttgtcgactagtcacacacatgaggactactggttatggtctcctctcaacggcgatgcatgaaaatactcaaaaaaacattgtcgtttgtaaactacacaccctcattttctcgaagcttcttctctctctctctctctctctctctctctctctctctctctctctctctctctctctctctctctcattgttgtctcctaagcaaagagttgttaagatcgatgaagtcaactgctgctttatgatgacgaatacacatcctattctctcnagatttctcagcantgaaattatca

SEQ ID NO: 1717 - DNA, 855 bp, Brassica napus
agcaaagctcgaaaaaacaagaaagtaaaaggtatggcgtcgaacaacagcaacgatgatttgtatgctgttcttggttggaacaaggaatgtacctcgaccgaactacgcactgcttataagaagcttgctcttagatggcatccagatcgttgttcatcaatgggaaacatggagtttgtacatgaagcaacgcaagaaatttcaggctattcaagaggcttactctgttctgtctgactccaacaagaggttcctctatgatgttggagcttataacagtgatgatgatgttgaggaccaaaatggaatgggagatttcttgaacgaaatggctgcaatgatgaatcaatccaagcctaatgacaatagttcaggggacagttttgagcagctacaagatttgtttaacgagatgtttcaaggagacgccgcggcattcccaccctcatcatcatccttctctgcttcaactttcacttcctcttgtaactttggctttgatacaaactatcagcagtcaccgtttgggatgggctcgatggggactagcgatccgttcggatttgactcaagatcgcacaccttctctttaggggtggaacatcagcaggatttcaagaaagggaagaacaatggtggaagaaggaacagacggaagaaccatgctcaatcttctaacgactatggagtccctacttcatagcccttccttcagaccatagtttttatttgtcgaactagtcaggcacatgaggactactgggtatggtctcctctcgacggcgatgcatgaaaatactcaaagaaacattgtcgtttgtaaactactaacaaatatggggtcaaaaagcg

SEQ ID NO: 1718 - DNA, 1123 bp, Brassica napus
ggagtagcacaataataaaaaccctattttaaccacctcttctcttctcttctctcttgagtttcttctttgttcgtctacgactcctatctaaaccctaatcatcgtcccttgtgttagcttctttaagaacttgctttccaagcaaagctctaaaatacaagaaaggaaaaggtatggcgtcgaacaacggcaacgatgatttgtatgctgttcttggtttgaacaaggaatgtacctcgaccgaactccgtactgcttataagaagcttgctcttagatggcatccagatcgttgttcatcaatggggaatatggagtttgtagatgaagcaaagaagaaatttcaggctattcaagaagcctactctgttctttctgactccaacaagaggttcctctatgatgttggagcttataacagtgatgatgatgttgaggaccaaaatggaatgggtgatttcttgaacgaaatggcagcaatgatgaatcaatccaagcctaatgagaatagttcaggggacagttttgaacagctacaagatctgtttaatgagatgtttcaaggagacgccacagcattcccaccctcatcatcgtctttccctgcttcaactttcacttcctcttgtgactttgtctttgatacaaactatcagcagtcaccgtttgggatgagctcgatggggactagtgatcctttcggatttgactcaagatctcacaccttctctttaggggtggaacatcagcaggatttcaagaaagggaagaacaatggtggaagaaggaacagacggaagaacagtactcagtcttctaacaactatggagtccctacttcatagcccttcacttcagactatattttttatttgtcgactagtcagaggactactggttatggtctcctcaacggctatgcatgaaaatactcaaaaaacattgtcgtttgtaaactacacacctcgttttctcgaagcttcttttttctttctctctctctctctatctatctaaatgttgtctcctaagcaaagagttgttaagatcgatgaagtcaactgctgctttatgatgacgacgaatacacatcctgttgtctcttgattttctcagcatt

SEQ ID NO: 1719 - DNA, 1061 bp, Raphanus sativus
atccccttgttttggcgtctttaagaacttgctttcgaatccaaagctctgtttaggagcttataattttgtcgaaagtaagaaggtatgacgtcgaacaaaggcaacaacgatgatttgtatgctgttcttggtctgaacaaggaatgtaccaccaccgaactacgtactgcttataagaagcttgctcttagatggcatccagatcgttgttcatcgatggggaacttggagtttgtagaccaagcaaagaagaaatttcaggctatccaagaagcctactctgttctgtccgactccaacaagaggttcctctatgatgttggagcttataatagtgatgatgatgaagctgaccaaaacggaatgggtgattttttgaatgaaatggctgccatgatgaatcaatccaagcctaatgagaataattcaggagacagtttcgaacagctacaggatctgtttaacgagatgtttcaaggagaccctacagcattcccaccctcatcatcttcaactttcacttcgtcttgtagctttgtctttgacacgaatggtcagcagtcaccgtttgagacgagctcgatgatggggagaagtgatcctttcggatttgactcaagatctcacactttctctctaggggtggaacatcagcaggatttcaagaaagggacgaagaacaatggtggaagaagaagcagacggaagaacaattctcaaacgtctaacaactatggagtctcctccacttcataggccctttttttcagaaccgtatttttttgatttgtcgactagtcacacactcacacacaagaggactactggttctggtccttctcaacggcgatgcccatcacaaaaaaaattcttaaaatacattttctcgaagcttcttttctttttcctctctctaattgttgtctcctgagcaaagagtcgttaagatcattgagattgatgaagtcaactggtttgtgatgatcgaatacacatcgtatgtctcttgattctttcagcatttaattaatacaaaatacattttttttgcttggtcc

SEQ ID NO: 1720 - DNA, 1129 bp, Brassica oleracea
cttctttgttcgtctacgactcctatctaaaccctaatcatcgtcccttgtgttagcttctttaagaacttgctttccaagcaaagctctaaaatacaagaaaggaaaaggtatggcgtcgaacaacggcaacgatgatttgtatgctgttcttggtttgaacaaggaatgtacctcgaccgaactccgtactgcttataagaagcttgctcttagatggcatccagatcgttgttcatcaatggggaatatggagtttgtagatgaagcaaagaagaaatttcaggctattcaagaagcctactctgttctttctgactccaacaagaggttcctctatgatgttggagcttataacagtgatgatgatgttgaggaccaaaatggaatgggtgatttcttgaacgaaatggcagcaatgatgaatcaatccaagcctaatgcaagactctcttcactagtttctttcacccttagcttattataataaacttctttagatatttgaaatgttggttttggcaggagaatagttcaggggacagttttgaacagctacaagatctgtttaatgagatgtttcaaggagacgccacagcattcccaccctcatcatcgtctttccctgcttcaactttcacttcctcttgtgactttgtctttgatacaaactatcagcagtcaccgtttgggatgagctcgatggggactagtgatcctttcggatttgactcaagatctcacaccttctctttaggggtggaacatcagcaggatttcaagaaagggaagaacaatggtggaagaaggaacagacggaagaacagtactcagtcttctaacaactatggagtccctacttcatagcccttcacttcagactatattttttatttgtcgactagtcagaggactactggttatggtctcctcaacggctatgcatgaaaatactcaaaaaacattgtcgtttgtaaactacacacctcgttttctcgaagcttcttttttctttctctctctctctctatctatctaaatgttgtctcctaagcaaagagttgttaagatcgatgaagtcaactgctgctttatgatgacgacgaatacacatcctgttgtctcttga

SEQ ID NO: 1721 - DNA, 1148 bp, Raphanus sativus
  misc_feature (99)..(99): n is a, c, g, or t
  misc_feature (113)..(113): n is a, c, g, or t
  misc_feature (115)..(115): n is a, c, g, or t
  misc_feature (121)..(121): n is a, c, g, or t
  misc_feature (125)..(126): n is a, c, g, or t
  misc_feature (140)..(141): n is a, c, g, or t
  misc_feature (145)..(146): n is a, c, g, or t
  misc_feature (152)..(153): n is a, c, g, or t
  misc_feature (164)..(164): n is a, c, g, or t
  misc_feature (170)..(170): n is a, c, g, or t
  misc_feature (173)..(174): n is a, c, g, or t
gggagttccattctctctattagcgtatacgtatgaaaggagaggagagaacacacaaataaaaaccctatttctaaccaaccctaatcttcatcatcntcatccccttgttntngcgtcntaannaacttgctttcgannccanngctctnntttggagcttntaattngtnnaaagtaaaaaaggtatgacgtcgaacaaaagcaacaacgatgacttgtatgctgttcttggtctgaacaaggaatgtaccaccaccgaagtacgtactgcttataagaagcttgctcttagatggcatccagatcgttgttcatcgatggggaacttggagtttgtagaagaggcaaagaagaaatttcaggctatccaagaagcctactctgttctgtctgactccaacaagaggttcctctatgatgttggagcttataatagtgatgatgatgaagctgaccaaaacggaatgggtgatttcttgagcgagatggctgccatgatgaatcaatccaagcctaatgagagtaataattcaggggacagtttcgaacagctgcaggatctgtttaacgagatgtttcaaggagaccctacagcattcccatcctcatcttcaactttcacttcttcttgtagctttgtctttgacactaacggtcagcagtcacagtttgggagaagcgatcctttcggatttgactcaagatctcacactttctctctaggggtggaacatcagcaggatttcaagaaagggaagaacaatggtggtggaagaagaaacagacggaagactcaatcgtctaacaactatggagtctcctccacttcataggcccttttttcagaaccgtatttttttgatttgtcgactagtcacacacacacaagaggactactggttctgtctggtatttctcaacggcgatgcccatcacaaaaatactcaaaagcattgtcgtttgtaaactacacattttctcgaagcttcttttttttcctctctctaattgttgtctcctgagcagaagagtcgtcgttaagatcattgagatcgatgaagtcaactggtttatgatgatcgaatacacatctcttgattctttcagcatttaattaatacaaatacatttttttgcttggttca

SEQ ID NO: 1722 - DNA, 902 bp, Raphanus sativus
  misc_feature (28)..(28): n is a, c, g, or t
  misc_feature (707)..(707): n is a, c, g, or t
  misc_feature (741)..(741): n is a, c, g, or t
  misc_feature (744)..(744): n is a, c, g, or t
  misc_feature (802)..(802): n is a, c, g, or t
  misc_feature (813)..(813): n is a, c, g, or t
  misc_feature (818)..(818): n is a, c, g, or t
  misc_feature (871)..(871): n is a, c, g, or t
tcatccccttgttttagcgtctctaagnaacttgctttcgagtccaaagctctgctttggagcttataattttgtgtaaagtaaaaaaaggtatgacgtcgaacaaaagcaacaacgatgacttgtatgctgttcttggtctgaacaaggaatgtaccaccaccgaagtacgtactgcttataagaagcttgctcttagatggcatccagatcgttgttcatcgatggggaacttggagtttgtagaagaggcaaagaagaaatttcaggctatccaagaagcctactctgttctgtctgactccaacaagaggttcctctatgatgttggagcttataatagtgatgatgatgaagctgaccaaaacggaatgggtgatttcttgagcgagatggctgccatgatgaatcaatccaagcctaatgagagtaataattcaggggacagtttcgaacagctgcaggatctgtttaacgagatgtttcaaggagaccctacagcattcccatcctcatcttcaactttcacttcttcttgtagctttgtctttgacactaacggtcagcagtcacagtttgggagaagcgatcctttcggatttgactcaagatctcacactttctctctaggggtggaacatcagcaggatttcaagaaagggaagaacaatggtggtggaagaagaaacagacggaagactcaatcntctaacaactatggagtctcctccacttcatagnccnttttttcagaccgtatttttttatttgtcgactagtcacacacacaagaggactactngttctgtcttnttctnaacggcgatgcccatcacaaaatactcaaaagcattgtcgtttgtaaactacncattttctcgaagcttcttttttttcctctc

SEQ ID NO: 1723 - DNA, 1274 bp, Brassica rapa
gggttctggagagttccattccctctctaacgtatgttggagagatagaggaaaacaaaaaattcttctctcccaacttcttctttgatcatctacgatcttcagtgttcctgcgtcttaagaacgtagtttcgagtccattgaacccactttagtaccagtattggtctgtgactctgagactctgttttttttggtggttgaattcatcgaaagaatcgatttttattgtgtttttgtcggttttggtttgtgggttttgagaaataaaggcatggcgtcgaacagtaacgagaaagggaacgatgatctgtatgctgttatgggtttgaagaaggaatgtaccaccacggagctccgttctgcttacaagaagctcgctcttagatggcatccagatcgttgttcgtcgatgggggattcggagtttgtagatgaatcaaagaagaagtttcaggctatccaagaggcctactctgttctgtctgactccaacaagaggttcctctatgacgttggagcttataatagtgatgatgatgatcatgaccaaaacggaatgggagattttttgaacgagatggctaccatgatgaatcagtcaaagcctagtgagaataacacaggggacagttttgaacagttgcaagatctgtttaatgagatgtttcaaggagacgcttcagcattctcctcatcttcatcatcatgcaatgcctcaactttcacttcctcttgtagctttgtcttcgacactaatgctcagcagtcaccgtttgagcacaactcgatggggatgaatgatcctttcgcgtttgaccccagagctcacaccttctctttaggggtggaacatcagcaggatttcaagaaggggaagaacaatggtgggaggagaaacaggaggaagaacaatgctcaatcagctactcacgaaacgtcgtcgtcaaacaactatggagtccccacttcataactattgaggaccatctttttgataacttatctccacatttgtcgactagtcacacacaagaggactggttctggtcttctcaacaaggatgcatcaaaaactccaaacgttgtcgtttgtaaaactacccttgtagttcgttctctcggagcttttttctctctctctctctctactttgttattgaattgttgtctcctaagcaagagtctttaacaccattgttatgtaatacttgtcccagattcttaattagtcattggttttctcagcatttgattatctatacaacaacttt

SEQ ID NO: 1724 - DNA, 1211 bp, Brassica napus
ggggttctggagagttccattccctctctaacgtatgttggagagatagaggaaaacaaaaaattcttctctcccaacttcttctttgatcatctacgatcttcagtgttcctgcgtcttaagaacgtagtttcgagtccattgaacccactttagtaccagtattggcatggcgtcgaacagtaacgagaaagggaacgatgatctgtatgctgttatgggtttgaagaaggaatgtaccaccacggagctccgttctgcttacaagaagctcgctcttagatggcatccagatcgttgttcgtcgatgggggattcggagtttgtagatgaatcaaagaagaagtttcaggctatccaagaggcctactctgttctgtctgactccaacaagaggttcctctatgacgttggagcttataatagtgatgatgatgatcatgaccaaaacggaatgggagattttttgaacgagatggctaccatgatgaatcagtcaaaacctagtgagaataacacaggggacagttttgaacagttgcaagatctgtttaacgagatgtttcaaggagacgcttcagcattctcctcatcatcatcatcatgcaatgcctcaactttcacttcctcttgtagctttgtctttgacactaatactcagcagtcaccgtttgagacaaactcgatggggatgaatgatcctttcgcgtttgaccccagagctcacaccttctctttaggggtggaacatcagcaggatttcaagaaggggaagaacaatggtgggagaagaaacaggaggaagaacaatgctcaatcagctactcacgaaacgtcgtcgtcaaacaactatggagtccccacttcatagctgttgaagaccatctttttgataacttatctccacatttgtcgactagtcacacacaagaggactggttctggtcttctcaacaaggatgcatcaaaaactccaaacgttgtcgtttgtaaaactacccttctcgttcgttctctcggagcttttttctctctctctctctctactttgttattgaattgttgtctcataagcaagagtctttaacaccattgttatttaatacttgtcctagactcttaattagtcattggttttctcagcatttgattatctatacaacaactttttgtttggtattgaaccaagcatcacatagtgatggcaatac

SEQ ID NO: 1725 - DNA, 1226 bp, Brassica napus
ggggttctggagagttccattccctctctaacgtatgttggagagatagaggaaaacaaaaaattcttctctcccaacttcttctttgatcatctacgatcttcagtgttcctgcgtcttaagaacgtagtttcgagtccattgaacccactttagtaccagtattggcatggcgtcgaacagtaacgagaaagggaacgatgatctgtatgctgttatgggtttgaagaaggaatgtaccaccacggagctccgttctgcttacaagaagctcgctcttagatggcatccagatcgttgttcgtcgatgggggattcggagtttgtagatgaatcaaagaagaagtttcaggctatccaagaggcctactctgttctgtctgactccaacaagaggttcctctatgacgttggagcttataatagtgatgatgatgatcatgaccaaaacggaatgggagattttttgaacgagatggctaccatgatgaatcagtcaaaacctagtgagaataacacaggggacagttttgaacagttgcaagatctgtttaacgagatgtttcaaggagacgcttcagcattctcctcatcatcatcatcatgcaatgcctcaactttcacttcctcttgtagctttgtctttgacactaatactcagcagtcaccgtttgagacaaactcgatggggatgaatgatcctttcgcgtttgaccccagagctcacaccttctctttaggggtggaacatcagcaggatttcaagaaggggaagaacaatggtgggagaagaaacaggaggaagaacaatgctcaatcagctactcacgaaacgtcgtcgtcaaacaactatggagtccccacttcatagctgttgaagaccatctttttgataacttatctccacatttgtcgactagtcacacacaagaggactggttctggtcttctcaacaaggatgcatcaaaaactccaaacgttgtcgtttgtaaaactacccttctcgttcgttctctcggagcttttttctctctctctctctctactttgttattgaattgttgtctcataagcaagagtctttaacaccattgttatttaatacttgtcctagactcttaattagtcattggttttctcagcatttgattatctatacaacaactttttgtttggtattgaaccaagcatcacatagtgatggcaatatattattgttttcgac

SEQ ID NO: 1726 - DNA, 1110 bp, Raphanus sativus
aacgtgtatgtttgagagatacagaggagagaagaggagacaccaaaaaaaaaaaaaaaaacatttttctcccctctcgtctccaaacttcttctttgatcgtctacgatctcctatcaatccctaatcatccagaagatcattgcctcgagtaatggcgtcgaaaggcaacgatgatttgtatggtgttctgggtttgaagaaggaatgcaccaccacggagcttcgttctgcttacaagaagcttgctcttagatggcatccagatcgttgttcatcaatgggggattcggagtttgtagatgaatcaaagaagaagtttcaggctatccaagaggcttattctgttttgtctgactccaacaagaggttcctctacgacgttggagcttacaatagtgatgatgatgatcatgaccaaaacggaatgggagattttttgaacgagatggctaccatgatgaaccagtcaaagcctagtgagaataactcaggggacagtttcgaacagttacaagatctgtttaatgagatgtttcaaggagacgcttcagcattctcctcgtcttcatcttcttcaactttcacttcctcttgtagctttgcttttgacaccaatgttcagcagtcaccgtttgtgacaaactcgatggggacgaatgatcctttcgcgtttgatcccagagctcatcacaccttctctttaggggtggaacatcagcaggatttcaagaaggggaagaacaatggcgggagaagaaacaggaggaagaacaatgctcagtcaggtgctcacgagacgtcgacttcttcaaacaactatggagtccccacttcatagtctttttgaagaccatctttttttttgctaactcatctccacatttgtcgactagtcacacagaagaggacttgttctggtcttctcaactcaaagcgttgtcgtttgtaaactacccttctcgttggttctctcggagtttttatttctctctctctctctctactctgtgattgaattgttctcctaagcaagagtctttaacagcatctagagattgatgaattcaacgaatacttgtcctaaattcttaattggttttctcaaca

SEQ ID NO: 1727 - DNA, 761 bp, Brassica juncea
ggtaatggcgtcgaagggcaacgatgatttgtatgctgttctgggtttgaagaaggaatgtagcaccgtggaactccgttctgcttacaagaagcttgctcttagatggcatccagatcgttgttcatcaatgggggattcggagtttgtagatgaatcaaagaagaagtttcaggctatccaagaggcctactctgttctgtctgactccaacaagaggttcctctatgacgttggagcttataataatgatgatgatgatcatgaccaaaacggaatgggagacttcttgaacgaaatggctaccatgatgaatcagtcaaagcctagtgagaataattcaggggacagttttgaacagttacaagatctgtttaatgagatgttccaaggagacgcttcagcattctcctcatcatcatcttcttcaactttcacttcctcttgtacctttgtctttgacacaaatgctcagcagtcgccgtttgagacaaactcgatggggattaatgatcctttcgcgtttgatccaagagctcacaccttctctttaggggtggaacatcagcaggatttcaagaaggggaagaacaatggtgggaggagaaacaggaggaagaacaatgctcaatcagctactcacgaaacgtcctcgtcaaacaactatggagtccccacttcataactattgaggaccatctttttgataacttatctccacatttgtcgactagtcacacacaagaggagataaggtatca

SEQ ID NO: 1728 - DNA, 1028 bp, Brassica juncea
  misc_feature (145)..(145): n is a, c, g, or t
  misc_feature (150)..(151): n is a, c, g, or t
  misc_feature (716)..(716): n is a, c, g, or t
  misc_feature (737)..(737): n is a, c, g, or t
  misc_feature (758)..(758): n is a, c, g, or t
  misc_feature (855)..(857): n is a, c, g, or t
  misc_feature (859)..(859): n is a, c, g, or t
  misc_feature (861)..(861): n is a, c, g, or t
  misc_feature (866)..(866): n is a, c, g, or t
  misc_feature (893)..(893): n is a, c, g, or t
  misc_feature (912)..(912): n is a, c, g, or t
  misc_feature (963)..(963): n is a, c, g, or t
  misc_feature (968)..(968): n is a, c, g, or t
  misc_feature (971)..(971): n is a, c, g, or t
  misc_feature (980)..(980): n is a, c, g, or t
  misc_feature (985)..(985): n is a, c, g, or t
tttctttggtagttgaattcatcgaaagaatctatctttttgtgtttttattggttttgattcgtgggtttgaagaaaggaaggtaatggcgtcgaagggcaacgatgatttgtatgctgttctgggtttgaagaaggaatgtancaccnnggaactccgttctgcttacaagaagcttgctcttagatggcatccagatcgttgttcatcaatgggggattcggagtttgtagatgaatcaaagaagaagtttcaggctatccaagaggcctactctgtgctgtctgactccaacaagaggttcctctatgacgttggagcttataatagtgatgatgatgatcatgaccaaaacggaatgggagatttcttgaacgaaatggctaccatgatgaatcagtcaaagcctagtgagaataattcaggggacagttttgaacagttgcaagatctgtttaatgagatgttccaaggagacgcttcagcattctcctcatcttcatcttcttcaactttcacttcctcttgtacctttgtctttgacacaaatgctcagcagtcaccgtttgagacaaactcgatggggattaatgatcctttcgcgtttgatccaagagctcacaccttctctttaggggtggaacatcagcatgatttcaagaaggggaagaacaatggtgggagaagaaacaggaggaagaacaatgctcaatcngctactcacgaaacttcgtcntccaacaactatggagtcccnacttcatagccccttgaggaccatctttttgctaactcatctccacatttgtcgactagtcacacacaagaggactggttctggtcttctcaaacgnnnangnatcanaaactcaaaaagtgttgtcgtttgtanactctttggagcttttctntctctctcttctctactttgtgattgaattcttgtctcctagagattgatnaagtnaanggctttatnatgangacggacgaaaactcttttaatagtcggttggttttctcaaag

SEQ ID NO: 1729 - DNA, 1048 bp, Raphanus sativus
aggggaagaggttctggagagttccattctctctaaaacgtggatgttggagagatacagaggagagaagaggagacaccaaaaaaaaaaaacatttttctcccctctcgtctccaaacttcttctttgatcgtctacgatctcctatcaatccctaatcatccagaagatcattgcctcgagtaatggcgtcgaaagggaacgatgatttgtatggtgttctgggtttgaagaaggaatgcaccaccacggagcttcgttctgcttacaagaagcttgctcttagatggcatccagatcgttgttcatcaatgggggattcggagtttgtagatgaatcaaagaagaagtttcaggctatccaagaggcctattctgttttgtctgactccaacaagaggttcctctatgacgttggagcttacaatagtgatgatgatgatcatgaccaaaacggaatgggagattttttgaacgagatggctaccatgatgaatcagtcaaagcctagtgagaataactcaggagacagttttgaacagttgcaagatctgtttaatgagatgtttcaaggagacgcttcagcattctcctcatcttcatcttcttcaactttcacttcctcttgtagctttgcttttgacactaacgttcagcagtcaccgtttgagacaaactcgatggggatgaatgatcctttcgcgtttgatcccagagctcatcacaccttctctttaggggtggaacatcagcaggatttcaagaaggggaagaacaatggcgtgagaagaaacaggaggaagaacaatgctcaatcaggtgctcacgagacgtcgtcttcaaacaactatggagtccccacttcatagtctttttgaagaccatctttttttttgctaactcatctccacatttgtcgactagtcaaagcgttgttgttttgtaaactacccttctcgttctttctctcggagcttttatttctctctctctctctctactttgtgattgaattgttgtcttcctaagcaagagtcttttaacaaca

SEQ ID NO: 1730 - DNA, 1059 bp, Arabidopsis lyrata
tatacacacaccaaacatcccaagttcgttggctctgtttttgggtgttgaaattcgtcgaaaaaacgagtttttcttcttgggtttctctttttgttgacctagaggagaaagttagccatggcgtccaataatagcgagaaaatcaacgataatttgtacgctgttctgggtttgaagaaggaatgttcgtcgacggagctccgtactgcttataagaaactcgctcttagatggcatccagatcgttgttcatcaatggagtttgtagaagaagcaaagaagaagtttcaggcaattcaagaggcctactctgttctgtctgactccaataagaggttcctgtatgatgttggagcttataatactgatgatgatgaccaaaacggaatgggagattttttgaacgaaatggcgactatgatgaatcaatccaagcctaatgagaataacacaggggacagttttgaacaattacaagatctgtttaatgagatgtttcaaggagaccctgcagcattctcatcatcatcgtcttgctccacttcaacattcacttcctcttgtagttttgtatttgatacaaatgatcagcggtcgtcaccgtttgagacaagttcgatagggattaataatgatcctttccgatatgacctgagagctcattccttctctttaggggtggaccatcagcaagagttcaagaaagggaaaaacaatggcggaagaagaaacaggagaaagaacaatgctagccatgaaacgtcgtcgtcaaacaactatggagtgcccacttcatagccacttcacaccatattttttgctaactcatgtccacatttgtcgactagtcacagacaagatgagtggttgttgtcttctcaacaaggatgcatcgaaactcaaagggtcgtcgttttgtaaactacccacctcctcctctcgaagcttcttctttttgtttctctctgctttattttgttattgaattgttgtctcctaaagatcgatgaaatcagttgctttatgttgatccttctatattcttattagtcattg

SEQ ID NO: 1731 - DNA, 1327 bp, Raphanus sativus
  misc_feature (1284)..(1284): n is a, c, g, or t
  misc_feature (1297)..(1297): n is a, c, g, or t
  misc_feature (1306)..(1306): n is a, c, g, or t
ggaggataaaataaaagaaatcttaagacaaggggtaagaggttctggagagttccattctctctaaaacgtgtatgtttgagagatacagaggagagaagaggagacaccaaaaaaaaaaaaaacatttttctcccctctcgtctccaaacttcttctttgatcgtctacgatctcctatcaatccctaatcatccagaagatcattgcctcgagtccgttgaatccactatagtaccaaagttcttatagatattgaactgtggctctgttttttttggtagttgaattcatcgaaagaatatatatatttttttttgtcttcttgtaaggtaatggcgtcgaaaggcaacgatgatttgtatggtgttctgggtttgaagaaggaatgcaccaccacggagcttcgttctgcttacaagaagcttgctcttagatggcatccagatcgttgttcatcaatgggggattcggagtttgtagatgaatcaaagaagaagtttcaggctatccaagaggcctattctgttttgtctgactccaacaagaggttcctctatgacgttggagcttacaatagtgatgatgatgatcatgaccaaaacggaatgggagattttttgaacgagatggctaccatgatgaaccagtcaaagcctagtgagaataactcaggagacagttttgaacagttacaagatctgttcaatgagatgtttcaaggagacgcttcagcattctcctcatcttcatcttcttcaactttcacttcctcttgtagctttgctttcgacactaatgttcagaagtcaccgtttgagacaaactcgagggggatgaatgatcctttcgcgtttgatcccagagctcatcacaccttctctttaggggtggaacatcagcaggatttcaagaaggggaagaacaatggcgtgagaagaaacaggaggaagagcaatgctcagtcaggtgctcacgagacgtcttcttcaaacaactacggagtccccacttcatagtcttttcgaagaccatcttttttttttgctaactcatctccacatttgtcgactagtcacacagaagaggacttgttctggtcttctcaactcaaagcgttgtcgtttgtaaactacccttctcgttggttctctcggagtttttatttctctctctctctctctctctctctctactctgtgattgaattgttctcctaagcaagagtctttaacagcatctagagattgatgaattcaacgaatacttgtcctaaattcttanttggttttctcancatttgatnatctctctatacacattacca

SEQ ID NO: 1732 - DNA, 1102 bp, Raphanus sativus
  misc_feature (100)..(100): n is a, c, g, or t
  misc_feature (344)..(344): n is a, c, g, or t
  misc_feature (630)..(630): n is a, c, g, or t
  misc_feature (636)..(636): n is a, c, g, or t
  misc_feature (646)..(646): n is a, c, g, or t
  misc_feature (671)..(671): n is a, c, g, or t
  misc_feature (791)..(792): n is a, c, g, or t
ggttctggagagttccattctctctaaaacgtgtatgtttgagagatacagaggagagaagaggagacaccaaaaaaaaaaaacatttttctcccctctngtctccaaacttcttctttgatcgtctacgatctcttatcaatccctactcatccagaagatcattgcctcgagtatggcatcgaaagggaacgatgatttgtatggtgttctgggtttgaagaaggaatgcaccaccaccgagctccgttctgcttacaagaagcttgctcttagatggcatccagatcgttgttcatcaatggggattcggagtttgtagatgaatcaaagaagaagtttcnggctatccaagaggcctattctgttttgtctgactccaacaagaggttcctctatgacgttggagcttacaatagtgatgatgatgatcatgaccaaaacggaatgggagattttttgaacgagatggctaccatgatgaaccagtcaaagcctagtgagaataactcaggagacagttttgaacagttacaagatctgttcaatgagatgtttcaaggagacgcttcagcattctcctcatcttcatcttcttcaactttcacttcctcttgtagctttgctttngacacnaatgttcagnagtcaccgtttgagacaaactcganggggatgaatgatcctttcgcgtttgatcccagagctcatcacaccttctctttaggggtggaacatcagcaggatttcaagaaggggaagaacaatggcgggagaagaaacaggaggannaacaatgctcagtcaggtgctcacgagacgtcttcttcaaacaactatggagtccccacttcatagtcctttgaagaccatcttttttttgctaactcatccccacatttgtcgactagtcacatagaagaggactggttctggtcttctcaactcaaagcgttgtctttttgtaaactacccttctcgttctttctctcggagcttttatttttctctctttctctctactttgtgattgaattgttgtctcctaagcaagagtccttaacaacatctagagattgatgaattcaacgaatacttgtcc

SEQ ID NO: 1733 - DNA, 1136 bp, Brassica napus
ggttcttccctctttcggtttcgaaattagggtttccctctgtgctctcctttaatcaccagtttggaagatgcctaggtatgatgatcgttacgggaacactcgtctgtacgttggacacttatcatccagaactcgtaccagagaccttgaacgccttttcaacagatacggaagagtgcgagatgtggatatgaagcgggattatgcctttgttgaatttagtgatcctcgtgatgctgatgatgcgaggcattacttggatggacgagactttgatgggagtcgcatcacagtggagttttcaagaggggcacctcgtggctctcgggattatgacagcagaggcccacctcctggatcaggtcgctgctttaactgtggtcttgacggtcattgggctcgagactgcactgcaggagactggaagaacaagtgttaccgctgtggtgaaagaggacacatcgagagaaactgcaaaaacagtcccaagaagcttaggcggagtggaagctactccaggtcacctgtaagatcccgttctcctcgtcgtagaagaagcccaagccgtagcaggagtcttagccgtagccgaagctacagccgctcaagatcccctgtgaaaagaagagagagaagtgcagaggagagatctcgcagtccaaaaagaatggaggactctctatcgccaagaggcagagaccgtagtccgattatagatgatgaaggtagcccaaggatcatagacgggagccctccaccttctccaaagcttgaaaagccagcaggatcagaccatgatggtggtagcagccctcaagacaatggtaatggaagaaacactgttgccagtcctgctgtgggacgcagtgccgacagtccgagagaagaccggagccccgttgatgatgattacgaggccaaccgtgcttcacctagaggaagcgagtctccttgactttgatggctcatggcctcagggttactggtgctctagcatgttgtactattgaatcagactgccccagatatttcctttctcttttatgtatgtttgctttggatcttcttaagttcatgttgtcaggagttctttttaccctgttgagatgatggttaaacttgtaagacataaa

SEQ ID NO: 1734 - DNA, 1156 bp, Brassica napus
ggttcttccctctttcggtttcgaaattagggtttccctctgtgctctcctttaatcaccagtttggaagatgcctaggtatgatgatcgttacgggaacactcgtctgtacgttggacacttatcatccagaactcgtaccagagaccttgaacgccttttcaacagatacggaagagtgcgagatgtggatatgaagcgggattatgcctttgttgaatttagtgatcctcgtgatgctgatgatgcgaggcattacttggatggacgagactttgatgggagtcgcatcacagtggagttttcaagaggggcacctcgtggctctcgggattatgacagcagaggcccacctcctggatcaggtcgctgctttaactgtggtcttgacggtcattgggctcgagactgcactgcaggagactggaagaacaagtgttaccgctgtggtgaaagaggacacatcgagagaaactgcaaaaacagtcccaagaagcttaggcggagtggaagctactccaggtcacctgtaagatcccgttctcctcgtcgtagaagaagcccaagccgtagcaggagtcttagccgtagccgaagctacagccgctcaagatcccctgtgaaaagaagagagagaagtgcagaggagagatctcgcagtccaaaaagaatggaggactctctatcgccaagaggcagagaccgtagtccgattatagatgatgaaggtagcccaaggatcatagacgggagccctccaccttctccaaagcttgaaaagccagcaggatcagaccatgatggtggtagcagccctcaagacaatggtaatggaagaaacactgttgccagtcctgctgtgggacgcagtgccgacagtccgagagaagaccggagccccgttgatgatgattacgaggccaaccgtgcttcacctagaggaagcgagtctccttgactttgatggctcatggcctcagggttactggtgctctagcatgttgtactattgaatcagactgccccagatatttcctttctcttttatgtatgtttgctttggatcttcttaagttcatgttgtcaggagttccttttaccctgttgagatgatggttaaacttgtaagacataaaatggttagcttttcattttc

SEQ ID NO: 1735 - DNA, 1159 bp, Brassica rapa
  misc_feature (907)..(907): n is a, c, g, or t
  misc_feature (1124)..(1124): n is a, c, g, or t
  misc_feature (1142)..(1142): n is a, c, g, or t
ctttcggtttcgaaattagggtttccctctgtgctctcctttaatccccagtttggaagatgcctaggtatgatgatcgttacgggaacactcgtctgtacgttggacacttatcatccagaactcgtaccagagaccttgagcgtcttttcaacagatacggaagagtgcgagatgtggatatgaagcgggattatgcttttgttgagtttagtgatccccgtgatgctgatgacgcgagacattacttggatggaagagactttgacggaagtcgcatcacagtggagttttcaagaggggcacctcgtggctctcgggattatgacagcagaggcccacctcctggatcaggtcgctgctttaactgtggtcttgacggtcattgggctcgagactgcactgcaggagactggaagaacaagtgttaccgctgtggtgaaagaggacacattgagagaaactgcaaaaacagtcccaagaagcttaggcggagtggaagctactccaggtcacctgtaagatcccgttctcctcgtcgtagaagaagcccaagccgtagcaggagccttagccgtagccgaagctacagccgatcaagatcccctgtgaaaagaagagagagaagtgtagaggagagatctcgcagtccgaagagaatggaggactctctatcgccaagaggcagagaccgtagtccgattatggatgatgaaggtagcccaaggatcatagacgggagccctccaccttctccaaagcttgaaaagccagcaggatcagaccatgatggtggtagcagccctcaagacaatggtaatggaagaaacactgttgccagtcctgctgtgggacgcagtgccgacagtccgagagaagaccggagccccgttgatgatgattacgnggccaaccgtgcttcacctagaggaagcgagtctccttgactttgatggctcatggcctcagggttgcaggtgctctagcatgttgtactattgaatgagactgccccagatatttcctttctcttttatgtatgtttgcgttggatcttcttaagttcatgttgtcagaagttctttctttttaccctgttgagatgatggttaaacttgtaaganataaaatggttggctttncattttcagacattttt

SEQ ID NO: 1736 - DNA, 812 bp, Brassica rapa
ggttcttccccctttcggtttcgaaattagggtttccctctgtgctctcctttaatccccagtttggaagatgcctaggtatgatgatcgttacgggaacactcgtctgtacgttggacacttatcatccagaactcgtaccagagaccttgaacgccttttcaacagatacggaagagtgcgagatgtggatatgaagcgggattatgcctttgttgaatttagtgatcctcgtgatgctgatgatgcgagacattacttggatggacgagactttgatgggagtcgcatcacagtggagttttcaagaggggcacctcgtggctctcgggattatgacagcagaggcccacctcctggatcaggtcgctgctttaactgtggtcttgacggtcattgggctcgagactgcactgcaggagactggaagaacaagtgttaccgctgtggtgaaagaggacacattgagagaaactgcaaaaacagtcccaagaagctcaggcggagtggaagctactccaggtcacctgtaagatcccgttctcctcgtcgtagaagaagcccaagccgtagcaggagccttagccgtagccgaagctacagccgctcaagatcccctgtgaaaagaagagagagaagtgcagaggagagatctcgcagtccaaagagaatggaggactctctatcgccaagaggcagagaccgtagtccgattatggatgatgaaggtagcccaaggatcatagacgggacccctccaccttctccaaagcttgaaaagccagcaggatcagaccatgatggtggtagca

SEQ ID NO: 1737 - DNA, 4501 bp, Glycine max
aggttgcatggtaatgttgaaaccatggctgttttgagcattggaggtggtgatgtttctaggaagagagattctatcatcttaactttcgcagatgcaaagatttcagttcttgagtatgatgattctattcacggacttcgtactagttctttgcattgttttgagggtccagaatggcttcatctgaaaagaggaagagaacaatttgcaagaggaccagtggtaaagattgatcctcaaggcaggtgtggtggagttcttatctatgatttgcaaatgataatactaaaggctactcaggttggttctggtttagttggggatgatgatgcctttggatcttcaggagcagttgctgctcgtattgagtcatcttatatgataaacctacgtgacttggatatgaggcatgtaaaagattttacgtttgtttatggctatattgaacctgtaatggtgattttgcatgaacgtgagctcacttgggctgggcgtgtctcatggacgcatcacacttgcatgatatcagcacttagtatcagcacaactttgaagcagcatccacttatttggtcagctgttaatcttccccatgatgcatacaagcttcttgcggtgccatcgccaataggtggcgttcttgtaattggtgctaacactattcattatcacagtcagtctgcttcttgtgcattggccttgaacaactatgctgttacacttgacagtagtcaagagataccaagatcaagtttcaatgttgagcttgatgctgccaatgcaacttggttgttgagtgatgtggccttgctgtcaacaaaaactggcgaactgctattgcttatgcttgtttatgatggaagggttgtacagagacttgatctttccaagtcaaaagcttcagttctgtcatctggtattacaacaattggaaattctctgtttttcctcgccagtcggttaggggacagtatgctggtgcaattttcttgtggatcaggtgtttccatgatgtcatccaatctaaaagaagaggttggtgatattgaagtagatgctccatcaaagagattgcggaggtcaccttctgatgctttgcaagatatggttagtggtgaggagctctccttgtatgggtctgctacaaatagaacagaatcagcacagaaatccttctcgtttgcagtgagggattcattgattaacgttggtcctttgaaagatttctcatatggtttaagaataaatgctgatgcaaatgctacagggatagccaaacagagtaactatgaattggtgtgctgttctggtcatggaaagaatggttctctgtgtgttctgcggcaatcaattcgcccagaagtgattactgaggttgaacttcctggttgcaaaggaatttggactgtgtatcataagagcacacgttctcataatgctgattcttctaagatggctgatgacgacgatgagtatcatgcttaccttattattagcttggaggctcgaactatggtactagaaactgctgatcttcttagtgaggttactgaaagtgtggactattatgttcaaggaaaaacacttgctgcagggaatttatttggaaggcgtcgagttatccaagtctatgaacgtggtgctcgaattctagatggttcttttatgacccaagacgtaagctttggagcttctaactcagaatctggttctgcatctgagagtgctatagcactttctgtttctatagctgatccatttgtcttactcagaatgagtgatggaagtattcgacttctgattggagatcctagtacctgcactatttctgtcacttctccagcttcatttgagagctccaagggatcagtttcttcatgtacactgtaccatgataaaggacccgagccttggctgaggaaaacaagtactgatgcatggctttctactggtgttggtgaggctattgatggcactgatggtgctgctcaggaccatggggatatttattgtgttgtttgttttgataatggtaaccttgaaatatttgatatccccaatttcaattgtgtcttttctgtggaaaattttatgtctggaaagagccatcttgttgatgctctgatgaaagaggtactaaaagattctaaacaaggggatcgggatggagtggtcaaccaagggaggaaggataatataccgaatatgaaggttgtagagttggccatgcagagatggtctgggcagcatagccgtccatttctttttgggattttgagtgatggaactattctttgttaccatgcttacctttatgaaagtccagatggtacttctaaagttgaggattccgcatcagctggaggatccattggccttagtagtaccaatgtttccaggcttagaaatttgagatttgttcgtgtgcccttggatgcatatcccagggaggatacctcaaatggatcaccttgtcaacaaattactattttcaagaatattggtagttatcagggattcttcctatcagggtcaagaccagcatgggttatggtgttgagggaacgacttcgtgttcatccacagctatgtgatggatctattgttgcttttaccgtccttcacaacgtgaactgcaatcatggacttatatatgttacatcacagggtgttttgaagatatgtcagttgccttctggctcaaactatgacagctactggcctgtacaaaaaattccactaaaagccacaccacaccaagtaacatactttgcggagaagaacttatatccacttattgtctcattccctgttcttaagccactaaatcaagttatttctctggttgaccaagatttcaaccatcaaaatgagagtcagaatatgaatcctgatgagcaaaaccgcttttatcctattgatgaatttgaggttcgtattatggagccagaaaagtctggtggcccttggcaaacaaaggcaacaatacctatgcaaagttctgaaaatgcccttactgtgaggatggttactttactgaatacaacctcaaaagaaaatgaaacacttttagccattggtactgcttatgtgcaaggagaggatgttgctgcaagaggacgtatcctcttgttctctttggggaaaattactgataatccacaaactctggtttcagaggtgtactctaaggaattaaaaggtgctatatctgccttggcctcacttcaaggccatctattaatagcatctggtccaaaaattattctgcacaagtggaatggcactgagttgaatggtattgcattttttgacgcaccgccattacatgttgtgagcttaaacattgtaaagaacttcatccttattggcgatatccataaaagcatatactttcttagttggaaagagcagggtgctcaattgagcttattagccaaggattttggttctctcgattgttttgcgacggaatttttgattgatggaagtactcttagtctcatggtttcagatgataatagaaacatccagattttttactatgcaccaaagatgtctgagagttggaaaggacagaagcttctttcaagagctgaatttcatgttggtgcccatgtgactaaattcttaaggttgcaaatgctatccacttcggatagagctggttcagttccaggctcagataaaaccaatcgttttgccttattatttggtaccttggatggaagtattggttgcattgcacctcttgatgaaatcacatttcgcagactgcagtctttgcagagaaaacttgttgatgctgtaccccatgttgctggcctgaaccccagagctttcagattatttcggtcaaatggaaaggcccatcggccaggccctgacagtatagttgattgcgagctgctatgccattatgaaatgcttccattggaggaacagcttgaaattgctaaccagattggaacaactcgatcacaaattctgtcaaatctaagcgatctgtctcttggaacaagcttcttgtgaacagtcatcttttgtagatcagggaacagtgctgcccatgtttcccaagctcttggcagttatttattttgatgcaatggcatcttattatcacaattaaatgctccactatgttgaaggcttgggtaactgatgagatcgtagcctaactctcttacggcccttggaaacagtgaatgcagacaaactatggatagtgatatctaaaattgattccaatgtatgtttcattggaagtaggggtgtctgtttaatgctctaatggacgaggtggatgtaacatgaattttgttcatctaaagaaacaagtaggaaacttaaccccactagaaagcccggcccggacattctttcttttctgtatgtcagcatcaagaagtttctgtaacttgtaattattattacttaatacttttgttcgctccataatatgatggtttagtttcaaatggtatttaaatttgtc

SEQ ID NO: 1738 - DNA, 2014 bp, Quercus alba
acgagtgcgttggtttatggtattcagagaacggcttcgagttcatccacagctttgtgatggatctatagttgccttcactgttcttcacaatgtgaattgcaatcatgggctcatatacgttacatcacagggtattttgaaaatttgccaactgccatcagtatcaagctatgacaactattggccagtacaaaagattccactaaaaggcactccgcatcaggtcacttacctcgctgagaagaatttataccctcttatagtttcagttcctgttcataagtcattgaatcaagttctttcaactctggttgatcaagaagttggccatcaggtcgaaaatcttaatttgggttctgatgaactgcaccaaacttacactttagatgaattcgaggtccgcattctggaaccagaaaagtctggtggcccttggcaaactaaagctacaattccaatgcagagttctgaaaatgctctaaccgtgcgagtggttaccctgttgaatacaaccactaaagagaatgaaacacttttggccattgggactggttatgtgcaaggggaagatgttgctgcaagaggacgtgtgcttttattttctgttgggaaaaatactgataatcctcaaaacttggtttcagaggtttactcaaaggaattgaagggtgctatatctgctttagcctctcttcaaggccatctgttgatagcttctggtcctaaaattattttacacaagtggactggtactgagttgaatggcgttgctttttttgatgctcctccattatatgtcgtcagcttaaatattgtcaagaattttatcctcctcggtgacattcacaaaagcatatactttcttagctggaaggaacaaggagctcaacttagcttattagctaaggattttggctcccttgattgttttgcaaccgagtttttaattgatggaagtaccttgagcctcacagtttcagatgatcagaagaacattcagatattttattatgcaccaaagatgtcagagagttggaagggacagaagcttctttcaagggctgagttccatgttggtgctcatgtgactaagttcttgcggttgcagatgctttctgcttcatctgatcgaactggtgcagctccaggctcagataaaaccaatcgctttgctttattatttggtaccctggatggcagcattggttgtattgcacctcttgatgagctcacatttcgtaggctacagtcattacaaagaaaacttgttgacgctgttgcccatgttgctggcctaaatccaaaatctttccgccagtttcgctcaaatggaaaggctcatcggcctggccctgatagcatagttgactgtgagctgctatgccattatgagatgcttccattggaggaacagcttgaaatcgccaatcagattggaacaactcgttcacaaattctctcaaatttgactgacctctctttgggaacgagcttcttgtgatttcagccaatctgaaggggttatgggagtaaggattcccttgaatgcttgggcagcctgaattaaacactttgtaatattcagccatgttcattacagcaattgcatggccatttttaatggctcagttgaatcagcctcatctgtagttaacaatggagaaaaaggagggagcaaggcagccaaaaaggttgttgcttcattgttatgcatcaaatatgatatgctgttgaattgatgctccaagcatagactgggcactagtttcacataacgagaattgtcgcttaaaaatgttttaacattgaagtgaggagattgggaggggaaaggaagaaatataagttgcttaattatgtagcattaaaccgtcaaatgccaatgttgtacattgtagaagggtgaaggaagcaaaagacagttgcttcattgttgtacattaatgtggtatataccattcaactcttgtcacaaccaatgattggacattgtttccattaatgagaactg

SEQ ID NO: 1739 - DNA, 1704 bp, Gossypium hirsutum
gtattctgaagatctgccaaaatgccatctacatcgaactatgacaactattggcctgtgcaaaagattccactgaggggcactccacatcaagttacttactttgctgagaggaatctgtacccacttatagtttcagttcctgttcataagccagttaatcaagtgctatcatcattggttgatcaagaagctggccatcagatggacaatcttaatttaagttctgatgaattgcaccgaacttatactgtggaggagtttgaggttcggattttggaacctgaaaaatctggcggtccttgggaaactaaggcaactattccaatgcagagttctgaaaatgctctaactgtgagagtggtcactttgtttaataccaccacaaaagagaatgaaacccttttggctattgggactgcttacgttcaaggagaggatgttgcagcacgaggacgcgtgcttttgttttctattggaaggagcactgataataatcagaatctggtttcagaggtctattcaaaggaactaaaaggtgctatatctgctttagcctcccttcaaggtcatctcttgatagcttctggtcctaaaattattctacatatttggactggtagtgagttgaatggcattgcattttatgatgctccaccattatatgttgtgagcttaaatattgtcaagaatttcattctacttggtgatgttcacaagagcatatatttccttagttggaaggaacagggtgctcaacttagcttattggccaaggattttggctcccttgattgttttgcaacagaatttttgattgatggaagtaccttagtcttatggtttctgatgatcaaaagaatattcaggtattttattatgcaccaaagatgtctgaaagttggaggggacagaagcttctttcaagggctgaattccatgttggtgcccatgtaactaagttcttgcggctccagatgctttctacttctggtcgaactagtgccactgctggctctgataaaaccaatcgatttgctttgttatttggtactctggatggcagcattggctgtatagctcctcttgatgaacttacatttcgtaggttgcagtctctacagaaaaagcttgttgatgctgttccacatgtagctggtttaaacccaagatcttttcgccattttcgttcaaatggaaaggctcataggcctggtcctgacagcatagttgattgtgaactgctttgccattatgaaatgcttccattggaggaacaacttgaaattgctcatcagattggaacgacccgttcccaaattttgtctaatttaaatgatcttactttgggaacaagcttcttgtaaagcagcagatatcaaggcaggtaggttatggaaaatatttaacaacttgtacggaacaattcatgaggagcgatgcctgttgtaggatgaatgacagcatttaaaagcttattcagatcaggtttggtgtctttagttcatatgatattgagaaaggaaaacaaatgttgtatagtggattgtgttttatctgtatggtgtagaatcttgtatcttggagctagtaaacaggactataatagcagcgcagtaaatttctgtaatcttttgttagaagccactgcggctgtaaactgctgattgcttttgaacttgtgtagctgattaaatgaatgtc

SEQ ID NO: 1740 - DNA, 2411 bp, Citrus sinensis
  misc_feature (10)..(10): n is a, c, g, or t
  misc_feature (927)..(927): n is a, c, g, or t
  misc_feature (947)..(947): n is a, c, g, or t
  misc_feature (1028)..(1028): n is a, c, g, or t
  misc_feature (1230)..(1230): n is a, c, g, or t
  misc_feature (1255)..(1255): n is a, c, g, or t
ggtgccttanaatattcgatgtgccaaattttaattgtctttttactgtggataaatttgtgtctggaaggactcacattgttgatacctatatgcgggaagctctgaaagattctgagacagagattaacagtagttctgaagagggaactggccaaggaaggaaagaaaatatccatagcatgaaggttgttgagttagccatgcaaaggtggtctggacatcatagtcgtccatttctttttgccatattaaccgatgggacaatcctttgttaccaagcttacctgtttgaaggttcagagaatacttctaagagtgatgatcctgtctctacctcacgttctctcagtgttagcaatgttagtgcttctaggcttaggaatctgagattttctcgcaccccactggatgcatacacaagggaggagacacctcatggagccccatgccaaagaattaccattttcaaaaatattagtggtcatcaaggattttttctttctgggtcaagaccatgttggtgtatggttttcagagagcggcttcgagttcatccacagctatgtgatggatctatcgtggccttcactgttcttcataatgtgaattgtaatcatggtttcatatatgttacatctcagggcattttaaagatctgccaattgccatctggatcaacttatgacaactattggccagtgcaaaaagtgattccattgaaagccactccacatcaaatcacttactttgctgagaagaatttgtaccctctaattgtttcagttcctgttcttaagcccctaaatcaagttctttcattgctgattgaccaagaagttggccatcagattgacaatcacaatttaagttctgttgatctccatcgaacttacactgtagaggagtatgaggttcgaattctanaacctgatagggctggtggnccttggcaaacaagggctacaatcccaatgcaaagttctgaaaatgcgctaactgtgcgagtggtcacactgtttaacacnaccacgaaagagaatgacacactgttggctattggaactgcttatgtccaaggggaggatgttgctgcaagaggacgtgtacttttgttttctactggaagaaatgctgataatcctcagaatttggtaacagaggtttattcaaaggaattgaagggtgctatatctgctttagcctctcttcaaggtcatctgttaatancttctggtccaaaaattattctacncaagtggactggtactgagttgaatggaatcgctttctatgatgctccaccattatatgttgtgagcttaaatattgtcaagaattttatcctccttggtgacattcataaaagcatatacttccttagttggaaggaacaaggagctcaacttaacttattggccaaagattttggctctcttgattgttttgcaacagagtttttgatagatggaagcacactgagtctcgtggtttcagatgagcaaaagaatattcagattttctattatgcaccaaagatgtctgagagttggaagggacaaaagcttctttcaagggctgaatttcatgttggtgctcatgttacaaaattcttgcggctgcagatgcttgcaacttcatctgatcgaactggtgctgctccgggatctgataaaacaaatcgctttgctttgttgtttggtaccctggatggcagtattggttgtattgcacctcttgatgaacttacattccgtaggttgcagtcccttcagaaaaagcttgtcgattccgttccccatgttgctggcttaaatccaagatctttccgccagttccattcaaatggaaaggctcatcggcctggtcctgacagcattgttgactgtgaactgcttagccattatgagatgcttccattggaggaacaacttgaaattgctcaccagactggaacaactcgttcacaaattctttcaaatttaaatgaccttgctctaggaactagcttcttgtgagtgtagcttatgtctgaaaggagcttctgaggatctctgaaaagcaatgcacaaaatgtttggccaagttacaattccactctctggtctaacaatcgcgtgcatgattgtacgatcacagtgtttgtgtttgcttcattgtttttagtctgactatgatagccgatggggtagtcttgttaagtgctggggactagagactagattcatgtaaagtggtctgccaatttccataatttttcttaacatgttgtattaacatcgtaaagaaacaatatcaaccttgctatttgctactcatcttactttcaactttcataaactaatgtttgatagaaaaacaatcagaaacaaccttgtagcagttgcttcaaggacttactgtttttccca

SEQ ID NO: 1741 - DNA, 4587 bp, Manihot esculenta
gcttattcatttcctcccgccaaacacagactcaggccttgaactctatcttcagttcttcactctcccaaaagctctactctcctctttctctctactctaaccatcttctacttttctttggttctctattttctccactctcccctattccctcttgttccagtttcaaaccctagaatcccaaatcatcgccacaatgagctttgcggcctacaagatgatgcactggcccaccggcatcgagaactgtgcctccggcttcatcactcattgtcgcgcggaccttgcccctcaagttccttctatgcagtccgacgatctcgagtctgaatggccggcgaagcgaggaataggtcccgttcccaacctcattgtcaccgccggtaatgttcttgaagtttatgtgattagagttcaagaagagggcactagagaatcccgaaattctcgcgaaccgaagcggggaggggtaatggatggggtctctggtgcttcgctcgagcttgtttgccactacaggttgcatggtaacgtggagtcaatggctgtactgcctatagaaggtggcgatggttctagaagaagagactctattatcttgtcatttaaagatgcaaagatttcagttcttgagtttgatgattcaatacatggactccgtactagttctatgcactgttttgaaggtccagagtggcttcatttgaaaagaggtagagaatcttttgcaagaggcccatctgtaaaggttgatcctcaaggcagatgtggtggtgttcttgtttatgatctacagatgataatacttaaggctgcccaggctgctgctggtttggttggagatgatgatgctcttggttctggaggtgctatctctactcgagtccaatcatcttacattatcaatctacgagatctggacatgaagcatgtaaaagattttatatttgtacatgaatatattgagcctgtggtggttatccttcacgagcgcgagcttacttgggctgggcgtgtctcatggaagcatcatacttgtatgatttctgctcttagtatcagcacaactttgaagcagcctaccctcatatggtcagttgtgaatcttccacatgatgcttacaagttgcttgcagtgccatcaccaattggtggtgttcttgttatttgtacaaacaccatccactatcacagcgagtcagccacttgtgcattgtccctgaacaactatgctgtttctattgatagcagtcaagagttgccaagagcaagtttcagtgttgaacttgatgctgcaaaggcaacttggttatcaaatgatgttgccttgctgtcaacaaaaaatggggaacttttgttactgacccttgtttatgatggaagggttgtgcagaggcttgatctttccaagtctagagcatcagttcttacttcggacattactacaattgggagttcattattttttctgggcagtcgtctgggagacagtttgcttgtgcagtttacttatggtttgggatcttcaatgatttcatctggtttaaaggaagaggttggagatattgaaggtgatgtacctactgcaaagcgattgaagaggtcaccttcggatggtttgcaagatatggttagtggggaggagctttctttgtatggttcgactggcaacaatacagaatcaacgcagaaaactttctcatttgctgtgagggattcactgatcaatgttggtcctttgaaagacttatcctatggtttaagggttaacgctgatgcaaatgcatctggaattgctaaacaaagcaactatgaactggtatgctgctctgggcatggaaaaaatggtgctctctgtgttcttcggcagtcaattcgcccagaaatgattacagaggttgaccttcctggctgtagaggaatttggactgtttaccataaaactgcacgtggccatagtgttgatacatctagaatggctgcagttgatgatgaatatcatgcatatttgatcataagcatggagaatcgcactatggtgcttgaaactgctgatcatttgacagaagtcactgaaagtgtggactacttcgtacaaggacgaacaattgctgcaggcaatttgtttggaaggcgtcgagttgtccaagtctatgaacgcggtgctcgaattctagatggttcttttatgacccaggatttaagctttggagcctcaaactctgaatctggttctggttctgacagttcaacagttttgtccgtttctattgcagatccatatgtgttaatcagaatgactgatgggagtattcggcttcttgttggagatccttctacttgcatggtttccataaatactccatctgcctttgaaaactcgaagaaatcaatatctgcctgcacactttatcatgataaaggaccagagccttggctccgaaaggcgagtacagatgcatggctttctactggcattagcgaggccatagatggtgctgatggtggcccacatgatcaaggagatatatattgtattctttgttatgcaactggtgcacttgaaatatttgatgtgcccaatttcaattctgtgttctcagttgataaatttgtctctggaaaaaaccatcttgttgatacgtatgtgcgggaaacatccaaagattcacagcaaaacaaaacttctgaagaagtggctggcctaggcaggaaagaaagtactcataacatgaaggttgtggagttggctatgcagatatcacctggccaacactgtcgcccatttctttttggtatattgtcagatgggacaatcctttgttaccatgcttacctgtttgaagttccagatggtacttctaaaatagaggattctatttctacacaaaattctgttggcccaggcgtcattagttcttcaaggcttcgaaatttgcgatttgttcgtgtccccttggatagttacacaagggaggaaacaccaagtgagagctcatgccaaaggattaccattttcaagaacatcaatggttatcaagggtttttcctctctggatcgagaccagcttggtttatggtgtttagagagcgaatacgagttcatccacagttatgtgatggctctattgttgcattcactgttcttcacaatgtgaattgcaatcatgggtttatttatgttacttctcagggcaatttgaagatttgtcaactgccatctgtctcaagttatgacaactattggccagtgcaaaaggttccactgaagggaacaccacatcaagtgacctattttgcagagaagaacttatacccacttatagtttctgttcctgttcacaagccagtgaatcaagttctctcatcactggttgatcaagaagttagccatcagattgagaatcataatttaagttctgatgaactacatcgaacctatagtgtagaagaatttgaggttcggatcttggaaccagagagatctggtggcccttggcaaactaaggcgacaatcccaatgcaaagttctgaaagtgcacttactgtgcgagtagttacactgtttaacacaaccacaaaggagaatgaaacgcttttagccattgggactgcttatgtgcaaggggaggatgttgcagcaagagggcgtgtgcttctgttttctgttgggaaaaatccagataattcccaagttttggtttcagaagtctattctaaggaattgaaaggtgctatatctgctttggcctcgctacaaggtcatctgttgatagcttctggtcctaaaattattttacacaagtggactggtacagagttgaatggtgttgctttttttgatgctccaccattatatgttgtgagcttaaatattgttaagaattttatcctcctgggtgatgttcacaaaagcatatactttcttagttggaaggagcagggagctcaacttagcttattggcaaaggattttggttcacttgattgtttcgcaacagagtttttgattgatggaagtacacttagccttgtggtgtcagacgaacaaaagaatgctcagatattctattatgcaccaaagatgtcagagagctggaaaggacagaaactgctttcaagggctgaatttcatgttggtgcccatgtgactaagttcatacgtttacaaatgctttctacatctgaccgaagcggtactgcaccgggctctgataagaccaatcgctttgctttattgtttggtactcttgatggcagcataggctgtattgcccctctcgatgagctcactttccggaggttgcaatcactacagaaaaaattggtcgatgctgttccccatgttgctggtctaaacccaagatcattccgccagtttcgggaaaatggaagggttcaccggcctggcccagaaagcatagtagactgtgagctgctttctcattatgagatgcttccattggaagaacaacttgagattgctcagcaggttggaacaacccgtgcacaaattttatcaaatttgaatgacctttctctggggacaagtttttcgtgattccagctgatctaccagcaatt

SEQ ID NO: 1742 - DNA, 4394 bp, Prunus persica
ccttctccgaaaatgagcttcgcggcatacaagatgatgcactggccgacgggcattgagaactgtgcatcggggttcatctctcactcacgctccgacttcgtgcctcgaattcctccgattcagacggaggacctcgagtctgaatggcccacctcgcgccgagaaatcggccccattccagacctcgtcgtcaccgccgggaatgtccttgaagtgtacgtcgtcagagttcaagaggaagatggcaccagaggccctagggcttcaggagaacccaaacgtggtggtctcatggacggcgtctctggggcttcgcttgagctcgtttgccattacagattgcacggtaatgtggtaacaatggcggtattatctagtggaggtggagatggttccagaagaagagattctattattttaacctttgaagatgcgaaaatttcagttctagagtttgatgattcaattcatggacttcgtactagctctatgcactgttttgagggcccagagtggcttcatttgagaagaggtagagagtcatttgcaagaggcccattggttaaggttgatcctcaaggaaggtgtggaagcattcttgtttatggtctgcaaatgataatacttaaagcttctcagggtggctctggtttggttggagatgatgatagttttggttctggaggtgcaatttcttctcgtattgagtcatcttacattgttaatctacgagatatggacatgaagcatgtaaaggattttacatttttacatggttatatcgagcctgtgatggttatccttcatgagcgggagcttacctgggctgggcgtgtctcatggaagcaccacacttgtatgatttctgcacttagtatcagcacaactttgaagcagcatcctctcatatggtcagctgttaatctcccacatgatgcctacaagctacttgctgtaccatctccaattggtggtgttcttgtgattagtgcaaattctattcattaccatagccagtcagcctcatgtgcgttggcattgaacagttacgctgtttctgctgataacagtcaagagatgccaagatctagtttcaccgtggagcttgacactgccaatgcaacttggttattgaacgatgtagccttgctgtctacaaaaactggagagctactattgcttacccttgtttatgatggacgggttgtgcagagacttgacctttcaaagtctaaagcttcagtacttacgtcgggtattacgaaagttggaaattcgttattttttctgggcagtcggttgggggacagtttgcttgtgcagttcacttgtggtgtagggggctcagtgttgtcatctgatatgaaggatgaggtaggagatattgaaggtgatgccccattggcaaagcgattgcgaatgtcatcttctgatgcattgcaagatatggttagtggcgaggagctctctttgtatgggtcagctccaaataatgcagaatcagctcagaagtctttttcatttgctgtaagggactctttgattaatgttggtcctttgaaggacttctcctatggtttaaggattaatgcagatgcaaatgctactggaattgctaaacagagtaattacgaactggtgtgctgttcgggtcatggaaagaatggtgctctctgtgttcttcgtcaatcaattcgtccagaaatgattactgaggttgaactaccaggctgcaagggaatttggactgtttaccacaagaatgcacgtggtcataatgctgactcttctaaaattgctgcttctgatgacgagtttcatgcatatttaattataagtctggaggctcgtacaatggtacttgaaacagctgatcttctgagtgaagtcacagaaagtgtcgactatttcgtgcaagggagaacaattgctgcagggaatttgtttggaaggcgtcgagttgtgcaggtttatgaacgtggtgctcgaattttagatggttcttttatgactcaggatttaagctttggaacttcaaactctgaaatgggttctggttcagagagctccacagtgctatcagtttctattgttgatccctatgttttactgagaatgtctgatggtggtatccggctccttgttggagatccttctttgtgcactgtttctacaagcattccagctgcctttgagagctcaaagaaatcgatatctgcctgcacactgtatcatgataaaggacctgagccatggctccggaagacaagtactgatgcttggctttccacaggaattgacgaggctattgatggtgctgatggtgtctcacatgatcagggtgatgtatattgtgttgtttgttatgaaagcggttcccttgaaatatttgatgtgcccaatttcaattgtgttttctctgtggataagtttgtatcgggaaatgcacacctcattgatacattaatgcgagacccaccaaaagatccccaaaaactgatcaacaaaagttctgaagaagtgagtggccagggccggaaagaaaatatacagaatatgaaagttgtagagctggctatgcagagatggtcgggacagcatagccgtccttttcttttcgggattttgaatgatgggatgattctttgttaccatgcttacttgtttgaaggtccagagactgcctctaaaactgaggattcagcttctgctcagaatactactggtgtaagcaatcttagtgcttccaggctcagaaatttgagatttgttcgtgtccccttggacacatatgctaaaaaggacacatcaaatgagacatcgtgccaaagaatgacaatttttaagaacattgctggctatcaggggttgttcctttccgggtcaagaccagcttggtttatggtgttcagagaacgtctacgcattcatccacagctttgtgatggttcagtcgttgccgtcactgttcttcacaatgttaactgtaaccatgggctcatatatgttacatcacagggtattttgaagatttgccaactgccgcctatcacaagttatgacaattattggccagtacaaaagattccgttgaaaggaactcctcatcaggtcacttactttgctgagaagaatttatacccgcttatagtttcagtacccgttcataagccactgaatcaagttctttcatctctggttgatcaagaagttggccatcaggttgaaaatcataacttgagttctgatgaactacaccgaacttatagtgttgatgaatttgagattcggattatggagccggacaaatctggtggcccttggcaaactaaagctaccattccaatgcaaacttctgaaaatgctctaactgttcgagtggttacactttttaatacaaccacaaaagagaatgaaacacttttagcaattgggactgcttatgtgcaaggggaggatgttgctgggagaggacgggttcttttattttcagctggaaaaagtgctgacaatacccagaccttggtttcagaggtttactccaaagaattgaagggtgccatttctgcattagcctcacttcaaggtcatctgttgatagcttctggccctaaaattattttacacaagtggaatggtactgaactgaatggtgtggcattttttgatgttccaccattatatgttgtgagcttaaatattgtcaagaattttatccttctcggtgacgttcacaaaagcatttactttctcagttggaaggagcagggagctcaactcactttattggccaaggattttggtaaccttgattgttttgcaacggagtttttgattgacggaagtacgctgagccttgtagttgcagacgagcaaaagaacattcagatattttactatgcaccaaagatgtctgagagttggaaaggccagaagcttctctcaagggctgagtttcatgttggtacccatgtgactaagttcctgcggttgcagatgctctctacttcatctgaccgaacagggaccaatccgggctctgataaaaccaatcgctatgctctgttattcggtaccctggatgggagcattggctgtattgcccctcttgatgaactgacatttcgtaggttgcagtcattacagaaaaagcttgtggatgctgttcaccatgttgctggtctgaatccaagagctttccgccagtttcagtcaaatggaaaggctcatcggcctggccctgacaccatagttgactgtgagcttctaagccattatgagatgcttccattggaggaacagcttgaaattgcaaaccagatagggacgactcgttcacaaattttctcaaacttaaatgacctctccataggaacgagcttcttgtgact

(The sequence listing continues in the following parts.)

What is claimed is:

1. A method of increasing biomass, seed yield, leaf area, root coverage, root length and/or growth rate of a plant, comprising expressing within the plant an exogenous polynucleotide comprising a nucleic acid sequence encoding the polypeptide set forth by SEQ ID NO: 501 or a homologous polypeptide which comprises conservative amino acid substitution(s) with respect to the amino acid sequence set forth by SEQ ID NO:501 and which exhibits at least 95% sequence identity to SEQ ID NO: 501, wherein said homologous polypeptide increases biomass, seed yield, leaf area, root coverage, root length and/or growth rate of a plant, thereby increasing the biomass, seed yield, leaf area, root coverage, root length and/or growth rate of the plant.

2. The method of claim 1, wherein said homologous polypeptide has at least 99% sequence identity to SEQ ID NO: 501.

3. The method of claim 1, wherein said exogenous polynucleotide comprising the nucleic acid sequence set forth by SEQ ID NO: 298 or an optimized sequence thereof, thereby increasing the biomass, seed yield, leaf area, root coverage, root length and/or growth rate of the plant.

4. The method of claim 1, wherein said exogenous polynucleotide comprising the nucleic acid sequence selected from the group consisting of SEQ ID NOs: 298 and 14, thereby increasing the biomass, seed yield, leaf area, root coverage, root length and/or growth rate of the plant.

5. The method of claim 1, wherein said nucleic acid sequence encodes the amino acid sequence set forth in SEQ ID NO: 501.

6. The method of claim 1, wherein said nucleic acid sequence is set forth by SEQ ID NO: 298.

7. A method of producing a crop plant comprising growing a crop plant which comprises an exogenous polynucleotide comprising a nucleic acid sequence encoding the polypeptide set forth by SEQ ID NO: 501 or a homologous polypeptide which comprises conservative amino acid substitution(s) with respect to the amino acid sequence set forth by SEQ ID NO:501 and which exhibits at least 95% sequence identity to SEQ ID NO: 501, wherein said homologous polypeptide increases biomass, seed yield, leaf area, root coverage, root length and/or growth rate of a plant, wherein the crop plant is obtained from parent plants which have been transformed with said exogenous polynucleotide and which express said exogenous polynucleotide, thereby producing the crop plant.

8. The method of claim 7, wherein said parent plants have been selected for increased biomass, increased seed yield, increased leaf area, increased root coverage, increased root length and/or increased growth rate as compared to a wild type plant of the same species which is grown under the same growth conditions, and the crop plant having the increased biomass, increased seed yield, increased leaf area, increased root coverage, increased root length and/or increased growth rate.

9. The method of claim 7, wherein said polypeptide has at least 99% sequence identity to the amino acid sequence set forth by SEQ ID NO:501.

10. The method of claim 7, wherein said polypeptide is set forth by SEQ ID NO:501.

11. The method of claim 1, wherein said homologous polypeptide is identified using the BLASTP, TBLASTN, or TBLASTX algorithm.

12. The method of claim 7, wherein said homologous polypeptide is identified using the BLASTP, TBLASTN, or TBLASTX algorithm.

13. The method of claim 1, wherein said nucleic acid sequence is set forth by SEQ ID NO: 14.

14. The method of claim 7, wherein said exogenous polynucleotide comprising the nucleic acid sequence selected from the group consisting of SEQ ID NOs: 298 and 14.

15. The method of claim 7, wherein said exogenous polynucleotide comprising the nucleic acid sequence set forth by SEQ ID NO: 298 or an optimized sequence thereof.

16. The method of claim 7, wherein said nucleic acid sequence is set forth by SEQ ID NO: 298.

17. The method of claim 7, wherein said nucleic acid sequence is set forth by SEQ ID NO: 14.

* * * * *